United States Patent 9,487,797 (GENOMIC PLANT SEQUENCES AND USES THEREOF) - sequence listing, part 90

SEQ ID NO: 81008 - DNA, 79138 bp, Oryza sativa
aacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatatatatatatatatatatatatatatgtatatgtgtgtatatatatatatatatatatatatatatatatttcaatgcataaaaaatatatacacatatacacaaagtttatatacgcataaaatataaaaataaataaaaaaatacatcatgaatagaaagtttgtatacgcgtatatacaagtttatatacacatatagaaagtttgtatacgcgtatagaaaagtttgtatacgcgtatagaaagtttatatacgcgtatacaaacattctatatgtacgaatacaaacttggtatacatacgaatacaaacttgatatttatacatctcgaaaaaaaaaggaaaaaaagccgaacagaagagaaaccggaaaaataacaaaccgaacggaaaaaaaaccagaggaaaaaaccaaacagaaacgaaaaaaccggtgaaaaaaaccaaccgaacataaacgaaaaaaagggaaaaaaacaaaaaaaacgaaaaactcgctcctcatccctgttagagtttgtgtcgaatatgtgtacatagtcggttacagtttaggactaggagttgtaataggtattaggactagagtatgagtcggactctatccaaggttctctcataaatagagaggcatgcctgttgtaaccgcatggcgacttagcatagcgagagggagcgactgaactccgttaacaaatatcgtgtctcggtgtcgtcatcgttttggatctcctatgacgttttcttccgcgtttagctaacgatgttgatttcggggctggttttataacaagtggtatcagagcctacatgaggtccatggtagaggcgcgatggaggtgctccacaccgcgtagcctgctgtaatgcccacggaggggcattggcgcaaggtgaagcatggcggagatcaacggagtcttgatcggtggatcgaacacttctggcagcggccggaaccgtcgatggctgctttcaacagggagatgactagacgtggtgctcgggttgatggcggcggaagcgattggcgatccaatcggtgggtcagacacttcgggcgggtggctcggactttccggtgagctactctcgacagggagacgtgcggccgcacgctcgggttgattgaagctggaggcgatcggcgttctcgatcggtggattcgaacgctctgggcggggtggcccgggcctttcgatgagctacgttcgacagggagacggctagacgtagcgctcgggtcgttcggcggctgggaagacggcatgcgacttgtcggcttcagctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaaccctggagaggttttggttcaacctgtttttccctctagcagacaagaagtaaaccacgtgggctgtagatcaatgacaacagttgttggtggagtcgtcggtggtgcttggcattggtgctagatgttgtcagagatacgaagaagcccaggaggtcagggtcgcggcggtgtgcgcgtcctgcgtcgaagccgagccggcgacggagatcagggcgatgccgagaaggagctggctagggttttagctaggtcgtgcagggttcggtcttgagggtttgtggtgtggaagacacggacatggagtcgtctccggttcggtcacggcgcggacacaattgaagacaaacagtggataccaagtttcaacacgaaggggaatcggacgaggactacgattagttcatgaatcggactcgattttttcccaaataaaagcagcagaggaccacgggattgcaacaacgcaatcgaaacaaatcacctagcagagggcgagattcgtacccgattttcgcaaaggcggaggtggtttgggcggcgaggtcacgggtggctggaggcgcatccttgcaggcggtgtgtggcggcgtggtactcggcggcgtccgtcggagctcgagcgagagcttgcggcggcggctgcggcggttcccgacgaagaaccggcgtaggtcttcggtggcggtgctcccaaggcggcgcggcagcctcttgcggggccggcggctccccaaggtccggcggcgcggcggctcctcgtgggtcggcacaggcactagacggcggcgggaggcgatggtggtgtgcggcggcgcaaggcagcggtgtgcggcagcttcggcaacgaggcggcggcgcatcgggtagggcggcagcgtgcgcaggagggaggagcgaggaagccgaagagaaaaggggatcggctcgatctgagccggtctttgaccgctgttgtctggtggttgaccgagtaaaggagaccgagtccggttttttggagaaagagaaaaaaaactgattcggtccggctggtactgttcgagttagtcggtggggtcgattgaaccagggcagatcaatttaacagggcaacagctattgagttgattatcgtcgatggcggcaacggtggtttccaaatttgaggtggtgaagttcgatggcaccgggaatttcgttctctggcagatgaggctgaaggatctgttggctcaacagaggatatccaaggctcttgaggagacgatgctggaaaagatggatgctggcaagtgggaggagatgaagacgcaggcagctgcaacaatatgcttgagtctctcggattctgtcatgtaccaggtcatggatgaaaaaacgccgaaggaaatttgggacaagttggcaagcctgtatatgtccaagtcgctgacaagtaagttgtatctcaaacaacagttgtatggtttgcagatgcaagaggagtcagatcttaggaagcatgtggacgtcttcaatcaattggttgtggatctaagtaagttagatgtgaaactggatgatgaagacaaggccataattcttctgtgctcgcttccaccgtcttatgaacatgtggtgactaccctaacgcacggcaaggatactgtcaaaactgagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaaggagaagggggcacggtgctataaatgtcatgagtttggacatataaggaggaattgtccgttactgaagaagaggaaaggtggcattgcaagtttagcagctcatggtgatgattcagatagcagcagtcatgagattctcacagtgtctaacgagaagtctggagaagcgtggatgttggactcagctagttcctatcacgtgacatcgaagcgggagtggttctcttcatacaaatctggtgattttggtgttgtttacttgggcgatgacacgagttatcgtttgttggagtgggcgatgtcaagttcaagatgtatgatggaaacgaggtgctactttcagatgtgagacacgtgccgggactaaggaagagtttgatttcgcttgggagcctacatgagacaggttggttgtatcaggtggattctaataggaagaccatgaatatcatgaaggacggcaagactgttatgactggtgagaggacaagctcatgtttgtacaagttacaaggaactgctgttgtaggtggagtcatggaagatgggcatgctggtgttgctgtgcacgatcctgaaggcggcgagtctagcgtaggctcgtcaggcggcttggcgtgagctgcggcagaaccaactcaagtcctggtacacggaggttcgagcaagtaacagattcggattggcgtggcatattcgccaaggtggagtttgttagagtttgtgtcaaatatgtgtacgtagtcggttacagtttaggacttggagttgtaataggtattaggactagagtatgagtcggactctatcctaggttctctcataaatagagaggcgtgcctgttgtaaccgcatggcgacttagcatagcgagagggagcggctgccggcgtcgaccggccgtgagtcgttgtaactctgatacgctgtatatgctggatcggggaggagcacccgtaatcagtgccccagagatgtaggctacggctgaactccgttaccaaatatcgtgtctcggtgtcgtcatcgttttggatctcctatgacgttttcttccgcgtttagctaccgatgttgatttcggggttggttttataacactccctccggcgcgtcgccgccccctccccgcgcgcgacacgtgtccagtcgcgcggggagggaggcgcgcgactgatcgcccaatagcaatctcggccccgcccggcacagcggccgtgcctaggccaaggtcagtcgggccagcatgggcctgacttacacgtcaggccatgccgggctgacccaaaggcatgatattctatcgtgcttctctacagaataagtctatttttcctatcttaactctttgggctttgtctatatggctggaaatacatctattttgtatttctcttctctttgggtcttaccttatatggttgattaagcctattttgcgtccctctactatttttcttccattgtactgggccgtgccgacccaacgtgccgaggtagcagcccagacacggcacggctgttgggtcggggcggcacaggcacaaccccagtcaggccgtgccgtgcttgggtcgggctaaattgctgccttgggctgggccgtcaagcctcgggccatatggccatctataggtgaagcaacaaatgtcagtgatggcaaagcttgacgccttgtaacttaaacgccgtgattaggggctctactaagtcaaagctaaagctaaagttaaaatataaatttttaattttaattttaaagttaattttaagatattttcaacgtagtttttttaatattagcttttaagtcgctaagagcatcactaaccgcaatcctatttccttactaaaactaattttgagggtttttagtgaaaaaattggatccaacagattcccaaaagcactgcaatagttttggagttcccatccccatatatttcgctctatggatttgagggcgagagagtgactcccaatctctcgttcgcgtgtttctcctctcctttatgcacgagcagtgaaaatttctaaatttctgtcggtgatcgcgatctctttctgcgcgcatggaaggaaaaaaagggaatttctgttggttgtttaacagaagggcccagtttttgggattgaatatcttttggaggcaggagtattttcacttcctattttcagttttggaaaaaattttgggatagattattgctaatctgttggtgatgctatacatatacaagatttttacatatagattaattttttataccttaataagccgtttagggaatgtgagcaaccgacaggggcggagccaggcaaaaatggcatcggggtcactatagttcttattctttactacttacgtacaacatgtactatctccgtttcatattacaagtcgtttttttcttaatcaaacttgtttaagtttgactatgtttatagaaaaatatagtaacatttctaatagagaataaacattttatttaaaatatgtggtatactctctccggcccattttaagcgcaatcataaatttatgtgtccattttttatcgttagtcttatttgaaattttttttatgattagtatttgtattgttattagatgatacaacatgaattgtactttatacgtgacttatatctttttatttttttcaaaaagaatgaaataagatggatgactaaatttagacacggaaactcatgagcttaaaatgagatgaagggagtatttaagtccagatggggataatttgttttagttttcacgagggcatgatagaggaaagaagttgaagatggggataatttgttttagttttcacgagggcatgatagaggaaagaagttgaagagtgtctgcttaaagaaaactagggtttttgttaggaggcttggctcaagggatctgagccttcgttcctttttctctgattcaacggtggtggaagggtcggcacacagggccacatggatggttggatcaagcctcgtatcagatagtacggtccacgtgaattcgaacgtgtttgctatttcaccagatgatgaggggttttctaaaaaatcgctgacgtggcgctctcccagcaatcccacggcttttaagtaaacctatattacgtgggcagccagctctgtactacttctagttagtaatataggcttgtaggccttttatgatacacgtcattacctgaaaacaggcttgaaaagctagccttctaatccccaaaacttaatggccgagctagtggaacgagatggcaaaaagaaacggggtcagatcaaaattttcaccggggtctttctagcattactaaggtggtaaggtggtgtttgggaaggaggaactaaactcacaaaaattttagtccctatagaaggggtttatgtttttgtaaaagggactaaagttcagtggtggagccaggatttcaaagttgggtatttctgtctaacaaaaaaaaagttcatagtagaaaaaaaatcaatggttcacactatgtcaatactgataatctaaaaaataaaactacaaattattacatggtacctctaattttctacctcaggcacaacctcaactgcagtaatctgaatctgaactggactctcatttgcatatgtaatcggctgaacaaaaggaacagcaacttcgctatcaattctaacgggctgtgctgttgatccagaaccagaacctgaccctaccttcctagactttgaatgtctatcccacaaagtcttcaaatcaatcgatttcttcttcattttgagagctctttaatctacagaactacagaagtacagaacaaaaaaaaaaaactactcagagactaaggtaaaaagacatggacacatgatgagtggatttaggctgattgaatcttgaactcttgattgctcacctgaagttgtgcttgccgccgggcgctgtcccgttgagccgcagccgctggccgccgcgcccttgcccctcgcggcctcgctcccgctgtcgctggtcgcccgtcagttgccgcctcgaggcctcgccgcgccgccgccgaacgcctcactgcgccgccgctggtctagctcccgtcgccaatcctgtcgccgcccaccggaagccggttgccgctcccgccggtcgccgcgccgccgccgaacgccaccacctagggtttggaaatggggaattggggagcgggcgagcagcgcgtgactgcgtgaggcgtgagcgcgagccgagccagggactcaggaggagtggggacaactactacgtgtacatgtgtatatactgatgttaggtattccggggaatacacaggaatcactgtagctccgcccctgctaaagtttagtccctccttctcaaataccacctaagggtattaccccagtgagagtatggtagctccacccctggcaaccgaggaagctacgagatcaccatgcaggtggaggtcgtccctgatctttctttagcacctcaattaatagggttttatgggttcttttggaccggagatgacatcgagagagctctcgtacgaggtttaatcctcttatagtgctaaaggagatatgaacaatttaatttatttgaattaactgcgcaatccgatcaatgcacaagtttaagaaacgtgtgcatgagctcgagaacaatagtcagcatgtcggtgacccttcttcttacggactatccgtaaataagaagtcgtcacctcgccaatcctcttatagtgctacaggagacatgaacgatttaatttatttgaattagctgcgcaatccgatcaatgcacaagtttaggaaacatgtgcatgaactcgagaacaatagtcagtatgtcggtgaccctcctccttatgaactatcctattaccatacataagaagtcgccacctcgctggagatcacaaggaaggtggtctagaggagggtgttggtgtggactgtatagagggtgataacctctgcttccgtcatgagtgggaaaacttctcaagtgcttagtttttctttaaaaaaagtatgcactggatttggcttgaaaagtgttgttataatatcataaaacttaaattatatatatatttatcttcgttagatagttgaagttttaaaagtttggctcctaaatgctagtaaatatttatgaccaagcacatgtttagtgcgtttgtatattgaaagaccaccacataacaacgagccatgtgtttatcgactcaaataacgattagctagagtattatagttcgagttcgtcaaattgttaaagtgccgtaggctcacctgtctcttgaaccgttgacgtcagtttttttttttttttggcatattgtcctaaattgaaacgtctcgaatacgtcttgttgcttattatttttaatctcactctttaaccgtcgatctggttaggtttactttggaatgcaggatatgaggtttactttgcaaaacaggataaataaaacataggaataggaaagttatagaaatataataggattgtatatgtatatataggattatcactaatctcagtactttatagcatgctaagccattgctaatggaccacgcaggaagtaaaaaattaagtagcaaaataactgagtgttgtttctgttcctagcatataggaaaataaaaagaaagaggtttgactggacggtttttttccccgtaattttcctttgagttcttcctatgtcccaaaggtaggaatagtgcctaaatcctttataatgtgaatactgagtttttccttaaaaaaactgcaatccaaagtaccctaattgtgtttctcattttccatctaatatttccatgttatatctactcactcttacacgaatgtatacaacatactaccgctaattacaaatggttctgttacactgtttttcccaaaaagatatacgagttctaaatgactttttaaaatttagaattgagttaaagggattaaattactccatccattccataatataaggcacaaccactttttttaaatgttccataatgcatgcaattaactatgacatattctccattaaattattccttttttaaatcatccactctcatgttatctaattttattggatacatgagagtatcatgcagatttttgagccaggggatcaacaccaaacaactcagatttttcagcagaaaaacaattacaaaaaaatatataaaaagaaaaaatagggatagcaagcctgccttttaccgagcccaaccacccgaggcccattaacagacccaaaaccaaacttttaccaagacccattaacaggcccaaatatcatctgagccacattgaacaaacaattttgctatatatttgtcgacaaattttctcccaaaaatttgacagatataattacagtacaatcgtagtgtaattacattgtaacttacatataattacactgtaactataatgtaacttgtatgtaactttcaaaaatctctttgtaacatgttatttcggtaaatgaaggtcatgggaacaaatcctttcagtaaaatggaggttatgggaacaaatcctttcacatatgtatgtgctgcgattttttttcttcctcaccagaacaaatcttgtaatagatctaatgattcaaaattacgtgaaacttatatacaagttacaatgtaattgcatacaagttacagtgtaattacactacgattatactataattaaatctattaaatttttaggagaaaatttgtcgacaaatgtatatgtggtcatgcaagcccaaagcacgcataccgaacttaaagaaggcctataagcgtgaacgaatctcaaataaatcaaacggtctaaaaaacgaatgattcagcgctcagaaatcattcgactgctgtatagtctttccgttattaggatgatctaaactacaagatcataataattattttttagtctttagattaagagtggttgtgtcttatattttggaatggagggagtcctatatttaaaatcggagatagcaattactccgaattccgaaagctcagtttgacatctccaggagctcatcagcaaaatcctggacatacgtaacgcacggaaaaaaattaaaaatacacctctttttcattggttttatataaatatacacgtttacgaagattttgcacaaatataccactgtcgtgaaatgaaagtgcgagatcgagctaattacttgatctcgtgcggcaggtgtgcgagaccgtctcgcgcgagaccgctccttcgcttccctaaccaccgtattcgcgtgagtaataaattaattagtgtcattagcagttaattaattaattaatatttatttaattaacatcattagtaattaattaatcgttaattatacgctaatcatgagccatgtcaggccatctcgcacgctgctcaagcgagatcgcttcttgtcttgccgtcacgccggtctcgcgtcctggtcttgcgagaccgtgcggtatcgcttaaccatcctggcctatcgtcacgctatcgttactttcgctgaataaatcagcgatattgtttcgcttttgcactttcaatcaacgacgatagtatatttgtataaacaaaattacatctcgaatattaatgagaaaaaaataaaaaacggtatattttcatatttaattccgtaacgcactgcctagcgagggttggccaagtttcgcttgggggagtagaattctaggtagacacagatatttccaaagcaaacgaaacgtgtcgccttccctccttcccaacggggagggttccgcacgcctcctctctctctcacacacacacacagccagccgggtcatagggcacgtggggcccacctgtcagctgccgatcgacaaggacgagtagatgatcttctgcgacgtgtacgtgagctcactggcgttcctgcttttattaacgccgaaagagacgacgacgactttttgtgcttttatttactaacccttgttgttgttgtttttttcagaaacgtcctccataaatcgtacagttgtttcgttggttgctgttatcgttactgacttcctgtgcgctgaaagataccttcggccaagcgggctaattgtagcgtgtgtagcttgggaataaagtagcagaattaatttttgaaataatattatttttgaaaaattgtaaaagtagaggttgatgttgaaacaacaatttagcaatagtaaaatggatagcgaacaagcaggaaagtggatgggttatgagacaaatgatttatacaagttcaggccttctcaataagaataagaagtaataacatatttctgtttgaggatttgattcacttattttggtattgatctaaagatctcaagtgtggttatgttcacaaggggccctgccttccttagatagtcggaggagataagattacaagatagagactttatcccttacagtctaaatccctataactactttacaatcgtaactgactaagactacatgatatttccttgatatgcaggttaatacaatatccgagtcttagcctatacatattctaatcatatgatatatcccctataatcagttggatagtctagccttgtgggtatatgatacccataatttccacagtagcccctgagaccttcacagtctgaaacaaaacccttctctcaaactacattatataacagccgaatgcttcaattcttcctcctgcaatctcccgagtgcttttatccctagtaggttgtgaagggctgaaaaataaaaattaggtgcatcgactagatacacctaattaggtgtagcccccgactatgagattagttgaataaactaaacatatagtcaaggataaaataaaataaccaaccgagtggtttataacaattatagtcatcaaaatgacttaatattatacaacacatattgtgtaaatccttgaataatataactcaagtgatatatcgactgctttttattaaaaaatattccaaacatatattcaacctaagccataaggttgattaataaaaatatgcacttacgtgacaataagcaatgatattgtatccaatcaattgctaatataacctaagcagtgtgttgacttataatcatataaaaaagtcagcaggacagttatgaaaaacttcattgctaggcaccttttaaaatacattgtatcaactcctaaaacattgtatatctgcggtatataaaaaaggattttaaggtattaggtacttgatcatgcgtatttttgtctaagaaaaaaacacctaagtctctaggagaatgtgacagaccacacctgaaattatgggtcgaaaacacttcaagggcctcggcccaaatgaacagtgttctccgatatcctaattataaaaaatttggtttttggtatttcaaccattcgcccttctctggtaggcttggttcttgtattcgatcctacacatcactcgtcttgataatatggtattcctagactctaaccaaagacttatttaaatttggattattttttgtcttttttaattttcaagatcaccaatcgtcattaatttcttcatggaactaatacactttcaatctttcgtacaaacattaaacacaatagatacgttttgttttatcatcaattcgccaaaacccacgggggatctaaatgcactttcaacacgtttattagtagggtttcaataatgccttgttggtacttttgcaatacataaactcaaataattgtttgttcaaaagcatagtaacaacaataatagaatgcctaaggctgtgttcgaactataaggaaggttggggatcttctagttcgtgcacataaaaatggagtagcttattaaagcacgattaatttaagtattactatcttcgtcctaaaataagtacagccgtgggtatccgtgtccaacatttgaccgttcgtcttatttgaaaaatttataaaaaaattaaaaaaatagtcacacataaagtactattcatgttttatcatctaataataataaaaatactaatcataaaaaaatttcaaataagacaaacggttaaacgttggacgtgaacagtgtaaaacattacttattttgggacggagggagtagttgtaaaaaacttaaaaaataaatcaatataatttttaaccaactttttatatagatttttttttcaaaaagattcgggaagcatgcatgcaaaagagagagagaaagcagaagtcgggttttatctttgatttgactgtgcttgcattttatttttctctcttaggatggctaggccttctctccattctatcataactatcctcccaatctcgacattacatcatctaaaaggagcactattttttccttaaactataatctgtgttaaataacctagaaagcaactactatactctatattataagatgtaagcatttttataatttttcacggaaattaaagaaataggtgaaattgaacggtggaatgttgtaattactccctcagtcttaatatgtagcaacctcggataggtcctatccgagcttgctacgtattgaaaatgagagggtaggggtgtaggtaagaagaattaggaggagaaactaaatgagatatggttgtgcttgtttgggatgagaaaaatgtagagaaatagttatatcttgggataaattcaaaactaaaaaaggatatattttggaacgatggagtagtactttaggagggaaggagtagtgtatttagcaaactaactacccctggtaattggcaggtgtacgttcgtgttcatatagaatagagatgagtgtgtgagctttgtgagcgcatatatttgtagtgctgtgttttaacaaaatatccacatccttctacttcaatataaccaatctatagaggaccattttgtaattaccacaacacccagaagtctaaacagatagagtactggaggagtagtactactgcaaatccccaccccaaaaaaataaaaaaaaaatctgctcttaacaactccctataaagctaccactacgcccccctaccgcggagaagcaaccaatccaattccgaacaagcaaggcaccaaatccccccaccatggatcaccgcctcctcctcctcggcctcctcctcctctccccggcggtggccgccgcctcagtccccggcgaggaggagccgctgatccggcaggtggtcggcggcggcgacgacaacgagctggagctgaacgcggagcgccacttcgccagcttcgtccagaggttcgggaagtcctaccgtgacgccgacgagcacgcgtaccggctctccgtgttcaaggccaacctccgccgcgcgcgccgccaccagctgctcgacccctccgcggagcacggcgtcaccaagttctccgacctcaccccggccgagttccgccgggcctacctcggcctccgcacgtcgcgccgcgccttcctgcgggggctcggcgggtccgcccacgaggcgcccgtcctccccaccgacggcctccccgacgacttcgactggagagaccacggcgccgtcggccccgtcaagaaccaggttcccctctcgtctcccgtcgatttttcccccaaaccaaggactcctcctttgatttctcgattgaatcagccgtcttatcgtttcttgattttttttaatttttttgcttttgcagggatcgtgcgggtcgtgctggtcgttcagcgcgtcgggggcgctagagggagcgaactacctggcgacgggcaagatggacgtgctctccgagcagcagatggtcgattgcgaccatgaggtgagaggcgtttgcttcccctttcttgtttttgcgtactggtatattattatccttttattaggagcaagttttatttgtaattttgtgattggtctgtgcttctatgggtgttataagagaggttggatgggtgctataagagaggttggatttttctggctttccgccaatgttttgtcagctgctgcgctgtccttttcctatctattttcttggtttgtgattgggcagcgcacccaaatgagaaggggaaagggaaattggggcaaatgaatgggaaagggaaatttgggaaaggagttgcatgattccttggctaactttgaaagggaaattatgaggaaaaaagagtggcttgtggtattatcagtgcttaagaagtcaaaccaaagtggtgaacttagcaagcaaatttgtcgtggtcgattttatagtggtgaagtaggtgaataaaacaaaagatgatgaatgcaaggctgagtggataaaatctccaattgatactggcacatgtcgctctggaagatcggtctaggtaggcgtctctctgggtctaccgcaggtggataaaactaagatgagatctaggtaagcgtctctctgggagttcatggtgaccttgtgcattgataggtctatgaaataagagagttcatgcacccttgtgtgttggtacgtgcctatggtatggtaacgaacaagcgtatacaattgggcacaaagggttgtttgagtgggcacttaatgaactgaaaagtgctgaacttgggaaccctatgattagttaaattttagagaaagggagttaagaaagtacccgatgttctggggttgtcatgtattccagcaattttagtttttaggtactagtgaagctaccatgaagaagttgtaaattactcaaatctcaaccattaagttcacttgagtgaaaaatataaatggagtcgatatcggccgcaggttgtttctgtcattgcttcatttcttattttactgtctcacttgatggatagacagccaaacgtttgtgtgcactggcttgatgtactctttcgttttggtaactgggccccaggtgagaccccatcttggtgatattgttgtacaactgaataactactgtaccttttatatcattatatcggttaagaaaaaaataatcaaatttcctcttttcttttggatgtgtcatcatattttaggggcaaatttccggtttcctctttcatttggttgtgtccatcatattttaggggcttgctcttgacctatttctttccatatttacttcttgaagcttcactcctaaatcctaattaatgaaaaagttagtgcttctctgttctgttcaaaaataaaacaaatcttatttccataataacacaattcactaaaccatccttacaaagtctgcaccaccgttttaatttccgcctatagcatgggtgattctcttcctagttgaaaattctatgtaggattttttggtagtaagatgtaagtggctctcattctagaaggcttttcattactaagcttctacattaggaaatgcgagaaatatttgttcagaaaaaacaattttctcatatatttaaaagataatcaacagtgattcctatggtaattttacaaagtagcaccaggctaatgtcttgcacaacctctacaatttgtcgtaaccagcttaagtgattttcacattgctttcatcgcaaagtacacatgtaaagcttacccgagtcgtgctcaaataatttttagccttcctggtattataatactttttttgacttgacagtgggatatgtactgttgttatttgttttctactgttacctgtttcaactgaatggggtatctcaacttactgggcttcattgttatctaattttgcagtgtgattcatcagaacctgattcatgtgatgctggatgcaatggtggattgatgactaacgccttcagctatcttttgaaatccggtggccttgagagtgagaaggattacccctacactgggagggatggcacctgcaaatttgacaagtcgaagattgttacttcagttcagaacttcagtgttgtctctgtcgatgaggatcagattgctgccaaccttgtcaaacatgggccacttgcaagtaagtactataaccatctctcggaatgatgcatttgcaggtctgactgttatatgtaaatacatgaatatattgtgcaattgctgatgaatgacttcacattttcctgcagttggcatcaatgctgcgtacatgcaaacatacattggtggtgtttcgtgcccgtacatctgtggcaggcaccttgatcacggtgttcttctcgttggctacggcgcatctggttttgctccaatccgcctaaaggataaggcctactggatcatcaagaactcctggggcgagaactggggagagcatgggtactacaagatctgcaggggctccaacgtccgcaacaaatgtggcgtggattctatggtctccaccgtgtctgccatccacacctcaaaggagtagattctgatcagtagtcccccgaccatcctgtggatggttcacagttggtgattctgatattatatataagctagaactacgaaatatacttagtttatgctccatctgcgctgttattgcagttatgataagcagcgatgatgtgaagctgcaactgaatgtttgtcctaagttatatgcttggtttgctacgcaatgctacacgctatttggaggtagctttaagtattatcgccattcacgaacttgtatttttactattaccaatcttttgaatggtctgtattatatgcatgtggtctgtttacatggaataactctgtctattgctacgaatttgcgtcttgcacattctccattttaagggactctggtattgatatttcagtatttgaatctgtacaagctgcaagatggttgggttattaccatacgagttataactacttatgcttaacaaattatggacgatagcaaaatcttggtataatccctcgagtggaactttctctctttaaatttaatgtaaatggttgtaaaaaatatttagcaatatagcgtatagtaacatctaccactgtaccaaaagtcattcaaaatgaatgttgttaatttttttagaacttttagcaactatttagatagcgtttgaataaatgaggggatatctcctcgagagtttaaaatactttctcattgtccgtggcattctcatgttagtaagactacaatctctacttatatgatcatatcaacacattttattcatattatggaaattgcaagatttgccattcatccattgggtaggggaggcgggaagagaggggaggaagagagatgacaaggactctgtggctatggtagcgatggtacaaagttgtttctcttccctagcaagaaggggcatgtagcttagtggttgtagtagccttagtagcatcccaggtcctgagttcaaagctctattagtggcgaatctaagaagaaaatagagggggtgttttattcgaatgagagtttcaggcgagtagtcgtctagcttatcacgtcagtggcgaatccaagaagaaaatagagggggtgctttgttcgaatgagagtttcgggcgagtagtcgtctagcttatcagacaagctattgacgtatgattacttaagcgctgactattataaactttaaaatttgatttatttgaattttgatgaaatttctttataagatcttttttcaaaattaagaaagtctagtggtttgacaagcacgcccacaaaaagtaccttaaaaaaactctaaatcccaaacaacagggcctaaagctagtaaactatactaccccatccaaaaaagactatcctaacaacgaatctggacacacatgtatccagattcgtacttaaaattggtttttttatgggacggagggatacacgccaatctattgtcaatcaaatttctgatttgtacgagaaagaactcaaaataaagaataaaaatatactaggtatgatagctatagttggctgtaaatatatatatgaaaaacggttcgatgttcttttttcattttttttatttggttgcacttataataaaggaaccagttagataaatatatatgaccaaaggcaggtagtactgcttccctagctagccagctactagtttgtttcttgctgtgatgacttcactagagcacgtactggatgtatgtggatagatacttgttacatatgggctatggccggccggagctggggctggagccctaaccagccccaacgatgaatccgccgctgagccccgtgggagcgaattttaggctaggtaaaaaaggtcactcgctagggaccaactagtgatgatgagcattattggtgacgacttgacagattagggtttagggttgggttgagggtggtaggaggggttaaggggaggtggccagccaacaataggctgtggatagtggacaagggtgcgtgacaaggtggcgatgaaggtagagtttgtgtgatttggtaggacaggtctcatcagcaacaacaaagcaggaggggggggggggggcgacccatgtggaatcggttagggaaagagcgagaagggaggttgaaggcatccagtaggatcagggacaaccctaggctccgagcaccctgggccatgatccagggcctaggattaagaggcaatgggccaagataaattttcaccacattgggccaaccttgtgaaaatccagtataggtcataccgaagggggggggggattaagggtaatgttgtcgacacacgaaggatgagggagtgcatgtatcgtggagaaggatacaaggggaagataaggcttctatttaagcataacgaatcttggcgtgagctagaccattcaaaatgactaaactttgcaggtaattgaggtgaccgaggaagatggaatatgttgttgggtgcaatgtactagctgtagaaagggtgaaagagctgcccctagtggattttggtttattgatgacaaacgattaagggactaatgcacttattgagtgtataagcaagtgattagtccgatgaagaagctaggaaatggacttatcgatggatgagaattaaagagaagatattgaagatgcgggtatgaagtgactacctatggcaagatggtgaagcgcaagcgacgctcagctgcgatggaccatgcagtggtgaagggcaagcaaggggcttggcgccgatgaaccgaaaccggtggtgaagggcgagtgaagactgtgtcgtgatgaaccgtgcgaggccatttgaagccatagattatccacatcaatcatttgagaaatagaagatgaaatgccaaagatcaagaagatgagatcttcccgatgatcaaatgaccttgacgttggtaaccctccaagtgaagaaacaatatggtgtgaaggtactcctattggtataactttgctttttaaatttgagtttaggatgccgtactattaagagggatactacatgcatataattggttgaatactagtgctcaaaatgcttcatctttgtgtgagttgaaaaacctaagccaaaatttcaatcccgagttgtttcacttgtcacaacacttacatcgggtttctttgcaagtttttcataatctcttgaaggttttggaccatgttttatgttgggtttgatagcccacgaaactagctttccataaagtccaagatcttcgaaatcggagttcagagtaaaaagttattgcatttttacttgagcaacatcagactatccgatttgaaatcggactatccgatgtatcggactatccgatttttcacagaacttcactctctgcctttgtttgaaaaatcctttcgagtgagtttttctaagtgtcggagtatccgatgttggatcagatagtccaatgatacagagactccgaaatttcatggaacttgagtctctgttggaggatgaagtttttgcttctaaaatatcggatactccgatttaacattagattgtccgatgtctcggaaagtccgaaatttcatggaacttcattctctgtttcttgttgccttggaggtttaaaatatcggactatccgatcttgtatcggactatccaacgtgggctgaaagattcccctccaacggtcacattttggggggatctatataaatcccccaccaacccttttctagggttgcctaaactgatttcattccaatcttgctttgggttgagctttgtgctaagtgctttggatctttgagctctctccctctctatctcaaatcccccttgttctttgtgacttggatctttgtgtgtggatttggactttgggagcctagtgtgtgtttcttttgatcttgagcactaggatttgtccaagagttgtgtggtgtttattactcttggaggttgaggactcctagacggctaggtgtcgttcttgggccaccgatctacgtggggttggccaagagaagtttgtgaaggtcggatctcgcctccgcaaggaaagagatacccttagtggaaggaggagtgcatttgtgcaacctcacgaggatagggttgaaaaagacccggctctttgcgagcccctcaacgaagactagaatcccctcaaggatttgaactccgggaaatacatcggcgcataaatctcggtgatatcctcactctctttaccttcttgttccattgctttgtgctatgctaatattatttttggtcgagctcacctctttgcttgtggattgaatctagatctcttaggttgttctcttatttgtattgttgttgtgcagttcagatagtctgatctcagttcagactatctgatcacataggactatccgacctgatatcggacaatccgaccctgttttgttttagcttccgcctttatttttaaaaccgcctattcaccccccctctaggcgacatcaaggtcctttcaaaggggttggagcatccgccgctaatgcgtggcggcagacatcgaggtggcagtgatactgctgttgtggcggcgccactgccccgcccttgttggctagtcttactgcgtcttagatccactgcttcctcttccttccactcacccctactagagcaggccaccgaatttgcccgcgtgagcaagaccttaacgagcaccaaggaggcggaagatgagggagttgagccacctttgatttttcccatatccgtgtcgagtacgccgtggatggggacactgttgagctcggtgcctcggtgggtgcccttcctctcttcctcatctcaccgcggtttgagcttcttcccctcgatgcttgagttctcccccctcatcgcctcagcctcccggatccttcctcttcgccccagccttagccggctccacgagctttgcccttcccttcacccgtctggcagtcgagtgtgtatcactggaggagaggagatcgacatctgcaccatcacactactgagtgctgacttgctaatggcggcttcattggtagagaggagaacgggttcgtggagaaccgttgcgtggatgcatggaggctcacaacaatgtctcggattctgccgtggcgtcatccaccgccacctgcctcctttgcattaccgctcgctgacatcttgccctcgctctattgccctttggtaggagatacggagaaaaaaagggaaagagagagagagagagagaggaggaggaggaggaggaggaggaggaggagggaagtagagagaggatgacacgtgggtcctactaatttttttgggttaatgggatctatgccattgcaaatttgcctattcagaaaaataccattataattcgtctattcatagttgtgccattgaaattttagaaaatttgaaccgtgacactgctgtcatgttttccatccaactccttcctttttccatcttcttccttccatagggaggggcaaaggccggagcatgcgccatcattgtagaagagctcaacgctggtggctgcggcgagggagtcgccgttgccggcggcaatggcagcgggggagcagtgcaagacaatgacagagttgaacggcaagcggtcgccggccaccgccaccgtcacgacaacccggcatgtgggtctcaggtcgttggtgatggcaggccgagtgcggcggggttacgtgccagccagtccttgagaaggccaccgccgtcgttggcagcggcgaggagggatgaggtttcttctccttattgctgggtggcagggccaacagtagtgcgtcgttggcgtgtaggggcgatgggggaggaccatcctgcagcggcgtatgtccccccaccaggcacgacgtaggcaagccaagccggcaggctggactgatgatacctcgccaagtcgccatgtgggtcccacatgttgacttagcgagttaacaacggtcaactaccatattagtaaaccactttccaaaccaccaaagatttgcactggttttcgaagattgggaaagcattagggcatgtacaatggtgtctaataacgggctctcttcgttgtcatgcaggtaaatttggtgacgtggaagaaagagagggaaggaaggagaaacatcattgttatgcatgacagcggctcagagtcaactcttagcgtttattaacggaaagtttgttgcatgagggtggagaaaaggaaagaagtataataaaaaaatatttagtgtattaatggtttagaaatcttattgtctctactattgtagaaggatagtctctaatgtcattaattaatatagagagctcatattagactctacctttgtatatgcccttatacccggttttgtggtcgagggagaaaattcagtaaggagcaagagttgagggttgcaaataaacttattccatatatggtaggtgttctgggccttaagcgattatgcccaacccatgtgaggcccagtcctccaggcaccttgacacaggctattattttctgcgaatattagcaagtagcaaccatacgatcgtcaattccactactagaaaactcattttcggcgtcgtaggggatcgattttcacaagcgggcatgtaattcggtgccaaaacccggccggaaaaaaagtacccggggtggagggggcagtccgcctgcaaagatcaatcctcgcaggcgccgcttatatggcccgcctgaaaagatgcccctatatagtcttcttcctccccgagccctgttcattctccccgaagtttctctctcctaaagtgacttaaatataggggggggggaggttttgaacttcaaatctttgagggatttttctacggtgcttagatctactcatttccacactaggtatgcaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcaattttttttatttttgctatcacatccacctcctacttctagatctagatctagatcttgtcatatatatagagagaataaaatttttaatgtctatttattcggtgcaataaaaaaaagttatagtattttgtaatatgccgatgatatgattttgttagattttcctaatgtactaatttggcatgtctgtgtaaaaaaaattgaaataaactttgattttttattaatttacacttaacttttagttaattagttttgaatagcgataagttttttcaataaaccctacaaatttggtattaattgtgcaaatattttatgtgtattttttttagagatatggaaagtcgggaatggatgtatcattggccgaggtttttgtctccatatagaaacgaagtgtctaaatttattggtattgccaaggcacacgctgagaagaacaatatgaggaagataatttgtccatgtgctgactgtaagaatgaaatagcctgggacttcgacgatgcttttaaagtgaaggagcacttagtaactcgtagatttatggacaagtatgaaatatggacacgtcatggcgaagaacaagtggacgggcctgaaattaatgtagttccgacacaagttgaagacatggtgcatgacaatggttctgttgaggacaaaatcgacctagaggaaatgttatgtcatgcagaacccgaggtgctgatggggtcggctagagggttaaataactttgaagctttacagaaggcagcaaaggaagttttgtacgatgagtcgaagggctgtgacagtgagttcacaacactctggtcagttcttgaacttatgaggttaaaggcgagacatggatggtctgataccagtttcgacagtttgttagaacttctgcagaaaatgctcccgaggcctaactcactaccatccagcacatatcaagcaaagaaactcatatgccctctttcacttggtgtggaaaagattcatgcgtgtgtaaatcactgcatactgtacaggaaagagtacgcttctttagatgaatgtccaacatgcggtgctagccggtacaaatcgaatagcaatactggcctagaaccgtctgacacaactgagggacgacagagaaaaatcccacagcttgtgatgtggtaccttcctgtcaaagaccgcattaaacggatatactcaaacccgcgagatgcggaactagtgtgctggcatgaagaagggcgcaagaaggatgggatgattcgacacccggcagatgctcgtcagtggataaactttgatgctcagtacagagagtttgctaaagacccatggaacattagatttgccctgagtactgatagagttaatccttttggagacatgagcagctcacatagtacttggccagtgcttctcaccatgtataatcttcctacctggctttgtcaaaagcgaaaatacgtactactctgtatcctcatacagggaccccgttagcctggtattgatattgacgtatttcttgaaccattgttggaagatatggctgatttatggaaagagtgattgaaagtgtgggacgagtacttaagggaatacttcacagtgaaggccatcatcttcgtgaccattaacgattatccagcaatgtttttagtttcaggtcaaattaaaggtaaaacaggatgtgtgatctgcttgaatggaacgtactatatgtatctcccgggttccaacaagcttgtgtacatgcggcaccagcggttcctatgcacaaatcacaagtaccgcaagatgaaggcggagttcgatggcactgaagagacagatcctgcacccaaaccaacctcgggagaaaaggtgtgtgcaatgacagagaaaattgtttgcgagtttggaaaagtgactaagaaaccatcgaaggggacaaagcgcaagaaactcgagaagaatacgaaacaaggggatagtaaaaagcaagatgatagttcgaagccagatgataaactccctcccccattcaagaagcattccatattttttaagtacctcccgtactggaaagatctggaggttcgacatgccatagacgtcatgcatctagagaagaatgtgtttgacaacatagttggaacattgttggacatgccgaacaagactaaagatggtttgcaattaaggatggacctagtcgagatgggaatcagggaagagttacaccctcaagaaggagaaaaaaaatggcaaagtatatcttccaccagcctgtttcacactgacacctgaggagaagaagtcattttgcaactcactccatgatgtcaaagtgcccataggtttctcatcaaacatcagtcgactagtttcaatgaaagatttgtcggtatctggttataattcacacgattgtcatgtcttgctcaccgtgtttcttgcaattgcaataagggccataaaaccggagcatttaaaggttgctatcacaaggttgtgctactttttcaacgcagtgtcacagaaggtcattagtctcgaagagttaggaaatctccgtacattcgcacaggagacacagtgccaacttgagatgtgtttccctccgtcattttttgatatgatagagcacctcattgttcacatagtgccgcagatggttgcgcttggcccattgtacctccatcaaatgtggtcatacgagcgttacatggcggttttgaagggttacgtctgaaatcgtgcacatccagagggatcaatggttgagggttatagtactgaagaggttgtcgagtgctgtatcgattacctcaaagatggatatgcaattggagtacctgtgccccgacacgagggcagattgagtggcaggggaacgataggaaagaagagattcgtcacccatgatcacaaatcattccaagaagctcacttcagcgtgcttcatcagtttgctatcgttgagccgtacatcgatcaacatatcgaactaatacaccaccgagtggataatgaaagaacacaagcgtctcttcgtagattggttgcgagacctagacttacctgagggacaaactaccgataaaataactatgaagcggttggcttgtggtccatcaactacagtaaattcttggcagggatatgacattaatggatactcgtttagtacaagagcccgagataataagacctatacgcaaaacagcggtgtccgtgtggaggcaattgatgaagccggggaaaaacaatcatacttcgggtttattgaagaaatatgggaaatcgactatgggcacacaatgcaattccccatatttaagtgctagtgggtaaaatacccgaacgggatcaatgttgataagttcggtcttaatgttgttgacctggcgagtgtgggtcacaaggatgacccttgggtactcgcaatcgcgtggcacaagtgttttacgtgaaagacccatcaaatttgaagaaagatatagtgctacccgggaaacaaaagatattgggagtggatggggttgaagatgtcgaagattacaatcaatacgatagtataccactttatagtcagtttgtacagaagattaagaatgtcgagacatctactcagaagatcgtgaagcctcacatgcacacggacggtgtgggaaaaaatgttaaagggtaatgattgttgagtcgcatttaagcatctaagaagttagtagttatataattaaatttttagaattgatagtgtgctcaaaattttttaattaattacacattagtaatacactaaatattaaatttgagtggggtcctaggaccccactccacatactgtggatccgcccctgcaacccgacatgtgggtcgcaggtcgttggcaatggcgggccgagtgcggcggggttaagtgccagccagtccttgagaaggccaccgtagttgttggcagcggcgaggagggatgaggtttcttctccccgttgctgggtggtagggccaacagcagtgcgtcgtcggcgtgtaggggcgatgggggaggaccatcctacagcggcgtatgtccccccgctaggcacgacgcaggcaagccaagccggcaggctggactgatgatacctcgccagtcaccatgtgggtcccacatgttgacttagtgagtcaacaacggtcaactaccatattagtagaaaccattttccaaaccaccgaagatttgcactggttttcgaagattggaaaagcattatacccggttttgtggttgagggagaaaattcagtaaggagcaagaattgagggttgcaaataaacttactccatatatggtaggtgttctgggccttaagcgattatgcccaacccatgcgaggccaggcaccttgacacatgctattattttctgcgaatattagcaagtagcaaccattcggtcgtcaattcgtcattcctgcagttttctgaatcaactcctcattcgttttgtctaaagaaaacaaaaaagaaaggtaccaatagttggcctacctcgaatcaccaagagccacaagtgtcaatttacctgaaatgatggtgaaccaagcaatcgttgaaaattgcaatacatagatatagagcagccaaaaaacttggcctttcgttttcacatcttaaattttcttgcacataagtggcactttgccaaccatatatatataatatcacataactttatcaaccatatatacggtatcacatggttccgttttctttgtataaatgtgcatgcgaggatcatatgtgcgtgtatggcgaccttcccaccatattcatcaataactttgccttgcctttcctgatttcaattcaacgccacgcaaatcaccttcatttctactcatctggttatcaaatacatgtcgaattggtacgtgagcttttcaaatttcacttctacttggttacattaaaaaaacattagagtatttttgttatgaaaattcctttatactatgatttgttatacaaataaatgtacaatggagacacgaattttaagcggaaaaccctttgcgggaaaaaaccacaaacgccgaccattaatgatcactattgaggagttggatacaaacgcaaggaatacattgggttgtcgcaccctcgccgtgcggatctaggagttctagtgggcaagacttaagactcacgctaggaaactaatcctaatagtcaagttctatttgaaaacttatctgaatatattacatgcctaaaattcggatcacatatttaacatgattaattatatttttacactatatactaacgacgatgcctcttaaactaatctacataaaatgcagatccatgtccgttccatgcgtgctggtgcgatatgggggccaaatcagctgtaatactaacagttcttctagcccatatattagtgatcttaaatgtctctcagtattacagagaatttatatcctatcacacgacatcaataaaccacactataaatcttgcaaatcacccctttgaacttcatggtaaaaagaaattcaaatctaaatggatagccacatataaaaccaattaaggtgaatatttcctatataaaaagatggtaacacatttaatagaaaatatatatttttatttattttaaataatattattttttattcgtagtaactagtaaagaatggagattgagctagttttctataaaattattgttgcctatggttgtgtacagggatgaaactggtacggatacttttggtacgtccgaacgttttttcgaaatcggataggtttgttcggatagtttcggatatttttggattcagaaacaaattcggattttttttctccgtaacataaacgaatacagtaagggaaatatccgtcggaattgcaaaacggttatccgtgaatatttttcgaatatccacaaacaaggatcaaatttcagaacaaacatgtacatatacataacttttccatacgaagtcagatgaagacaaactttatatcaaaattgtagagctcaacgagatatacaactttattgttaactattttattatctgagatcatttaagggtctaaatattcattataaaatatcatatctatttttacaaaatctcatatctgtaattcaaacgatatcctatagagacgtgttccatatcaaagttgtagagctcaatggaatctaccactttgtagtttataacatttgtatttgaaaatatttaaactataaaacaaacattacaagtttcgaagatgtgaaataaaataaatagcatcttcaatttataaaacaagaccttgataagtgatatggtaagtaagctatacatgaagtaaaaggtatttggactggaaagtgaataaccatattacatgttggtctttttggggaacggttatgaaaatcgattttcacatacggttatgagaccgcctacaaaattaacgatagacatttaaatatgttgacctaaaataacaagcgatatctcttcattgattaaggaagctcaatttgaggagtttttatatcccggcaaatattcgttaccgtatttgtttcgtttcgtatcgctccgtatttgtatttgataatattcaatttaatttccatatccgggtttttgattccgattacgattccggaaataaaaaaatatgaaaatgaatatattaaagctagtttccgatccgttttcatccctagttgtgtacatttaccatgtgcttgtgtttggtgcttccttcatttaaaaatcagtgaaaccctcacacaaacaaacaaaaatgcattgatagatgattttgtgtcaatgctacaaaatatgctccatggtcctatgattaattccactatatttaaatcagggtgatgtcgttatacatgattccctgcatgttctaattcaaggtgagtactaaatgtggtgcattcacacattttaaggagtaattaattgttacattgttgggaggagcagtagttgagagtataataggaaaaaattgaatgaaaggtgataaatggtactccctctgtactcgtaaaggaaggaagtcgttttggacagcgacacaatctccaaaacacaactttgacttcttgtttctataaaaacatttattgaaaactgatatatgtatacttttatgaaagcatttttcaagacaaatctatttatataatttttatattttcaaactcaacaacttgagagttattcatgatttatattcccaaggcttaacttaaacattgtcctaaacgactttctttacaagtaaggagggagtacaagtagtatattagagtgacaagtattttgggacaaatttcaaattctagaaagataactattttaagacggagatagtactctatacttttattttttttaaataaaaactccaatgaaggtgacagtctgccaccccatctacttatattgtagttttacatattatctattgaaattcttaatattacataacacttaaatttaaatggatatatagttacaaataaaattaaactaaagtaactatttattcatttcagttaatatcatggttttttttcttttagctgtagcaattaactgagtaatatgtaacagctatatccatgccaaatgcaaaacggtgacattttgtacataaaaaagacccattagaaaaggaaccgccatccctcatttctggggaataattaattatttgtcacttttacgagtagtgataaaggatttgccactaaacctatatgttacagatagatgagattctacatatcatagataatgagtggtaaataattaattgccacatattaaaagtggcaaaaagttaaattttcctttttcttgaggttcacatctgagccgtccatctgtcaccccagctaagcgaacacaaccttgttttgttgtgttgtgcaactcagttcaaaacaatccaaaaaagctttattggaggtgtttgggggaagagaccactataatgccacgtcactaaatcccatccaacatcaacggcatttgtgtaagtacgtttagcaaattaagatcatctcatctctatccatgtattcattaacactgatgctacatctcaactcctttgatatccctattgttagataaccaattaatcaattttaatgcaataacaaaaccttccgactaacgtttcgcgtatggataataacgatgacaatattatatccaacgtcaacaccagactatatcaatgacttactattatattaataaacacaccatcgtacaccatattttactggctatcatttaccactgcggctaccggtcaccctaaatatatattcgtatgccatatgctagtctctctcggttatttattatttcggagagagttggtaccaatttttatgtagagatctatttatttttccgagagagtttgacaccccccaatttctctctggagatagataatcccacccttctatatccatctatatctatctattactatctatatcttctttatatttgacggtaacacatatggctgtgcgtggctccaccattggaaagaataaatacagcaagctaaccttgggggtttataattataacgcttccttggcccccttcgtctccatcttcttttttttttttctctctcccttctctctctctacaaatctggggctcccagtatagcttaggttgatttaattatggttaacctctcacagtaatccgggtgagaggtgggaagccaaagtgggagaagcaaaaatattctcagggcaggtaaggtaagcgaaggcgagaagagaagagacgagaagagaagagagagaaggtaaactagtctctcttgtacatggtggcttcccttcccttcccttctcttcccatctctctctcctctggttttctcctaccttttcttttgggggaaaaaataatattaattaaggcgcgcgtgcgcggcggcgcggcggcggcggcggcggcggtggaggaggattcagggtggtggtggtggtgatgatgggtttcttctcgtcgtggggtgtgcgcaggggggatgagcgcggcggcggaggaggcggctgcggcggcggcggcggaggaggtggagggggtggaggcggggaagaagggcgtggcggatgcgaaggggaaggggaaggagaaggtggtggtggcggaggaggattctgcggtggcggcgggctccgggggaagcggaggcgggaggaggacgttggtggcgtacccggcgcgggttgcggggtacaaggacgtggtggcggacgcggcggtcttcaggagggcgctcgaggggttgcacgcccagatggggacaaagctcaagtaagggatcccctctctctctctctctcacacacacacacacacacacgcaccaatctgtatctggcatcgccgatccttgcaccatgcagctgccttacgatatagcatttgatgccgttgcgcgcttagaacagttgctgtttgttttgtttctttcaatgcgcaagaattgcaacttgggagataaagtttggggagaaagagaagttttggggagagatagcgaacctaataataatggacgatgcaaatacaggcatttatatatttatatttatttatttggaatccggatacgtccggttttgactaatcaaccccatataaatgttaccctcgaaattatgtggcctatatctgccattgagtcaccgaatttatggatcgaccacatttctggtttcttatctttttgttttccccttcgtttgtgcaaattttgtccacagattgtgatagttggcttgggcctttgttgctgttgctttgcgtagttatccttgttttatgcctcgttcaatggtcaattacttatatgttgttaatgctgaggagcagccctagttgatgatgttatgttcaacacttatgttattgctcatttgtagtttgtagttgccttagaccctagtctaattgagtgtgtgagcctgtcccttgcaaatcaatgtacttgctatagctgtattatatggagagaatgacaggtatgtttgtcaatgttgcttgaatcactactgttaatattatatataagtttaagttgatgaatgatttgcattgcaacatgtttgtgtactgtggtaattagttgatctactctaccaagttatcattgagcatgcttcattttggtgcatttctaacatcatttttgttttcagggtgccaattattggtggaaaagaccttgatcttcatcagctgtttaaggaggtcacttcacgaggtggcattgataaggtgggaattcaataaaatcattcatatttcaattgtcaaatgttccttaagaaagtcttttagccagcgacagtcatgtaagactggccatatatagtaaagcaaatttttattatgcttagaagtttgccaaagaaaagcaaactaaaggcatggcacttgaaatttttgttgttttcatgatcttattattagttgttacctgtcagaatagcaggcaaataactgaaatttatttcacaggtgaagtccgataatagatggagggaagtaacagcatcatttattttccctgctactgcgacaaatgcttcttttatgttgaagaaatactacatgtcactattataccattttgagaggctatacttgtttgaggcacaaggctggtatcaagaaactggtcagtgggatttatagaaattcagtcttctagtttgtctgttgctgtattactagctcataccattttgtttcagcagattccagaagcatttcctgtatagaaatgaaagctgaaggtcaagcttcccggaaaaggaaaagaggaagcaattcttgttcttcaggtcagtttcagttcacttatcttctgtagcagtttgttttgtttaggacttcttctgtggcaggctagcagctcattacaagagaaggaaagattgtaaatgttactcaaaagtttaagtaatagtatgattgtgttaagtgttgtaactgtcaacttacaagatgtcgtaacatttcttcagtcgaagcttgtgagtttgcagcattttgtacattttggcccttgtattcttattctacaaatagaccctccaattaacttagagtggaccctttgttcaacaccattgatgaaggtgccgaggtacaacatcttggcgccaaccatacacttcggttctgagaaaggccaagctggcatgaagtccacatggtccgcgcagaaggtgttggcgctaatgtaatatccaggatgacaagctaacagttttaattaaacaatcgtagaaaaattgtgtggtgataagatgtcccccgtgccatgtcggcgagccgagtttgatccttggctggtctaacttgttttattttcttttttagtggccaaaaggtaccatatatattttttaaaagcaaacattcctcgagtcatgtatgcacgcatacagctgaccattaaaataagagaaataaaagggaaaaactcacagcttgaacactcgaacccaggatgtcgaggaaatcatgaggccatcaaaccactagaccacttatcagcttgttacctattgtaccccacaagccttttaagcttcctatatggtcagcgccaagaggtttgctactggccaactgctcacgtgtacttcatgccagcgtagcaaagttctcagcggcaacagttttttattattttcttttttttagtgaccaacaagcactcctcgattcatgtctgtatatgtagagctgaccattaaaaagagaaaaagagagggggggagggggggttaaggttgaacactcgaacccaggacgttgaggaaagcatgaggccgccaaaccactacaccacttatcagcttgttgcctattatatcccacatttaagcttcatatgtgatcagcgccaagagctttggtgatgaccacctgctcacgtgttcttcgtgcagctcgccaaagttctcagcgccaatgtgtatggcgcttagatattgtaccttggcaccttcatgatggtgttgagcaaagggtccattctcgaaataagtttattggagggtctatttgcatgtatatcaatatataagcccatttataaattcagtaaaaagcgagcatgttctataatggtgctaagataaatggagaacatttataggaagcattattgctgttctcaagcatattctatacggtgttaaactaaatggaaaacatttttatggaaattataattggtgttctttttatacatttaggtaaagttgtttaaatttatatgactaacagttagttcctttgactttgtcagacctagctgcttctttggataatgatgtacaagtgataattgatggtaagtttgaacatggctacatagttaccgttatcatgggctcaaaatcaacgaaagcggtactctataattgcaccgaagaacctgcagtgccaactgcggtgcctcatgttgcaattgacagcgctgagggcatacgtcctcgccgccgccgccgtaggaagaagttaagtacaacagaccccaaccatcctaaaccaaacaggagcggctacaatttcttcttccaagatcagcacaggaagctcaagccagaatatcctggacaagacaggcttatcagcaagatgattggtgaacgatggaacaatttaggccctgaagataaagcagtaagagtagacacggtcttttgaatttcattacttcaaattgataaagtaatcatgcaatatatgtgctttgtaacacttatacatattgtaggtatatcaagaaaaaggtgtagaggacaaggcaaggtaccagagacagttagctctttacagagaacagagaacaggccagccaatcagcaacgcggtgcctatccagcagagacttcctcagaaagaagtgacgattgatgaggtggactctaaagtcagtgaaggtgatatcctgctgtccaaccaaggatacagcagcagtaccagtagcagtgatgaaaccgctgattcgggagaaaaaaatgtggaagatgatgaagagtttaacacagagacatctcctgagccgagcatggaaacaacagattctcatggacagcctgatccttctgctgatggggagcgctttgaactgcgccgcagggagaaccctaagattgatgagaaacgtgacatgccacctaattaacgcttgtgccgagttgaagggaaaatttctgaaggatttttgttgtaggatcagattgctgttttgtttcactttacctttgcatcgtctctagagactgatgcgctatgctagcgcattgaatatcttctttttttatactgttagcaatttgaattgctctttcttaggtgaagtgatcacgggtcacttccgggcatccttgatgtccgataaattagagaaatgatattattttattattcactgtcgtcataggagtactgagtacaccagtttgttgctcacattagaacccattacaactgtaaagactggagtaatatttttaatagttggtagaattggttatatggcatcgaaagttggttatacatgtgaatgacaattctttgatggcggttttgatgacagccactgtcatcccatgataatgacacgtgtgacctattaagtcgatgatatgcgcctaggatggcaatgtctggtctaaagagtggtaaatcatcaaatcccaaagttagttatatgtaattgaacatgagagctatttaaccaagttgagaaacctattactgctgtccaacctaatactaatttatgatgtagtctcattggtatcggttagttgatagttgattataaatcgtaatgcttattagcgtgtaaaaactaatttgtaaataaatttttatatatgttcttaaggtacttaaattccaatgttgaaaaataaatcatgatgaaaaaaccattaatactaactctaaaattaagttttaaaatttaaaatttagttacggttgataagctaaagagcaaacaaaattaaagcggtacagcccgagacataagcaagcaaaacccactcctgcctgtcgaattccttttagacttgatcatatttcttggctgtataaacttacattaggttgcatatggctaaaaattaagtagacattattctgtgtatatatgatttctagaagccagctgttacaaaattaagtttatttaccagggttcgagtttcttgatgtggatcgggggaatttgaaggccacatcaggattaaccgaacaggctcttattgtttctcattaactgatgaggtcgttggcacaccttgatcttactaccggctggttaatgaactgctaccaagtgaaagttgagattgatactgagtgctccattgtcatacccatgaccatgacaagttcatacacaaaaaatctgcacaataaagtagaaacaagtaaaaacaaatccagaattatgcgtcgtagcttaataaacattgactgctggatattatgagaagataaaaaggaatgtgcatttgatttattgatacttcagcaaagagttagagcaaagcgcgcgcacacaccagagcacagcgtacaggtggcactggcaacataattctagatagcattaaaaatgtaaatgaactgggagtgagcaagtattggagaaacacctcttttttcagatatttaggtgtattggctcaaaaggtcccatgtttcttaccaagggaaataacaatactacatattttccgttcctgcatgcaatagtcaatactcaatagacacagttacaccatttatctttatctaacaaaggcgttaattataacagcaaaaccgagtcattatttattggaataaactgtgtcccgtactcaaatacttagagcaaaagagtgagccaaaatgctacacgttatattctgagttgaatcaatgctaaaaaactaagataagcaagaaaaagcggtgattgttctgcaacagtatcggacaacatatacctctggatttttctccaaacttgtaatgagaagttgataacattcattgaagacttgaacatttgaagttctgacagattgacaaaacctaagatcttgcatgttgcactcatattaaggtattcttgtcaagcaacaaaccaaggaactgcaagtctgcaacagcaacaccacggttcccaaatttagcacatggcatttagtaagatagagcacaaatgctatatatatgaaaacaacattcgatcaattcaaatgtgtaatgaaaagcagaagtcaaaacttacatggcatgtgtctcagcccaaaatgggctaaaatatgcttggtctttgtcctacggctgaactatgcactgtaccaagacaatatatggcgtggtactagaaatattagccaaataatttaacaacaaagtactgaaatggaactgtttttcccgaaattagaatattccttgaatgatatacaaaatgctggacaagatctttgctttcatactgctctctaggaatcctgagaagaacaaaaatttaacttgttttgaccaaaacaattcctcaacatgattcctccgaaaatcatttgcagtcattatcatccttcaggaaaccgttttcaatcacccctttcatcccttatcaaaattataagctctcaaattcctcttgcttatttttaaacaaagccttcaatgcggcgtaatagcagaatctgtcagtactgtacagctgtgctgcttcagacttcaggaaatagtccacaaccataggaaaatgtcattggtgagaccagtgtaccactccacgtggaagaagtgttacatacattttacagtcaaccagccctgttaggcataagtaaatgattagcatacttgaatgttacttcatttggagtgcacttattcctaagcatctcagctacaagctcctctgcatcctgccaccgctcagctctacacaaacccttcaatgtagagttataagaaatagcatcaggcttacatgacatggtgctcaataacttgagggcatcgtccaaacggccttgttcagaaaagccattgataagggcgttatatgtaaaaatatcaggtgtacttccatagtttggcatttgctcaagaacctcaattgcacgatcaaccagccctttttggcacaaggaattgattaatatattgaacgttacttcatttgggggacaatcctttccaaccatctcagctataagctccccagcatcttcccatcgtgcagctctgcacaaacccttcaacacagcattgtagctaaagatatcaggcttgcacggcatgcttctaaataactgaatggcaacctctacaagaccttgttcagaaaagccattaagaagactgctgtatgtgacaatgtcaggcgtacatctgtaccttggcatttgctcaaacacttgggttgcatagttgaccagaccattttggcaaagcatgtcaatcagtatattaaaggtcatttcaattagagggcaatcatccctaaacatctgagcaataagctcactagcatcatgccatcgttcagctctacaaaagcccttcaacacagcattaaaaccaagggcatcaggcttacacaccatgctgttcagcaacctgagggcatcatccacgcgccctcgttcagacaaggaattgatgattatattgtaattgacggtgtcaggctcacacccgtacttctccatttgctcaagaacttcgactgcgctgtccactaaattattttggcacaaggaactgatcagcatgctgaatgtagcttcgtttggcgagcaacccttcctaaccatctcagccatcagctcaccgatatcctcccatcgctcggcgatgcataaacccttcaacgcagcattgtagcaaacggtgttgggcttgcatagcatagtgttgagaaggtcgagggcttggtcgacatgcccttgctctgagaatccattgataagggtgctgtaaatgacaacgtcaggagtgcatccgtacctaggcatttggtcgagcagttggacggcgcggtcgagcaacccgttctggcagaaagaacggatctgcgtggcgaatgtcacctcgttgggagggcaacggttcctgatcatctctgccatgagctcctcggcctcctcccacttcttggcgatgcacaagcccttgagcacggtgttgtaggtgtaggtgtcgggcgccacgggcatggaggcgatgaggcggagcgcgtcgtcgaggcggccggagcggcagtacccgtcgatgagcgcggtgtaggtgacgacgttggccgcgccggtcgccctggccgcgccgagcacgcgctccgcgtcggcgaggcggccgtcgcggcagtagcccgcgacgagggtgttgtgcgagacggcgtccgcggcggcggccgccttgagcgcgtcgagcacgcgctccgcgtcggcgaggcggcgggtggcgcagagcttcttgatgagtatgttgcaggagatgagggcggcggcgggggcgggcagcgcgccggggaggaggaggaggcggagcgcggcgtcgaggtccccgagctggacgaggcggcgcagcgtctggccagggcggggcggcgcggccgggttgacccatatggaggagctggccctgcggttcgcccacctggaggaggcggcggcgaggcgggggcgcccgtgttgcttggcgcggcgagggaaagagaaggggtggtgggcggcgggcggcgaggaggaggaggaggtgatggccatggtcgtcggggtggtgaaggatggagaaggcggaggcgataggattcgtgggatggatgaggtggtgcggcggggccgcgggagtgagagtgacgaccaaatgcccgccaattctacttcattccaaccggacttcctcttttttttttcccaagtcctctcttcagtatggtgatgaaattcactgttaactcattctactgcctccaagtctccaaccaaaaaaggttcattttctatagacgaatctagactacgttttgagaagtacatatagaggtttttccctgtgtggtattaaaaaaagatggtgtctgcctctatgccactaaaaagtttgagcctctctctctgccatcgtcgaactttatcgcgccctccatgccatttcatccgttttgggttgtaacggtgggtaacggcagtgcgaaatgacctagttgcccttaggcttgaaatgccatttgatgaagtttgtttccttatgtgccattcggaggcaggcacatgcatgtattttttggcaccaaaggctgtgatgttggtggcaaaggcagggctgttggcgtgtcacgccctggagttccctttccttgtttaaaaaaatcattaaataaatcgaccaaagaaattgtttattttagctcaactaccatgtgcttgcaaaccggctcatctcgacaacagaaaagaacagcaaccgtgcctttcacaagtgcccttattttgcagtttgtgtttcattctctgctcacatattatgtttgggtttttcttttgttgtttgctcacaatgtgttgatggtttggcattcagattggaggatgtcagtattatcagtgggaggatgaaatggtggacactggagtgcaaacacctcatgcccctgctccaattcatacagttcccctacaagcagtggcaccacctggtggtttccctactactccactgcctatcaggcaagatcaagctactggagtggacattagggtgatgcagcagcttaagtggcttgaaaagatggtctatgtttgcatttttcttactttgtatgctattttcaagaagtagttgggtgtgtgtatgagtagtcatggataaatggatgtatggaaggatgaatgaattttcaatcaagaatggtgaaagtataaatggccaggttgaaacaacaccaaatgttagcacataacaacatcaaatgaaacaacataacataactagctatttcatcctttaattagctgtttcatcacataacagcactacatgatagtaccagatgttagcaacagacatgacttagcaaaatacattacttgtttgcatccacataccaacatggcaaagtaagagaccaaaaaaagagtgttttcatcacatggcagatgtttttcactatcatagaacaaaataaaagttttgccatggattaaaagaaccatagaccaaaagaagcacattttactacacctggagcttcttgctcctggtatttctagcagggctgtctgggcttgatgtagtggctgcagcttggggctttctttgggtaagcttccttggggtaagtttcctgctgatgcatatcttcattcttagtgaagcctacggcagtacaatctgcagtggccgggtctcctaggtctcctgttgagtggtctcatcagggcaaggttctaggaacacagattgtagtggtactggatcattggaaccagttgcagaccttgtgctaaaacaaaaacatggtgcattaggtggcatgaagtttttgatgatttgaaggcttgtggtaaagaaaaacatacctgttactcacactgactggttctgagattgtagtagtagtagtagtaatggcatatgccccctttttcttcttgttggcaccagaagaggaagatttcttccttttttttttgtgggatgcattggccattgcttcattggctgggaagaccatctgggagggattagccactaaactggtctctgtgttacatggtacaactttcttcaacctcttctttggtagacccctacatatcaaatgtgttttagttaactaagttattggtgatgtacatgtatatgcaaactaagttatgtacaaagtatacctttccgcctccattgtagctatatcttctaggttgccattcttacatgtataccagtgatggtctaacagatggtagatcgggcactcatgtttctttgacgttttctggctgctacctccctcaagtgatgacttcatcttattcttgtgcctacctccagctatggacttaagcaagggagggcgcatgaagaagtcatgggtagccttgggccacatggtcttgtctggtatggaaggaatataaccctcatatgcagcgctgaatttgttgacagagaagtactcatccacatggttctcaagcttttctccaggaatggatgtaatgtatgctattgcatgcttgcatgggatgtctgagccctgccaacccctacaagaacaggttctatcctttaggctgaccacaaacctgaacccagagccattagtagctttagcgcacagttctgccacaccttctggaggggctgttatcacctcaatatccaggttgtagctctcttctgatccttaagcctctgcaggatgtgaggtagaatttttccattaaacttcttggctaccttcttcctttggttccatttgatcaatattttctgccttatagtgtccagcaagtcatccaagtgctttcccttctctgcctttgtccagttattgaatgactcagccagattgttagtcacataatccatctttgatgcagtcctgtacttgctcctagtccacaacttcttgtgagtttttttgcaaatactttattgcttctggtttggctgcagccattgcttggtagtgcttctcaaatatgtatgggctccatgaatatgaagaagcccataaatgctcatcaaataccttcccactgtacctcttcttgaaattatgtactagatggtacatacattctctatgttcagcagttggaaaaacatcactaacccctttcatgactacctgtccacaatctgtgttgaatgtcaagccatctggggtacctattgcttccttcaatctctccataaaccagaaccagttctcattggtctctgagtcaatcacaccaacagctactggatacatccagttgcgcccatctactacacaagctatgcacaactgtcccctaaacctccctgtcaaaaaagtactatctactgcaagatatggtctacatcctctatgaaatacatcatgctttcagtacgaagaatagcctatgaaatcagatcttcttgtttatggtgtgatgatcaataacaagaaataatccggatttctaagttgaagctactatctgggtccatcctacatatgaacaaggagcacgtaatcattaaaccctaacacggattagtagcaatgggcactaaacatcagtacatcaagggaggcaataaatgtggcctaagacagcgaaatcaaagggggcagcataaaattcacccgtctagaaaccaatccgggcgctcgctggcgccgttccacaccatggctgctcctccccgttcctctcgatgcacggttagatccacgctcccatgctcctccccgccgccgctaggtttcgccaccgtcgccaccgccgctgctagggttttgtcgccatggagagcagggaatcgagagagaagagagtgacacttagggggatgacggtaagcatcggtcaacagacggtccaatatgctagcaattgaaagggaaagagcgacattttccctatccgggcccatatgtgacatgtcagagctgccaaacggttatccccaaatagaatagcgatggaatgatgtggagggcatgataaagttcgacaatggcagagagggaggctcgaactttttagtggcaaagaggcagacagcatcttttttaatgtcacaagaggaaaaacctcacatatagataagtaaccttaaattattgagttattactgttcatccataagatatggaagatcaaaattcctttagagattgtccggcagatgcgcaatagaatttaagcaaattttgctacaggatctcgtgggaatgcggtttcaattgttggacacaggcgtagtaaaatgttgaataaaatcactatgtaaatatggtaatttgctcatggaacccgcttatattattttaatatttttggccatgtgtacaactgaagagaccaaaacactcatccaaccaggttccaaccaaaccaacaacactatcgaaccccatggcagtcgccgccgcaacggtgacgtcgacgatggtgaggaaggcactattcacagcaacttcctctcctcctctgcctctcgtagctggtgtagcctctcccgctccatgcccagtgcttctgccatgccgcacatcgcgctttatccatcggacctactctgatgggtgccccactggcacagacacaatgctcattttgctaccagaagttgtgctaatggctttctcaatcctggttcaattttgggttaattggatccatgccattacaaatatgccgattcagataaataactttataattcgtctattcatatacatgtcattcgaattcgaacaaaattaaaaccatgccatcgccatcgtgttttccatcaccatatagatcaaaatacccctaaacgtgggacccacatgtcagttccatcctcttcctccatcctccctctcttctttcttccccatctctctccatcttgtttcaaatgtgcagccagcaagaagggcacgcctctcatcaccgtcggcatagtcattagcgacgacagcggtagcggggtcattgccgccaccgtcctctcagtccccatgccctcccccctctcattgccactgaggatatgcaagagcgacagacttgctcttaccgactagacacagctgcctgagtgcgcggtggatgcagagccccacctcccagtgccgtcgagctccatggggcatttaaactttttgccactttcagatatggcaattatgaatttgccactcacagtctatgacatgtgggccctcatgtgcatatgacatgtgggtccagtggtaaatccttaattgtcacttgtaatactggcaaatagttaaatatctccctcattgtggctaacacccaccttgcatcctagcacttgctcccctccggctgcaacccaacccaacccagattcaattgaagttgcgcggcatggagcggcggatatagtatataggtatatacagcatataggtagagggagaccccaacaaaattggattggaccccagcctgtctccaaccaaataacttattaaagcccaactaaagaaacaatacatcaaagcttaggttagcccaactagagcccagctattcgtgggaaggtgaaaggaaaaaagtacaccgaaaaaccagatatatgacatccctcaatttacaaaaaccattcactttaggtccttcggtagttttgaccccggttttatcctacgtggcggctgagtcagtgtgagatccacgtggtcaccacatgtcatcgtggccacgtttggcctcctatatctttcccctattctcttcttcctcctctgtctctctctctctcactcttctcttctcttctctaggcaagccggccggcggttggggcggaggccgcccgggcgaggtgggagaggaggaggcggcggcggcggctgcgacgcgggagaaggcgagggctgcggccggtcgcgaatggcatcgacggcgctgcgtcgccgcggtggtgggcacggaggcggaggcagggtcggatgccgcggcggtgggcacagaggtggaggcgtggctgccaggcggagatgccgcagtttcagaatgcgtcggagccggcgaaatggaggtggcgcgcgacggctcccgtggccacgacgaccgtgtcggcgtgcaaggattcggagttcaacgccgacgatgaagattggcgatgctgaaggggcacgaggaggggtcgacggcggtgacagtctcggagaggatcctggtcccgaagcgtacagactgtgcgcagctgtcgctgactggcagcgactgcgggcacgaactggcgggcagttccctccccggccgtcccctcctctccctgcctcttctctctccctctctcacttctctcctcttgggcaggccggccggcgggtggggaggagccgaggagatcctgcgtaacaacgcctagcacgaggcggatgacggtcagcctgatggcgccgtcgttcttggcgaggcggcacgcgaagttgccgacgaaggagacagtgacgagcagcagcactagccatcgaccttgtcgccggcaacaacctcaccgtcccgcgccgctgcgccagcccctcgctgcctcaggtcactgtggtggtggccgcggcgctcgacgcgtgtcacggtatggcctgcctaagaggatagaagtgatagagggagagagaggaggaagggagagagatgacgtggcatcctgatatgtggggcccacatgggtcccacgccgacttagctgccacgtaggataaccggggtcaaaaccactgaaggacctattatgaccggttttgattagttaaggaacgctggatatctgggtttgcggttgggggacaattttgtaactcgatgaccagggaccttccatgtactttttccaaggtgaaacgatgctctgaagtccaaaccgtgtatctcaagactgaattaactgcgtctccggctctccgctccttttcctcgtcagtcgtcggtactcttgacttgagacactgaatcgctgctcttgctcgatccttctccttcgctcaatcactcctctactcagatcaagatcaagtgctgcgcacccgcgcggccgactacacgctgcgtgtaggccacggcgagcgggcattcgcgtacgctcgacttccagtcttccacaagttgcaacttgcaaggtttgtttcctgccattagtccagaattcagattattggattaggccattagttcattcaatattctttagtgctgtcagagtaggagcatcaaatcattttgatttattcaatcattttttttttggttgtccacatgctgcatcgctgcttactgcttgcactagaataactggttggcagtgaccagtgagaagtggttagctaacgttggtgatattgatagtgttcataaccaagcaatgagggattgtgatgctttattgaaaaaagagcagcacattgatgtttctttgaacagccaaagtaatgctgagaaaattgcttattatactcgattaaatggctcaattgatgttactagactcttactgaagcaaggtatgccttttcggggccatgatgagagtgaggaggtctctcaataaaggaaatttcaaggaatttcatgcttataccgcagagcaaaatccagctttacacaattttttttggggaagctttacacaaggttgcaggtaaaaatgctcctggtaatagtaatagtcagtatacatcttcatagattcaaaataacatcatatgttgctttccaaaagaggtactgtgttctattcttgaagaagttgggaatgatgttttctgtttgctggttgattagtcaagggatgtgtcttagaaggaacaaatggcagtggtcctgccttatgttggtaaatgtggcagtgttaaagacagactagttggccttgttcatgttaaggagacgacatctatgtaccttaagtctgctattgatgatttatttgcggagcataagctaagtttgaaacaagtgagagggcaaggatacgatggtgctagcaacatgagaggggagttcaatggtttgcaatcactaattatgagagaaaatagctcagcatattacgttcactgctttgcacaccagcttcagctagtagttgtgaccattgtaaagaagcataaaggaatcgggaactttttttgatatgatttctcttttattaaatgtggttggtggatctttcaaaagaagggatatgattcgagatatatatgcagaacatgtgcatgatgctttagaatgtgggttacttataactagttcagaggtctggagatactcattggagctctcactatgagacactaaagagtttggttcaattgttccctacaatagttaaagttctagagtatatggaagagaatgacagggatgacaaaaaattgtgttttatttgcagcttatgttgaatatcttggcaatcgcaaacaccttgtctgtaactttacaaagaaaggatcaagacattgtcaatgctattaattgtgtaaaatcaactagaaatcgcttggatgagtttaggagttagaggacgattccaactcatcctcccgcctttatatttcccttggccaccatagaacaactcgggttttgtttagatcaaaatttagctttggtatttttccgtgtaatcctgtcatcgattagaacaactcgggtttgcttgttacggaaccccatctgtgatatttttgctgattcaatcctacatctttatttgcaaatcgagttgcctgttcatctttttcttactagttctcgattgcttgcaggaacaaatgccctcgtggttgggctaaccatgcatccgtcgagattcatgactgcctctagagttggtgtaacgattgcaaaggtgtaacgtctctagatagttatagtcggatctccaacgtcgctccattcaatcaaattgtcctctcatcgaaagatcgggacaccctcgtgcgcatcaccttaagttgcattgtgcaaccagcccattaaggcctaatagaggagaaaatatctcatgggcccgaaattctgtgttttacatccaaaagttaggtttacaagtatcctatatattcttctaattatccctaatatctacactaaatgttttatttcatttcttaatgttgttctgtttagctacacaactcacggtcaccgcacaaatatcacggttaccgcatcaaaccgtgcggtaaccgcgaccaaaccatgaaactgcaaaatttggaattcaagtatttgctgatgaaattcacacggttttcggcggttaccttgtgcgataacccccctccaaatggtaagggaaaccctgctcatcactagcaaggcgagagccgcaagacagaatattatagtaggattcagaatttgattacaaataaaacaacaaagggcttgttggcttcattaccaaaaaaacattactaccatttttttaatgctaaagtttagtagtgttttgtttgaggtctttctaaattctaaattctagtataagttttgttagagttgcgttggtaattatatgtttagttgttaccttataattttggtattaacaaaatttaaaatggttgaaaatcattataaggtgaacatgaccgacatgatctacttcatatgtcccaaattaagttaatccaatatggtacgtgatatatctagtactacgaatttagtactagaatatgtcacatttcatacgagattaatttaatttgagacagaattcgaagcaatagcatacgtactatctagctggggcatgttgggctgctcagctcaaacctgggccaactaaaaagcttccatttgcagttgtacgaatttaggaagaagtttatttaggtccctcgtctaaggatcaagtttagaccacatctctaaacagagaaattgggtagaacacattcctcatcttccaaaaccagtgtcgatatagtcccacaggtagtttcggctgacgtagcacccgttgtgcaatcatgaagaccaagtcaacatgtcaagtgggtgccacgttagttgaaattgccatccaaaccgcctttgggctatatttgcactaattttgaaagataagagatgtgttgtatcccttttgcgattaagggacgtgatctgaacttaaaccttacgagagacctaaaatgaactttcttatggatttaaaccaaacacctcatgtgcggatagtgggctgcagtgagaaatgctccaatgtgtaagatttatgataggttaaaattcaaaataggcatcttattatctatataccactttaaaagcttagctattgtcacccacaactgctttcatcgtaaacttttcttagtattaaaaacaactaaatataagtggatagttacatgtaaaatcgaaataaggcaaatatgtcccacaacaaacaatgggcaacacacttcgtgaaaaatacatttatccataccaaagtacgggtagctagtcataattaaaacaagggaaaattccctacgtatccttaaaattttccacaatctcttctatacctctaaattttgcctcatctcctacatgctatgaagttttcattttgatcccctctatccctattatgttagttggccattagtttttcaaaatgacgatattgcccctttgccatacttatttgctactacttcatcataaatctcatgtgaaaatttgcaatttacaataacatcaaattgagacaaaattatttgatgtaaaagttgaaaaaaattcaaacttttgaaaagaatttttttttaattcccatttcttggttctgctggtttgctcattcatttcgaatccgtataagagtttcatctagaaattgaaaaccgaaattattaattttggggttttaaattttagtgaaatgctctacgaattccatgagtcaatttgaaatttattaattttttttaatttatttctaaaatttgtggtgaaataattaattattccgtttgtgttcttacaaataaattctttaacatgagaattgtgttttgtgattaaactagaacataagtttgagagaagggcaatatagtcaatatgaaaaatatttaacggtgaactcatggcaactaacgagatggatataaagaggagattaaaatgaaaacttagaagcaagggatacgagaaatttttgtggacacatagggaatttcctataaaaatatgtaggaagtataaaccaaaaactaggtgtaaacatgaccaaacgtacttctttctaattgtacaatttccattaactatgtgcatgcttagttgatgtagaggttggatatatgtttatagtctactgaatattaaaaaaaatatatgcatttccatcttttaaaatattttggcccaacagttggcaaactatagatgatatgtcaatttttatggactacgttgcgagattttgtgtaaaaactaattacaattgaaaaggagtgcaaattgcactctgggacaaatttcaaaagattttgctttcaaagagtcagcaaacattttttgggatatatagaaaccgcgccaaacgattttcttgcaaacatttgaagacctctcaaatccttgcttggggtaaagaaatggccttgctggccatgtaaattggaccgcccacttgcattatacatatataaaatatatctacaaataaagctcttgttgcattatgactaagactgctatatcccaaaatttcacatataacacaaaaatttacaacaccgaattgggtccgcctaaaaagttatatatgcaatgcactggtatgtgccttcacgttctgaaatatccatacaaacaaatcggctctcttgactgccaactagtcaaggtgagcatgaacctgacaacacctgcaaaacgtaagccaaatgaacaattgtccaatcaatcaatatctattactctccgcgtcccataatataagtgattttgacttgtttgcttcaactgtttgaccattcgtcttattaaaaaaatttaaaattattatttattttatttctgacttactttattatccaaagtactttaagcacaacttctcgttttttatatttgcataatttttttaaataagatgagtggtcaaacaatacaagcaaaaagtcaaaatcccttatattatgggacggagggagtagcagcaaaaaatgagttgcaaatcatttaaagacctctcaaatccttactcttttgggggaaaatttgttaaaccaagaacaaatcccaccagaataaggccaaaaacaaatatcgcaccagaggctcagctcagctgctcttaacgtttggtatatgtccctcttataacattttccttagctttaagagaataatgataggtgtgcccatacctctgcagtcgaagagtagcacggcattgcttgtatcatgctcaagcgcaaatattaattcaaaaataattttctgagacatcatcatgcaagtgtatctagtgtcgatcctttgatgagagcatttgtcatctaaccatatgataagtcctgaacggtacgaccactagtgttgcgaggggcatatggtcttggtaccttccatctcagcaattcctgaagaatgttgacagaacccttcatattaaccaaacgagactagaaaacttgctcaatactgtaacaagtagttagctgaacatgtatacatatccggatgactaaaagaacaaaatgccattcctctgtacaacacggagaccttgataacacaaagctaagccatgttgcacgtgataaaagaacagtacgcatgacatgttattatatgtagaacagtacaagttgccattcacacgctcctactcacaagaagtccatttacctttgttgattttggaccataggccttatacgctccgtcaattgatgagtaaatcagtgtagcttgatcagacccacgattacacttgaccaaccgaacacctccctagaatttgtgggcttagctttcaggtacaaaataagctttgaaggtaaggatcctggagcatcctttttcccatgggtcatttctacagtcaccaaatcatcccacaatacatcccagattacaagcacggatcctttgcaggactgaactttctctgggtcatcattgggacctgaaatacaatcatatgataaatagaatgaacagtacaaaccgtaatgtaactagaatctacgtttgtcttacctgaagcagtagtactcttctgtgagtaattaaaagaattttacccttaggtagcataaaatgatcctcataagcatcagtagatgcaaactttccccggactttgaaaaggtcaacttggccaagaaatgtagcatattcagctaattgtaagatagcctaaaaagcaccgccaaaaaggattaagaataccatttgaaacaaatgagatcgccaccggcttgagggagagaatgctagttacctggccagctgctttatggtcgtcataaggatagagcaagctatcaccaccaatggctcgagggagacgcctacgagccaactgctcctcagccattatagctgatgatattttcattttcacagcatttgcaccttctgtagttttcgacaaaagatcaagaactccactcactggctgagcggctgcaccaattaaaccttttccgacaccttgcacaaagccctcaacaccagaagattttgcaccctcaatgggctttgtcaatatgcctgtaacacctctgaagatgccctttgcgagagccccacctccatctcgtatgacatcaccaaagtcttccactcctttgctatcctggagaaacattacgaaccacaaagtacatgttatcataacatactacttttatacagttcaatacatgcatacgtagaaagaaatgaacctgtctcattcggccctgaatgaatttcttgtccatggataatgctgctatacccttactcatattactcaaagcgctacttgcattgccaagaatgtcaacacccgaaagtaattgaagaggttggctgagaatatctttctgaatgttagacatagcagaactcattagtgcactttgtctcatgcacaattcttcccgatacctttgagctatgcggaccttcattgttaagataaaggaatcagtgcttaaaataattagagtagcgtacatcagcgtatagggacaataatgtaccatggcatgaaagtttttctcaaacatgcataacggtatgaaagtttgcagaagataattgtaatggaaaccaaagagagggagggagatattataaaaaagaaagactagttaacaacatttaactgattccctaccggcatgtgctccatgtttcccagtgccgtcattaaggaagaccagaacccaagaacccctctcggcctctgggtaggggacattgccattgagactctaaatcgtatttcagaaatattaagaagcctgcaacaaaagatttagtaccaacaacagggaaaaaatataagaaaaaaacacaacatgcaatagtgtgcgtacccaatcttcagtatagggtcaactgagacagcagaagactctgaactggatatcctatcaaattttaggttctgaatcatctcatggaggcgccaaataattggctcatggatattaacaaaaaacacacagttctcaggaacctacaagcattacataattattatcgcaacaaatatttaaagacatactccctccgtttcaaaatgtttgacaccattgactttttagcacatgtttaaccgttcgtcttattcaaaaaaaattaatgaaatatgtaaaattatgtgtacatgaaagtatatttaacaatgaatcaaatgatatgaaaagaataaataattacttaaattttttgaataagacgaatggtcaaacacgtactaaaaagtcaacggtgtcaaacattttgaaatggagggaatatatgataacttcatgtacaactaggaaactgtcatgaataaaacccaagcaagaccaagtaaaaaaaaacttactcacacggctgtttgataaagctatgctactcaaaagacaatctcataaggaaaaaacatctatgtgaaaatatctatgttaaaataagatttattaataacccatgtagacagatcacctgcacaccaagatatggataaacacaaaattcgagagaattattggtctgcaatgtcatagagaacttgatgatgtagtctgattgattctccatcctttgaggacaaaaaaggacaggcataagaacgaaaggtaactgattgtccacttgaatccaatgcatctgcattttgagcctgccattaaaagaagcaacaaattgaagtacggaaaaaagtagaaaattttgagcggaaaacagcaacctagcaaataaccaaaaacacatgattgtcacctattgattccagagcccattccagatgagtaggctagtaatagttgctgcactgagaggaaaagaatttcctcaggcatatggtcaattatggaaagtccaaactctgttagctccaaagtaacatgaaattcactatccagatctggagatgactgcccactgtcgacctctgatggctgaaatattggtgataatagcctttctgttgtctgttcccgagttctattatcaggcagccaatcattaatttgggtaacatgaaactttccctccttaagaacagtgacacgcaaagccttcttcaccctgcttgatgcagctagcggttggtgatccatgacaacatcaatgtcatatgtcatggaggttgtagggtcacttccatctactaatacttccaaaagacgccttctgccaatatcctcccaaaagaaggaagccgatgaatttggaggcagactacgccatgaataatcatcaccaccaacctgccgaaaccgtacaggcaagaacatggagcggttctctaccctgcatgtattgtttatattttattttagatatgtacgatttatgataaaataaatttcgtgtaagtatgcttacctgtaagggctggaccagcaagcgagctgaaatacaacttcataacgtgaacattttgttccacttctaacgtttactctcaccaaagcttgatcatttcctgtagtgttgttcatgagcacacacataaccccattagcatcaatgctaaaaggtgtactccatttgtatccctccaaccgcaactgcaagcgtaaagaattgtgaggttgagaagtagaaaagttaataaccaaaaccatttatatgtatgcaggaagtagcagttcagagtataaaagttaacctttaaaagttcgttcccaaattctgatcgccattgaaacgcttgaggaggactacttggatgtaaatgctcttcagtctcactatgatactcagataggataatacttcttccaattctattgataaaaagtgctcgtgggagaaaatttataacctgcattatcagtcaacatttttctgaaaaccttttatgttattacataatttaactaaacatagtgaacaaggacagaatactctttaacaaacaattcgaggtgttgcatattgcattcccttgagcagtaaatgaaaaacttgaaaaatcatatatgtaaaaatttaattgttgtaaatcatatatgtaaaaaatttaattgttgtttcctatctctgaacatgtcctaacacaatattaggattaattgctttacttgcttccattgcaacttgctggaactttgtcaacatgctaagtaatatggtgttttaatctttcaaatactccatagcacagtagtatggtaaatgacctagtttccatctagtaaattcttttgagacaacattcaattgctgaacaactttaattgcgaaaaataatcatgctgaaccaaagtatgaagcaatgaagatgtgaagacacagaatcaaaccttagttctgtctgaagtcatcttcagctgagccgagaaccagtaatatgacccatcagaagtaaatgctttgacatcaacatgctcctgcaccagatgaatgacacttgaagagaagataagcaatagttcaaacgtgtgtaaaaccacaaactataccttgttctcaagatcaaaaagggacactcctatactgtattgtttgcaactgccaacagccacacaaatcgcaactcgtgctgggctggaattgttatcccgagattcaaagcgcacacctgcagagcggttcatgtaatcctgtggcgacaacattacatagtctgtactacaatcttctataacctccaatatgtgcatatttctctgtgccactgggcctcttctgataagagattttgaagaatatctgagggaaaattttgaagatttagctgctctgcttagtgagtctggtctgctaagtgactctgcatctgagttttctgttggttccacctcaacgatgcgatatgatagtggaattgaagaaatattttttatccaatatggaacaaataatctcagtgtcttcggtgcagcatcacttgctcccagatcatgttcaacactaacacgaagtctcctaatatttgacacaagtaaaatgactagaaattatgacatatcaactaacaagaaaacatgaaacagtagatcaactgcactaacactcttttttcaaattgtgtcttaagaaatatatgagattaccatcaataagcctattaaaaccgtatctttcacaaaggcataagtagctaatgaacaagagaattttggaaaaggacccatttttaaattggaataataattaattataacagtagtccctagggccctccttcacctgacgcttttctactacaatcattttgtatgacccctgtaataaatgtatacacttgctcttaactaacattcaccaaaaaaaaaaggtattagagcaactaattttgacccgatcatgcatagagaagaccatgactaggagaggaaagtcctaatagtgaagatcctgaaggtgacaagtcaacagaactacagatagagtgcagtgaaagaaaaaagtagttcagaaaaaatggtggctaaatactagataccaccaatggttcaaatcaaatttgcatagtagtattgtatatgttacagattagaaaatgcagtagggtctattccaaatatgctggtaaaatgagatgggcaaatatgttggacatgactatgttgtttgtttgcactgttctggctgtgtttagaaacttctgtgttgaattgaaattcatatcaattgtttagataaccacactaagcaaatgaaacactaggggtactgttaaagcttacaaacctctggctcctattttgaaccatccagaatgaagtaacatgttccagggacattaagtccagtattaatacagtgtcctaaaatgaaaatgagaaacaaaaggttagagaattaaaacatcattttgtgcgttgagcaactttatgtgagccaaggcaaacatgttcagtcttgccatatagataaagcactctttaattccataagtaatttatgggaacaacacttttcctcagaagataaaacaactagtgatgactatcaaagcagggaagcacaatgtgcattccagcagattcatcacatacgtgtagtctagaactctaggcacattatgataacaggcaccatggttaggcttccaatgtttaagttatattaccttctctataatccagccattttggacaaacatagttaggtaaattggtttccggatatctgctgaatagataaatgcacttccaccagacgagacaataccatgctgcctttcaaccatactaccttccgtggacttctcccagatagcatactcggcttcatatggaagcttattttcgagtctaagaattgagttgaaacaaattttccagtcataaataggcatatttaagtctgtgtgaagaatggaagcatcaattccaacactaagccagaaattttgtttaatgccaacaggaggacagcaatatgaaagcatatcctttttctcaagatcagccagtctaagaactgaattctttgagggcacagatgactgctttaaggtgctttgccttgaaagtgaagattgttgttgcttgggaatgctctcagaacctagtgaaagaacctgactccaactatatgattcctgtgatttttcagaaaaagggcgaacttgcaagcacaaatccatatccttgatcatcgctgtccaaggcaatgcagtagatgcatgaggctccataacagcaattattttcctaggaatttctgcactttgttcttgcattgactgccgtgaacgcacccaccgccttcgcctaacaaagtcatgtggtgatttggaagatttccaggaagatggccagttcaaattttgaaaattggcagcatacgcccatccatcactatccacggaactagatatttcaattttccatggtgacgtccatttccagccaggtggaagacgaggttcaaagaatgccttcaaaataaatcacacatttctctttaggaggcaaccatttatgatatatttaaggatattttgcatcacaaaaagccaaagatatcagcagaaccttttattaatcaagcaaaaagaatttcagtggccaattagtctgaaagaagttaccttagatgagtaagagccgtcctttgtgctccatggccctacatcacaaccctgatcactagcagggttacttccccaccctgaagttggtcggtaccactgattttcaaatacttcatcaataatgcttgtggaactggtggaaccagcatttgacacagagctactatgcatggttacaggacagacagatacttcaagctttatgtcaaaaccatttgcaataatagcaagagcccttaagcttgcatgtttctttccattcctcatggtgacctcaagtgcaaaatggctgttgttaagtgatttggggatggttgacaatggcaaagctgcagtaaaacattcccatggaccatctgggccaagccctatccagaaaccactctttgcattgcttaagctgtctttccagctctggaagttcgtctgcgtagatctttctacgtaacaacttgaaagtactaacataccacagtgtttcacattttcatgattgagtgcttggccctagaagttgaagcaaggagctcagcatatgaagtgacaagcagaattaacccaaagttcagcaatgctatttgctcacaacattgcctatataaattagcagtttaaagaacaaaattaataccttccttgtaagaggacatgttagcacacgcttgacatcagcagcttgctgaatgatcctcatagaagcagctcgtttcaatattgttgcaccccgtccaataggaattgacaatgaaccaagtacttcaccttatgcattgatggaagatgttaagaaaccctaatactattggatcaacaattacaggagataacttaaatactactatattacagtaggtgtatccttcaaataattcaggttctaataactcaagaagttacctttcccagcctttgatgcaagatttgttacctcaatctctaaatgagcggatgcctgcaaagtaaagaaaatgaataatgcaatgctgctaacaattttgcaaaaaaaaaaaacatagagtaaactggaatggtactatgagacgtgaataaaaatggcaggtcaaattacctgctctggcacttcaaatataaaatgttcattccacttagcatgatgtgtctgtgattcacaagttttcaaaggttttacacatcttgtcctggcactctgagggaatatcttgtactggtcagaaacatcacttccaacaagcaagcgcaaagcacagaagtagctgtgatcattgccatcatccataataggcaaaccctacatgagaagaaagcagttagttcatatcaaaagcattgtatttgaaaagcaaaacgcgtatctgagtatgaccttggattcaaagatctgtatgataacataatatcttgattccgtagaattggacagtacacttagtttatcagaaaacctgggaggtggcataaacaatgagacttgattctcatgctgtagcagctcaataatgtcttcattgtcttcaagtttcttaacataaatatcacatcctaatttgttctcaaaaactattctctgaaaatcatcttcatccaaagcagagcaggacaaatcatcagcatttttcacactgtcaactgtatcctgtcaaaagggtacacatgctatcaaccatgaatcatgctgtcaaaaagcacagaaacagaatcatgaataaactggagggataagttgaaacctcattctttattgatgattttttttccagatcgatttgtcttttccatgaaattaaagtttctataagcaaatcaagatttgcagaactcaggttgacatttagaggacttgtggcagcaacacgaatcctcttaccgacttttgaaggagggtgtttactggtatcatatgtctcaaaccttcaattatgattaaacaatgttaagttagtggcataaaaatctagaagataatgcaactttaagttaaaataagcacaacttacttgaatatcccatcaaatggctcaacaaaaggttcccatgcttccaggtgtctattgaatgttgatgcagaaatcgaacagatcaatacagcattcattgtctcaaattttccatgtgttgcaagatttatatttgcgattgtagtgtcaaaaattggcgtgacctaaaattttggaaatatagttggcatgtagatagaaatatttgaatgatatatattctcagtccaaaaaagaataaaatttagcatgcgtacacaccattccacaggaactgtcaagaatgctgactgacaagcatccaaacttcagctcagcagtaatattttcccgcacctttggtttagcatggtctgctattctgtatgccatttgagctggtggttttttcgtatcagatgttgccaggaaagtgcagccctaaaaacacagcaaattgattgggttcctataattacataagttagaatgatgcaggtataatggattacctggtttgaaactttccaaatgctccagcagttaggtcccttcgagctagaggacctggatataggatcctctaagatatttgcatgattcaccagacccatcttcggacagcaaacggaatcattgcttggcatttcatctgtttttgttgcaacacatccaagagaagcatatccaggaggcggcactggataccagaagaataatatttcatcagaaccctttctatcaatctgggctacttttttaaactgagtaggcctttcagaaacaattgcgctgtcgcacttaaaaagaataccaagagtaggtggttcaaacctgaaagaagcatcaagcatattaacaacgtaccacaaagaagtacctatgtgtgtatataaagaaatcattacccttcagttatacaatcaccaactgaggaaaacccaaaacgaggtattggccgccatatagaaaatggtctttttgtatctccacctttgtcccaccatattctttcaaagtgtggagtagacatgcaatagctgcttggccttgacaaatttctaacagcatcccaaccagaagtactcttgcgatgagttaactgatcagcaggctggttactccgaacagaagaatctgcattcaaatctttaacaatatagcagttgggattccggagaagaacatggtgcaaatcaagagcttcaactctagtgggttgttcaatagaattgtgtgcatggaaggaagcaatcacattgtcgacacgccagatgctaaatccaggagttactctgcacaaagaatataaacacgatgaccaactacatgttctcagtgttcataattaaataataactaggcactcgacactttccagggaaagaaaataagaaaaaaaaatattgcacaacaaaacaataaaaggatgttgccatacccaggagtaggtgagagagtgtggatacaatcagaaaaagctgtagaagtcacaagatctgagcgaaggcagtacactacgtgatttgaaggtggttgtcttccaatattgaccacacaccctagagctatgtatccaggtggtggaacaggaatccagatagaacactcattgtcctcagctgcctgagatgaattcatttgctctagagatacaggtaatacatgaacaagcctaaatccaagaggtttccgtacacggccataggtattacttacagcaaccacaacctgagaaggtggcacacacctgacaaggtaaagtatcagctttggcaggacaaaaggatctccgtaaaagagaaacatagttcagcgtatggaaggcggtattaaaaactattcgcattcaattagacgcaagccctagtattcacctgggattccgaacattatacacatgactacatataactgttgcagtagctttaataatactcaaataacagttgacgatataggttctcaagtggcaaaaattaccttgaggacacacaatcacccaaaataacataatttgaaggagcttgtggcctccaaaaggtgagattgtacccaggcaactcacctgtggaatttcatcaaagaaggtaaaaattggtgtacccagaagagcaaacagaaaactactataatacaaaagcagctaagctaagttgcagaaaccatgaaaaatagtaagagttagaggaagtagcacacaagtaccattaggtgatgtccaaactcgcttaaagttaatacaagaaaccaatgggttattattgccaaactgcaatgcagcaagagtttgattttgcagtttgagcaagagagaagccacactcagagaaagatgaatgtatacatcagtagatgcaagtactatgtttgtcttttcactgacagaagtatatttccatgaaacatcaacaggttcaagaacaagaagaccagagccagcttcgatcgtaaggtctttaacaactgatcgagcccatatgtctttttcctttgaggcatacctgttaaaatgcacaacgattttatcaatcaacagagaaaactgacatgtatacaacaataaatcgacatattgatggcttagcagaggtaatgtaatgaagacaaacatgaaactgaaatccatcttggcgcgaagaagcttctcgatgtgcaaggaatcatcaattgataactttgaactgtcgtaaaaggtaaattctggggatacaacctgaatattccagaaatgagaaatgtgagacattcaacaccataaatgtgcataagtccagaatcaatacacttacaattcaacttaataagagcaaccggatgtttgtttttaagtaaagaagaaatgcacataatgtgagtagggaatttattccatgaacaaaacagttggtgaggagaaagaaacttgttaatgcctgtttgtagactaaggaagcaacttggtacactacgggtaattgtccaatttataattatttaactaccttttcttatactcttcctttttcataaaatttccagaagcaaacagtgctaacaaataatgaattaggagttaacgcaacaaacattacacgctttcccaaaacctactgtggtgacataccacaaatcctacaactctgggcactcttccagatagttcatgcaccatgctagttcaccacactcggtcactcaggcttatatccaaggtttcaattgctaaactttttgcaggcttgtaagttttaccgtcttaagaaaaagaacagaaaaaaggtcctaaaattacagaaatttaagcagtatatactatttagcaactctcaaaaatacattagaggagcttgcgtaaaatctaattatgtacctgagcctcaaatgtaaaattcagcatttgggccgagggggtatctgcaccaggctgaagagcattaattctcttatattcttcattttgcgtattatcatcttcattatcatttagagaactttctaatactgaaacttcaacgccatcttcagcagaaattgagtagctgcttccagcattcaaatatacacacctccgcagtaatgcaccgttcttttatgaaacaaatagccaagagatgtgtaagtttggccaaagaataatagtgagactggcaacaggacataaaaccataaaaaaaaatcactgagcagatacctcaatcttaacatttttgaatctaagttttttgccccgccccaaaataattatagtccctgagtataactggcccttcttgtcatattcgtcacataaagatatggtgcctccacagccatcgtaagtgaaatcatcaatatcgcaaccatcaactattagctgcctcccaggagatagttgaataaaattctctctctgaagaaaacaggctcacaaagtatgatgtcatctgacttaataagaggatcattctttggatctagactttcctcccggccggttattgtgcctagatttggaacaaaaaactcaacaacaggcagcagaaaatccaggacaacaagtacacgaggttcctgaattcttataacaaatgactgaaaggaagaacgccatcgataatccaatatcaccatggtgaggttggaaacccccacatcagatgaagggtcctgagtactcagcttagaagtctcagaataagatccaagcataaggcgcatctcggactttgtatctggcggatatcatggatcaagaattttagtatagacaaataaaggtccatctcaaatagtgaagttgtcctataagaaacccataaaccttccagctattaaaaaatgaataaaaaagtgtcagtaataaccaacatgatattaacacacaaaaaaaaaggcacacaaaaagtagtacaaaaatgcagatgacaaaggaatgatatatttatagtaccaaaaataaaaatttgcagaaacatttccctctgcaacagcacaagataactcaccacaagctctgctagaggtgactcagcatctggaccattgcgaagctcaaacaatgcatactggacatccacagtcattactacaacagtacgcgatagtaacaaatggttgttgagattaactttatctgcaagtagacgaattgaatcttttgtccgatttacattatcacggaaacctggggggaggttgggcgcttctgataggtttgtcgaaatgcaacttgtgatgacattgtattccttatctgacatgataccatggagcaaccctatctgcataagaaaaaaaatgataatcatataaaacacttgttttttttgcatttttccactatatatgaagtttatcagcccagttcttttctgacgaatggattaatgggcatgcttcccgagctcctaaacagtgcgaatttttgcaaaaactctctgaatttcttagaagactgttttaaatccattttcaatttttaacagttaattcattcaggtgtactcaatagaagagcttacatttcagatctaatgcaaaaatgaaactgataaactgagtaaatcaaattatttagagtaaattccagaaaaaaaatctgtgttttatgttcaaagttgcacttgcagaaaagcacatatattagaacttgtggcacataatatactcattttttacactgaaccagtaacaaaacctttctggagattgatgctacacagtaaagctattctccacttttaatagagcttttaaatcatggcctttgaagtgaatcattccacagataactaagtccaatctaaagtatgaaacaatggtgataaaaaagtgagataatcagcaatataaaagtactgtcacgtcacaagaaaacacttttaagtataaaaacaaattaatcacctgaaatttcatgcagagcatcgggacccttttgaaaacatcccgcaagctacgtcgcacttctatattgatgccatgaccttctctaatcatactctttcctagaataccattgactccaaccgccatgttgattccattaatctatttcagtatcattgaagcagaagaataagaaaactagataagcatactgagattagtaaagtgaccaattttccattccaatacatacctctgcttgaagaatatcaaggcgtacagcagaaggatcactctcttcacctccacgccagcaaaaaccattcctaactttcagttgtcccagatccagttgtatatagctgcagcatgatatgaaggtgatgtcaagctttctaagtattattaaatcaccattatgcttcactaaacttgcccacaatcaaaataaaaaagtgcggactaaaatgaacaaattagtatatgtagacacaggtataagaaatgtgcacacaaaatgcaaaaccatgtgcctttctccactatgattcagaattgcacacctacaatatatggtgtagatttagactacaaacaggaaatttcttatctacctgatcctaaagaactaaatcaactaataaaaccaaaaccaaacacatgtactggaaaattgaaataagggcatactctttgctctgggagttctttggaacaataattatgggtgtgtcaagtgaaagatccagctttatagcagaagcaccatctatttcatatttctgaatcaaccactcgaaacctccaactttgtcgatgaacttgattgcttcttcagtgtgaggggtggcaagctccatgaagtaagaggtgaactgcaaaatagaaggcactttcagaaagatgtacatggtcatggataacaagaacaaacagcttgcaagtgtaacacatacctcctgaacaaaacgataaaggaatacaattcgcacagcagaaagttgcccaatcagactatagttgtaaccttcatagtcatcatcgtcaacgctgtaagactggaacgcaaactgcaacagagaggaaacattaagatttcagtattttgtcggccacaacacaagatagtcttgtttagtttgactgccacaaccaaataaattatagttagctcttaagaagattaaaatggtaaattagtttgcatagagtacaaagtttgagatggaaatctgatgcactgtcgataaagagagaatcaaggttaaaacagaggataatcaaccattctaggcagattcactgatgaggtaaaaacccaggtacttgaacagatgatggaacacgagtagggataggtgacgaaatcaatgtgctattaaacaattaaatatatatggtcatgttggaaaactattttaatacgaagttagttaattggttgaaagcctttctttttcaatatcaatggacaaaagctctttgataatctagtcaaatctactatttgaatctcaaggcagcaaatatgattatacatgtccgcatcatactcttcatcttgctaacctttacaaaacaaaaagtaagcatcaatatacatatttgatagtaaaatggcatacctgacagcctacaatgtactaaagtattgaagagatgaactatgactactctattggtgcagctgtctgggaatgaacaactgacacctgtataaaggattgcaaaccaatgtcaataatacctttataagagattcaacacctggtttccgtatatcacatagccaaccccaacgatgttctggcccaagagacatgtcacaaaatctcatattacccagcataccatcaattgaaaatgaacctggatgaacctgatatataaaaaatcagaagaaacaatataaaaacacatatgcatgcagcttaacaatgaataaaaagaaaagacgcacaataaaattctaacaggcaagtaatcaacctaaaattttaaatgcaacaacatagcgatcttgtcctagattgctgccttcatggatgattttggggggaacatcatagttttaattactttagtaataatttataaattgaacctttcatcaactaattacatatgctatcaccatatcctagataatgtcctagattgccacgttcatggaaggttttctagggaatttcatagttcttgaattactttaataatattgtatacattacacctttcattaactaattacatattccatcaccagatagatgttctagtatattactttgataatttcattatttagtccaaatacattaacctcaccttcagatcaaacagaaatttctcctgcacaaacatcgcaagctgagaaccatcttccttgttaagaaacatagatacccgatccacatccatcttcatgttgaagatagttcggcgttttccatagcctagcaaacctttaacaaaattgcgagcattatcttccatccctgtaggtttgacgttgcgtactgcaggtgttgtatcagagtcaccctttggggcagaattaaccatgctaagatcaaatccaaactcaatcagagcaacaagagttggtctgttacagtagaattccagtgcagacatacggatacacatctgtaaaaagcaagatacaaaaataatcaaacttcacagagagatttacaatctaggaagttaaacatatcaacaagatgtacattttgtgattttaggactagatatattgcttctatagttctcgcttggaataaatctatgtaacagtaaaagatgaatatattaaattacctgcgaatctataccatcataaagacaagaatcaggagtcctggtcaaaaatgtaaggacaacaaaatcgttaatattattgtcttgtgcctcgtaaaatacttccgtaggcttcactttctgctgatccccatcaaagcttaaaccatctttcgaacttaattgagtatgcccatctggatcaaatattgagttggaaggaatttccaaatcttgaagatttggactttggtcaggagtgaaatctgtcagcgcatccatgaaagaatcttcctcaacagagaaggattttcgatgatcctcctcatcaggtgaactagaatctacagtttccaaattgtcattgataacagagcatgctagataatttgaagacatagagagacgaccctgaagctcatcctttatcttcaaagaatgcagttttgtttttacactcaaaccacgagaagattgaacaacattaacctgcaacattatatgaaatataagtgatggataaaaagaaatgaagacaagacccagtaatctagatctataacaagcactgaaacaaaaagctgtgaaataaaatctatcatcaatgcacagatctagaaaacaagcatcacattcatttgatagaaggaaaataactctgctcttgtatctgttgaattgcatgtgccagcccagtggtcccagccagttcaacccaaaagcttaagctgatgagcaaaggtgcgattcacttatacttcaacactccccacgtggaagctccctcaggcctcagacatgcaatagaagtggactacattttttttatttaattgtgtcatccaacattcaaactcgagacctctagctctgataccatattgagttgcaagccagttcaacccacaagcttaagttgatgagtgatgaagcacgcaggcaatcacctatacctcaatataagcatatgaaggcacaccagactgaagttaacgagaagagcaagcaggcaggactatgttgtgagtctgccacaacaagaaggcgagaaggcgaaagaaggcgaaacatcagtccacctatacagaaggcgaaagaagactcacaagaaatgcagcatgccaatctagcagcaataaagaagtctgtctgaaaggcaatgtcacaactaaacactaactgcaagagatgaaaaacaccgaattatggcaaaccgtctggcgcctttgctccctggtatggtttctgtgaaccaaagcgcttttgttaagcgtagaagcatacatgacaattttttgcttgtccaacaaatggctagaaggctgtacagtaagaaagaagcccatgttatgcttaaacttgatatttcgaaggcttttgattcggtcgactggtcctttcttcttgaagttttgtgccatttgggttttgggagacgatggtgtaatttgctttgccttttgctgtcaacctcctccacaagagttttggtgaatggagagcccggcaaggatattgctctttgtagaggcctccggcaaggtgaccccttgtctcctttgctttttatcttggttatggacgtgctgaactcagttgtagtgcatgcggatcatggaaatctactagaacctcttgctgtcccgcagacagcacaccgggtttctctgtatgcggatgatgtggtcatgttcttgcgtcctacaagcggggacctatctcttatcaagcagattttggaggtttttggtcaaatttctggactaagaaccaatatgacaaagagctcatgcactcctattcactgcttggaagatgatctagaagtgatttctaatgagttgtcttgtgaagtgaagaatttcccttgctcttatctcggacttcctcttacagtccgaaaaccaaccaagacagatttgttgccccttgtggacaaagtggcagataatttaccgggttggaaagcctctttaatgaacaaggcaggtcggcttataacagttagggtggtcctcttggctattcctatttatgcaatgatttcgttggatcttcctaagtgggtggtcaaggctatagataaaaggcgccgcggcttcttatggaagggaagagaaaatactaatggaggaaattgcttgatatcttgggaccgtgtgtgtcggcctttgtcctatggaggccttggtatccttaaccttgaaaagatgggatgggcactacgcatgagatggttatggcttcaaaaaactgattttgctaggccttgggccagtttgtctattcatgtgcctcagaatgtccattctcttttcaatgtggctgtcaaaactgtggttggaaatggagaaaataccatgttttggagtgataggtggctgcaaggtaaaacagtagcagagctggcccctaatctctttgcctcgatctccaagagggcaaggaagcaatgtactgtggcgcaggctttggaaaacagaagatgggtggctgacatacatgggggactatctgttcaggtcctttatgagtacttgaccatttggtctttggtagacacaggtggttctgctacaagatgtacaagaccagcatgtttggaagctaaccgccgatgggatgtatacttgtaaatctacctatgaagcttatatttcctgggatcgatcaagtttgctccttggaaacgcatttggaagagttgggctcctcttcgctgtaagttcctctggttggccatcaataatagatgttggacagccgacaggcttgcgaagtgcagactgcagcaccccgcggccggtcccctttgtgatcaaagtgaagaatccatccaacacattttgatctcttgtgtcttttcccgccaagtgtggacacctctgttcttgaagctagggatctctggtatagtgcctcaaccttcatccgattgttttttgaggtggtggagccaatctacaaaataccggccaaaggacgtgcgaaaagggctcaactccttggttatcttagtggcttgggagatttggaagcatcgcaatgactgtgttttcaatggcactaagtcctaatgttgcgacggtcttgcaggtggtcgagaacgagggtaatctttggtgtttagcgtgggcgtctgccctccaaagtttcttagtggttcagcaaacctaggcacctaattggccggggttggccggggcgtgggtgtgtaggaaggttttggtatctcctactttttttttcctttatttttcttccccttaatgaaatgaaatgaaatgcaattctcttgcgttttcgagaaaaaaaacaaatattaacaactccatagttttcgagaatgctttggcacactaggccactatccattgacaagagagtaaactgggctgcaggtacttattcttggtgactgggtatgatatatacaatgcaaattgcaaactgggctggtggagaaacttgacaagtgtgtttttagccacatgatgtgtcatcagaaattatgggctacattaactgaccacctgggcaagaggcacacgtgaagcttgccttgtccacatcgcaaatactcagctattgcagcaaacctagcacaacccactgacttgctttgcaacttcttgtactaaattgcaccaactagcttggcaaattattggaccaaatcacacatactcagctcataaactgtcttatccaccacaacgctaaccaatttgccattaacatggaaaaataaagaggaaaaaaaacacctatcaaacaagatcaaaatgttattcagaacttagcaagagtgagtaattcataactagatacaagcgcaaaaatatctacgaagtacacatactagatatctatctatctatactttcaataaagttacaacccacttgatggaataagtcttagtctagtctttgcattccttttttgctttttccagcttttaggatgtcatagcttttcagcttttagtcggtgttagaggacagcatcctcactttctgttttagaggacagcatcttcactttctgttttagaggacaacatcttgactggatgccctagactagctgcagccagctagctactactataaatatgtatccaagaaaatagacagaaaattgccccaactctcctagtgccatcctctcaatgagagtaaagattttgctactaacaccactaactctaaagctacatgcaaacatgccacatcatcacccactagcagtaattacatatttaacttcatgcaagcatgcaacatcatctacaatctatttaattctacaaatcaacatgcaagcacatccaatcatcacccctcacatcatttccataatattttaacaaatctatctatcatttttataatatttaacatatacttatcaatatgttccacattacagcacgggtatcatttgtttatttcatgataagtactaatgaactctaatgtttcattattatttttctatttactcctagctcgattgtcgaaaaaaagtatatagaaaattgcttagtaattcctgtagcaaagcacagggaatcacctaaatggaaaagatgtacggataagtttaggatagtgagatgcataaagccttccgttactttttgctataaaaaagaaacaaaagaaagtgaatagaaactctacttttggaggggaagttggggggagggcagagtttcatttcaacaaaggtgtggcaaacattgtttcaacccagtctggtatcttaaccaataccacatcaaaacttgtgctgggtcaacctgttttgggaacctgacctactcttccaagcctagggtggattgcaactgacgaatatcccaacatctcacgatatagaaccatttcctagggaactacagtttcaccaagtaagtttattcaggaatcaggtttagttaccaagtgttcccctcgtttgtctatgcacatgttagcttttgaacttatagtgcaaaatggaggtgtaatgttcaattccttttctgtttttttgttgaatgcaaacaaaaatagaattgaagcaaatcaccttgcctccacttccaaggagctctaacattacaacctcttctggatctttcttcttcctgtccaactgaaagaaatgcatagataacaagaagtcaatgaaacaataagcattagaatgactagaacatgacaagtccagtaagaacaaactatctcatgaacaaataagatgtcaagatggcaattcaaaacaaattagaagtatacctttgcatacagcgaaagcttcgtttcaaccacagaaccattcacaagaagatccactgatcccaagctgctcagccttggagtgcttggttctgttgtactgacagggtctcctagtatgttcacttcaggaggggcctacaagaaagtggagaaataccatcagacaaactatatacaaacttcaggtcctatgttaaacattataaagtaaaggaacgcttacagaagcttgatatgttgcttggacaagcgctttcatccaattggccttctcgatttcattatggtattcaattatcagtgtgctagttgattccagcgcctgcaaatggaacaatgctcagatcaaaaagggaataaaaaacaagttatacggcaacacttcaaaagaactaagtattccttcagtagattttgtcaagacaatggtaccccaacccgagcttttgactgttaaacttccttaggtgtagcgctagctataacatggcccacctgatccaactcatcatcttcttcttgctactaaaactgatataccatggtgagaacgtcttctttgactgattttgttgtttctgcttcctcgtctccattgttggcacatggcctacttgactcataattgccaggatcagatgtgcacttctctgcacgatggtttatcaacttcttcctggcacttcagttctacattccactgctcggcactacagggatctccagatgggcgtgactcatcactgtatgacatcgttgttaaatctggcagttttagaacttgatcaagaactagtaggaagtagctattgattttaccatcttctctcgtttactagttcattggatctcattgtacccaccacccagacaagaggagagaacggacaggtcgctagacttaatcactaacattactacatactccatccgaccgaaaatataaggacttttggagttagacgcaagttaaggagaaagataaaacaaaatgaggtgagatgagaaagtaatgaaggagaaagataaaataaaatgaggtgagatgagaaagtaagtggagaaattaaatgagaaatggttgtgattagttgagatgaggaagtaggtggagaagtactccctctgtcccaaaatataacaactttgccctcaggatttgtcccaaa

SEQ ID NO: 81009 - DNA, 1399 bp, Oryza sativa
gccgacatgtgagacccctgcaccgacgtcccccgccgaacagccttagtgcgccgaagaccgcgccacactcaccgacagcacctcctcacacctagatcgcctcctccaccgccggccgcgcctctctgcaccaagccggcctccttcaccggacgcgcctctcgcgccaatccggcctccctccatcggccgcgcctctcgtgccaagccggcctccatctctaccgcccgcgcctctcgcgccgagccggcctctgctgccatcggctgcgcttctctgcgccaagctggtctccgacccctccaccgaacgatgccgcgccggccagatgcagctgtctcccacgtcctcggctagtcaaccgaggccgccatgcctccggtgaccgcaaacatggtcaccaccaccacagccgccgctgcctaacacccaaccacctcgccgtcgtcatcctcacctcgcacccgactccttccctgccgccgacgtagccaccacctcagagtcgcagccgccgtcgccgctgccgccgtcgccgctgcctccgcaaactgccgctgcgccgtcgtccttcaccaccgagcagctagctgcccgacgccatgtctttcgccaccgccgccagttgacacggcagccaccacagccaggaccgccgccgccgttgccaactgtcgccgctgccgccatcaccacaccacggctgtcatcgccaactgctgccggcgtccagatccggccgagaccgccgttgccaactgctgccggccaactgccgccaccaccgtcgccacaccaccaccgctgtcaccaactgccgccaccctcaagatccggtcgagaggcgcggatctgtggagcaccgccaacgccgccgccaggcaccgcgccgtcacagccacgggacaaccgccgccgcctcagcgccctcggccagctccgtccccgccgccttcagccactgccgcccagcgctgcgcgcccccttcgcctcgctgcctggggtcggagctcggcctcccgtgccggatccagacaagagggggccggatccggccaccccgccgcctccacgctcatcaccgccgccggcaactcaggatccatccccccgcactagatccacgcaggagagcataggagccaacaccgccgcctcgtcgtcgtcggcccggccgcccacctcttcaaccgtcgtcggcaccgccacctcgccgacgccatgcgcaaccgtcgagctcgacgtcgcagccgccgaagtcgctgccccagagctaggtcggggtcgtgggctccgaacactgtgaccttggggggggagaaggccccaccgccgccgtccttgcggccgcgtggtttccggcggcccgctcgggcagcggcgaggtggaagga

SEQ ID NO: 81010 - DNA, 4586 bp, Oryza sativa
cgtcgcagccgccgaagtcgctgccccagagctaggtcgggagtcgtgggctccgaacactgtgaccttggggggggaggaggccccaccgccgccgtccttgcggccgcgtggtttcaggcggcccgctcgggcagcggcgaggtggaaggagggcggtgggggtggtgcggtggtggcggctgggtcgcctcccgtgtcgcccctaccctgggagtgacgcgggggcaaagggtttggcctagcccccgagagaggttttcgcagtgaggcttccttgacgacatctccagtgagaaaaacgatgatgaacaccgacatcgccatccgtcgagatctcaaggagaaccaagacaataggttttctcctggtagcccacctgaggaagaggggtggctcgacaatgccccaaagatggaaaacaatgcctaaaacaccattgttgtcgacctggcaagaccaagctgggctttactatgtcgctcggtccatgaagacctgaagaaaaagctccaaagctccaccacctaccatcctctatcggtacatggtcaccactgtactgacgccctccaccagatagcctcaccgacctctctttcgtcggccctccgcgccatcgaccggggcggcctccctgccatcgcccgaaccaacctcctggagcaaccagcatcagccttcctgaaccactgacgccacctgcgtcgtgctagcctcccttcgttccccgccggatgcccctcgtcagtcagcctcagcccacccatggcatcatcggccacctccacgcatccttcttctcgctgcctccggcaccactcgctaccatcaagacgggcctcactagccaactcgtcaactctcatccacacgcgtgtgacaccatcgccgtggggcacctccaccgcctgccccttcaccgcatgccaccgcctccctgtcacagggagccattgcaggggagtcggcgtccctcgcctaagaagcctgatccattaggggggtttgccgtatctagcgaaggggagccagatccggcgacgcggtgcacagacaagcctatagccttgccgccatggcctctaccctgtcagtcagcggcagcggcatggagtgttcgacggcctcccggagctcctacttctgcgcctcacaaccattatattgatgggtagcacatggagtgttccatgtgttcttgcacggggtagatttaattttcaacatgattttcatgagattcacataattacctctactgtgcatccatgcactatgtatgctctaatatttgtataccgaagcgtaaatcatgtaatcccccaaaaaagacattgttaatggcaatgatagaaactatttatttccttccttttgtttcggcaatgataaaatcatcatgaccttgctcatctgctcacattgcttaggtacagtcatcttatcttatcttatctctcgatcctgctcttaattctctattgttccatttcatctacctctgccttagttggttaactagctagtgcaaatcctagtaggtttaggatgcaacaggaacaaggaattcacccattgtagggcagtggattaatttgtcactacatgatgccacagtttagcaggcagtgacggcggcaataaatcctggcactagggaacggagtggaaaacggcgctaggtgtatggaatagacagaggtgtcaattgcatctattgaaaccatttattttcttcctctgctttgccctacatataaggcatgtgccattgctcacacagtcatctacacatctaattggtcttgctctaagcctattagaatttttgtgcagtcctcctgcccaagttgttccctgggtgcatgcatgaagtgcagtaggcttaggaggcaatgggaatacaggcttcatagcatgaccacattcaagtatcaaattgctatatagttgttctagtgattctgaagagggtacagtactgtctgacgatgcgtgctagaattgatattctcacacacactcagagaccagagtgttgtgtaatatggtgaagagagaaatgataagaggatggtactgcaaattggtgttcgttgtcgtctcgtcaaagtcaaggtagatatagacaatcacactggaagaatatgtgagctatggcctagcaggaaaagtgtttgcccgatgggctcatgggggaagagatggatggtttttatataccggcctgaataatttgaaatgcttcttctagtatgtgttagtcatacttgcaatgagccgaattagattatcgcacagttttatatctagtatattcactggctctaaaagtagttggcattgacatttggagttcaaagttgaaatttcttgatcaacagccgatcagaaaacagcaggggctcccttgctgttaagaactcttgttaataagaaaaaaacaaaaaacaattacagcagtataattcagttctgtactacattctaatctctctcattaagtctgaaaagaagcagcaagaggtctcacttgaaaaggtgtgtccaagaaagcaacgtaggtgaattatgattgaagatcgaaccattacttaggcactgtttgaaagattagcccagggctaattttgagaactaattaatgtttagtcataaattggtaggctaaatattagtctagggtggtatgtttggatccattggctaattcaaggctaaaaggtggagagagagtagaaagagaggagagaggaagagaaagagctgctttttgatggtccctacacaaaattatccccattagcaccccatagaggggttaatgttttgaggagggctaattcactttaacctcaaattagccctcctgtttggatccttgagggctaattcagggctaaaaggtgagggctaataattagcccatagaaccaaacagggccttagcttccaaatgttccacgcaaccaacaataatttctccatacttaaggatgtgtcctaagttattatttccacaatattccagcaagcaactgaaaaagggtattggaagaacaaccaaaaattagtgtctctagagcttgatgactacagaaaacacatgccaaatcacaatctggtggagcaaagttcttatgatccaacatgacatgggctggggttcagtctatccatcaaaaggagtcataaaaaaaccttcaattttaagttacacttactcttccttatccatataaggtgttgtggtggttgactgttctgaaattgagggcatagaatttatgagaagtgtatttcatgcctccgcgtactgttctgaaattgagggcatagaatttctgagaagtgtatttcatgcctccgcgtatataactacattggtcattatcttgggacaaatataattcattaaccatgtctttcataaccagaaattcatcatagctaggcatgctgtgataaatgcaaccgaaatctatcctgaagttgttgattcatgaagctttgaactgaggaatttgtgttaatggcaaaggtaaacactcaaagcctcgctacagtacgctctactagtagtagagaggtagagagtaaccaatcatggttcatcgttcctctttcatctcaactaatgtttagggcccgtttagttccaaaaagtttttcccaaaaacatcacatcgaatctttagacacatgcatgagtattaaatatagataaaaagaaaaactaattgtacagttatgggggaaatcgcgagacgaatcttttaatcctaattagtccgtgattagtcataagtgctacagtaacccacatgtgctaatgacggcttaattagtcttaatagattcgtctcgcggtttcccggcgagttctgaaattagttttttcattcgtgtccaaaaaccccttccgacatccggtcaaacgtccgatgtgacacccaaaaattttcttttccccaactaaacagggcctaacacttcacgttgtttggagcttgtctagtagtggtgtaaatggaggtgcatgtggcccatgtggtgtaaattgggctgtgttcgttattgggggttgggaacccatctcctaaaaacggagcaatccattagcgtctgattaattaagtattagctatttttaaaaaaaatagattaatttgatttttttaagcaactttcgtttagaaactttttgcaaaaaaatatattatttagcagtttgaaaagcgtgcgtgtgaagaactatagagaggggttgggaagtggctgaaacgaacgaagccaggtgatggagttcatatatagtacctatgcaatatgctatgtgtgtatgcagatcctactccttggaacagttgagttaatgtgcacttttgaggcgtgtctttcatacaaagtcatttatgcgagtctacttagggtgtgttcggatgcccccttttcctaaccctctttcttgttttccacgcgcacgttttttaaactgctaaacggtgtgttttgtgcaaaaagtttctataagaaagttgtttaaaaaaattaaattaatccatttaaaaacggggatcca

SEQ ID NO: 81011 - DNA, 9533 bp, Oryza sativa
ctaacgatactccctccgttccataatataagacacaaccacttttcttagatgttacataataaaaggcatgcatgcaagcatgcaattaactatagcatcttctccattaaattattacttttttaaatcctccactctcatgttatctaattctattggatacatgcattatatttattaggatgatccaaactacaagatgataataattatttcttagtctttggattaagagtggttgtgccttatattttggaatggagggagtaatatatattttttttaaaaaaatgaactttcttcatcaacatttcttatatacatgtatatgtatttacaggtatatgtatatacatgtatatgtatatatatactttttttaaaaaaaatcaacttatcaactttctgatatttaaatatttatttgtgttctcaaataattataatccaaagctatttttaatttttttaggactcaacaaagaaatatacagcttgagacaagtcaaatatgttccccgcaaaaaaaaagacaagtcaaatatgtatgtctaaattatatcttgaattgctaaagctgttattgccttttgactagatggttttctattttgcttcaagaaaatggctgcctgttgagaggcaactttacttgctcatggcgaacacaatacacttcagaatttaaaaaatgtagaaattaacattagccttatgaggtattttatggtccttaaaggaagataccaagagatgccacacttatttgtgttaagctatggtgcttcttggtatgtcaaacactagaagacacactaccgtaaatctaacaataaaatcacagaaagattcataaaatagctctgtaacttgtaaagcaaacataaaactttcgaaccatccaccacactgcaatacagagagccctgaatccacatggttaattcaaagatttttcccatcaaactattgcataacacggtcatgatctgcattttgcaactccatgatgttcaggcaaatatgatgcaatctaactcaacttctaaactgaaatcttacattaccaagacttctctaatctctcctgaaaaaagggaaaaccacctatcttagcatcacaagctagcagggttaacagtcgataaagaacaaaatgaatgtgaaccttacaagttacaacaacacatctggaccggccaaaagatttgaggcagctttaaccatcgatctcctcatccagaggagagaaccatttggtaccagactaatcatccagtaaaaggcatactgttttttacacaatagcccatacaacgaaccactcaagctcgacggcatgcctaggggcatagccgtgtaggagctccttgaccttgatgaaagcggtgaggtcgaaccatatttgctaatggctcggttttgcacgtttcatgccaccattgctgaaaggggagacgcttcctggatgaggactgtcctctctcagagtagagttcagcattgccagttccctcagctgttgtcttttatagtaatcttgcgactcatcctgcaaagacgaacaaaagaggtcagctatgaacggcggtcatagctgtaagcaacctacagaacatggttcacagaaaaacactgcaggaataactatcatagaatgacaacttagggaaagaataagtgagggggagaagaaacattgtatatgaaataaaaataaattactactcaagaagagctgttggaaaatatctcaaataaatagcaaagctacaatgtgagacaacatgagaaaggctagttctgtggcatcatatgcataagcttcgaaacacaaacaaaaaaatggtccaggggtatgaaacggaaagcagccaagtctgtaggttagcaggattcgggctggcacccaaaacttaaacccttgccttctcatcacctttgggcccttcatcataaacttaacattgcagatccactgcaatttgggacgatgagtaccacagtgccagatgtatagacataccgcatccacttaacaatgatttgcagcaacaaaatattcattatggacaacaatgaagcatggaatggaagtaatgacttgggatttatggaagaaactttgttttgtacttaattttaattttatgatttgatacaacatgattcatttctgtgctttcttggcaagtaccaaagacctatttctttctctctttttgtggggaaacagacattttcccgcatagatcactgctcattttcccaggaaaataaccaaacatgcccttagctgaggaaagctgcaggtctgactagtactcttttggccctcaagttgcatctgttttgttactatggtgaatgttatattcctgaaagggtagatttactaagtttgtactgcaacactctagatatagtattggcagtagactaagtttacaatttagatcatcattgaatatcttaagggtcattaactccaattaatattactggatatcagttttatttcattatatatggccctcttgatgcccacagggtcacatgcagaaccacaatcagagaaaggaaactattcctgtcctagcgactagcgctgaggactgtctccagcctagatctgcacccataccacactaaccagttgcaacaatgaggacatcaggaccaatgaaaagtgctgccactgggctgcgaatgagagggagaggtgaagttaccatgacttgtatggggtggtacctctaaattttatgtcaacaaaaccacagagatgcaaatagctgtaactactccaataagcatggagatgtaaaattccttttcagttcagtcatgcaaaaaaaaaaaagataaaaaaacataaccggtgaaaagtttgtgccattagcctgtatggtagactttatggtagcacatttctaaattctaaattgtgaagtggtattatccaaatttcagaataaattaatacataaagtcatataaattaataccactggttttagcagttcatccattatttcttgtgcctgcctcaatcttgtatcaatgatattggctggcaactcagcttcaatcaagatatgcagtggatcattgaggtgctcatagccaggttttcctttcagcttctcctcctataaaatagaaaacaaagatgtgtaactgtgtatatttggaggatatatgaggggaaaaaatatggacaaggagcaatctggaatctttcagcaatcaagattaatatatgagacagagtactatcacattattgatgtaacatgttaatgggtttaaggggcaagacagattcccagaagacaagatagaaacccatatgggaatatagtagtacaaaatactaacatatgttctacaaagatgcaataaaactcaccaccatatatcatgaacccaaaaaataaatagaaaattgaaatactagaacaatacatttgtccaatacatgtaagcaaatacgttactcaatgttactaacttattattgttacaaggtttatatggtaagcaaactgatgagcaggcaatataaaatctgccttgaggcacacaatactccataaaaacaattttttaaacagttctttttgtgtgtttcccatgtttcttcgtgtttcagatcaatttaggacgaagtttgaagaccagaattcagaaatactatagaccatggcagaaatggtcacaccaataatggatagttaggatttactaatcagggaagagtacaatgaaggatttccaagatttctacaaaggatattaaattaaacataacaaagaagtttatcatcctagctagctgtaatacttagttttaatttatataacgcatgttatatgagtatataaatgtaaagtaattaacatttacaaacgtttgttaccttatcagcatctttgatagaacccttccctctaatgaaaacacgacaaccagttgatgcttcaacccgctttagagaattacccctcggtcctagaatacgtcccacgaaattgaactggagcaaagcgaaaatagcagacattaaaaacaagacattttatctgctggatgataaatcgcataagaggaacacatacattagggtaagcatcaactggaacctccatgcgtacaatcttcttgacaatataagagccatgacttggcggtgcgccttgccagtccatacttgtcccaggaggaggaggaggaggaaagcctaatctctgtcatataaacaaatcttattagtattgctcacaaagacacaacctaatgtacgccagccaaagaacataagaatcaatggtacagagttttgatgaccttctatatacaattgaagaaaatttcttcagaatcagaagttgaaaacaatgagtaaatgtatagacaagaagattcttgtagtaattaaaagcttgttttccttttgcacttttcagtaattaattcattatacatacctcttggtgtatgccattccaaggcccaaatccattgccatgtaggttgggtctcataattggcgaagacatgggactcggacttctataacgacgcctgtcaaaatcgttgaatccatggtcgttgaccatgcttgatacccgcatgatttctaaacaacacaaagattggaaaaggaggaataaataaggttattacttagaagtaggagtttatacttttttggaatgcaagagttagatgatagctatgatcaaatcataacttccctatgagaagcatttaaggtagaagtgaaatcaagaagcacatcaagataaatagatattacatggtgcaaatatatgctacaattagaagcaggtttgaatccatagcataattcataacaacaaatatattacttacatatttcagtttgaattctcgaaaatggtcagttaaagggttaaaccaggaaagagtgtccttatcgatagttatccaacccatttacttgggttgaaccgtggagtgggttttagataaacagagagacatgctctcagtatatgacaaaaaaaggatgtatttatttgtggatacttgctctattttccagcctatagtaaacataaattaaatgcccgccttgctcatctataaaagaaaaattgcaaatctaaattacatgtagtaaatccatgaaaacaggccgtagaccactttataaacactaaaaggtgcagtgagaaattgaggcaaaaaatttgacttcccactaatgcagctaaaaatagaacctgatcaaatgcagtctgaagctattcactaaaaataaaggcaacatactcaacatccgaagttcccagcccacaagaagaatgcaaatttctccaatatgagctaactattcatgcaattcttacacattcaaaacatcttcatatattaaattcaacagtttcttttatcaagtaagcctatcaacagcacacggtgaagcgcaaaaatttgctgatgcattcacgcccactgttctagaagagaggcagccacctatagctcacttaggtgcccaccttgcctgcctgggtagcgacatagcagccaggacatcttgttggctacttgctgctagccgcacctaacagatcagtaatcatcctgtatccacaatgcgcataccattgtctgctgctgatgcaatggacaaatgattgcaactctacacataaatcttgacaactactagttctcatcaccactttatttttcatcattgatcttcagttctcaacaagtctcaatacatcgaaacatctacattatttgaaggcaaaaattcaatggcaatcaccaaaacagcgcaacaagccttgattcgcatgctgtattataccattacactcggtcatctctgttgtgttgtgcatataacccccaaaatattctaacaatctcatctcgattggcaacgaaaaattcccgagaaagaacaagagggcaactcggcaactctatccaaacataagctgcaggcaaaatcagcagcatcattccacgcattggagccacccgattcccaaatcccgattgcaaaactaacaccacaaatcccccctcttcctcacacgaaacaaacacaacccccaccaatccgtgacaaacagtaagcgagagatcaatcaatcaatcaatcaaaaaaaagaaaagatctcaccttggttgagcagccggctgcatatcggcagcacctgcatgaaaggccccagcttgtgatgctccgcgagcagctcgctcaagtactggctgcaaaaagaaacaaaacccaagaaatcgcacaaccaatcacctaaacaaatcgaaaaaagggcacgcaaccaagagcaagaagcaatccttggatcaaagaatcagcaagaaacacagtagcaatccacggcggcggcggaagcgggcgaggccgtacctatcggcctcggggttgctcctaatctggggcgagagggttcttgccggggagaaaccctggtggttgtagaggccgcctgacatggtggcggccacgagcgaggagaggaggaggaggagaagagaggagagggtttcttggtttcttttccttcctagcgaagaggttgatgatagagattagagagaggaaaaaaaatatgaagatggtggaaactggaaaggttttgatggttccaaaaagaattaaagaaaaactaaaaaggagaggtttttctgctttaggttacactacctgccaggttctgttggataaaggggaattgctggctgctcaggtgaaaattaaaaggagggcaggtgataggagaaaatcccttacctcacatcacctaaatggctatttcatagacggtataaattattactgagtgaaattacgtgtgtgtatatatatatatatatatatatatatatatatatatatatatatatatgtaaagagaagtaatgtgataataaattaaacggtacaattaaataaagtaacccattatatccaatgctcttgttgagggtagctaactctctccaaattttaagtgcataataatggctttgttgctctagggttttagtgtaatagatttttggagcaatattgttacgggcttatttaagtaaggatgtgtcaatagtgctggtttataactcattctcccccataaaaatacgaggtagcttattaacgcatgattaattaagtattagctaaaaaaacttgaaaaattgtattgatatgatattttaaagcaatttttccatagaaaatctttacaaaacttacatcatttagcagtcaaggaaacgtgtgcgcagaaaacgaaggtgtagaggttgggaaagggtaatgccgaagtcatataatggtattgtatggttattttatattttgactggtttatcgttaatgtgtttttcatatggtcttttacaacaaactggagtaaaaataatttgaagacataaccaattgtttggcttatattaatatccatccacatcttggacaagcaacagtcttgatcagaagatgttcttttcatatagcaaatgctcttcatatgcaatcatgcgagctaagaataaggcttctcccttccgtagcatttaatcaagtctgcttacttgttatcattgttccctctatcattttcctcacaattatgagcccttttcgttttttttttctaatatcaatggttcgatatgacgagactagctagccataatttttttttatagattgtgggttctcaccacagaggctatatacctgatttaagtcgacctcatcattaattaatcatgccaatatttggcaaaatagagttatttatgaggggatcaagccaaataattttcattgccacaatagttagcataaaaaatgttgtaggcgatacatgaaatattagaggaacatagtaaatgggatggaataatggtaattttagtttggattgtaaggatgactaggcagccattccctacgattgtgcagcatgcattaccttggctgatcgtgcagaccaaataacctgatttattgggcccttttgaattgcatgaaagaaaaaaaaagaaggaatagaacatatgattgcaaaacataggaataattgtttgattggaccgtaggaaaaactcattggaaatttttcaagagctcttgctaagttttctccaaaatatctataggattgtccattattctatatgaatatcaaaggattggatcaatttcaaaggattggaaatgatccaatcctttgattcaaagacattcataagaatttttctataggattggaatcctccaaaattcctatgtttttcctccaaattaaatggacccttaaattcttcttaatttttgtgttatccttatggttcaatcaaacaatatttttgtgtttttgttgtattttacaattctatattttacgcttatatttctgttaaaatcctaccttttttcctttcatgttcttaatcatgcatttacatgtcccgtagcccaaaactatttttgcttttgcagcagctgacgttgctgtctagctcactgcagtttctcttactagcgagccggaacatttgtcataagaaaaagaaagacctcactgcgtttacaaatgtcttttaatatcaagagactctaattgttgaccgcaattgtggtctaccgagataagtatcatgcaaatcatatcatggataaactgaacatttataagtatcttacaccaaagatgaaggtaaacaaccatcacaatctagtccttgaatagatgggaaatatactcatttatttaattaacctactcacttgatactctaacctctcaaaagcaccatcatagctaatgatcaccgtaacaagatgttgatggtcgatatatctaccaatacatcataaacctagcaaggtggtgggccattgaagatgttgggctggccagcccaaaccttttaagctccttttttgcatgttagctcagcccagagttctagtttccattcctccttttccttttctttcacttttctggaaaaataaacaatcaagtttgatatttatttaattagaagaaagaggcacccgatccaattcaagttgaagatgacttgagctttgaattcagtggtgggaattattgttttaattaactcttactctggtaaaaaaaatatttattgttttgaacaatattcttacgaacttgtaaaattcaactatcaataatttctcaaatactttgtttaacaaataaaataatatatgtagattttcatagaaaattattataatcagaaacttattataacataaaattggttatcagaattttaaaattttaactcctaaacgttaaatatttttgaccggaggaagtatcgttccaatatttattgtttataaaataactcggagttttggtaaaaaaataattagggaatattatatacaattattatttatagaaatcaacatcggtgtgcatcctcagtgtttagtttt

SEQ ID NO: 81012 - DNA, 13175 bp, Oryza sativa
aacattcaagatatcatgtgagataagtagtatttaatttaagtatgaaaaagtggtgtttgtattgtaagagtagtgtctaatactaatttcttgatgatgtggagtttatgaaaattatgtctaatgtcttgggttgggactggccttatcatgctctataaatcttttcctctcatctctcttcttttaaaattttgcaacacggctaggcttttgagcatgtatgcctcttgtgtttctctggcagtactctttgttattaggtgtgcatactactagcgcaggctgtgcagtgggattaggcggtgtcaggattgcaagagtgaactccacactcacagcggatccacactgcatgtgtacataaacatgaagacttcatgctgagatctgtatgattgtaggattggctccagggatcaatcttacgaatccaacagctgcacacacgacttgtgaatacgtcagttcctccggttccaaggttgcagcgcataaagtaaaataagccccatttgtttttggttttcatatgtaatttgagtttcattaatcacaactctatcaagagcaccccttttcagttgggttaatttgaaccgtgccattgcaaatatgtctattcagataaatgttattacaatttatctattcgtaatcgtgccacttaaattttcaaaatggaaccatgccatcgccgtcacgttttctatctttttttccccatcgacacgtggggcccacctgtcagattcatcttcttcagctccatcctcccatcttctctttttttcttcccactagttaagtgcccgtgcgttgcaacgggaaaaaaataatacatcaatttcaaattatagagtaaaattgtgctgaatagttattgagtgtttcttaataaaaagtagtaatgcaataaaatcctaattcagtctggggatatacgtattcagctgtatttacactcatgacatcaaatcaggtaactaatcgcaacaagtatatacatacagatggcattgtgtatttcgtaacatggcaagtgaatgcaagagaagtaattttgcgagtataggggacaaaaccaaacaatacagcataggaccacacgtccgcaattcaaacccagagcaataccataatgtttgcactgctaggatatgatagcgtcaacgattgattgagaacacgcacaagtatcttctgtcatgaggcacatattctctatgcctgcaatatattcaatataaaaatctaatgaaccacaatacataaagcatcaatatgtcctctagaatcacacaccacaggtgcaccacaagctagcttgtttggtcatattcatagcaggtgatattccaatgggagaggaatggaggaaggttgtacacttgctggagatcagagagtgacttagtttggtttgcctggataagaggaaaatgggtcagtccttatttgccagtatatagtaatagttatatatgtatgtcataccattcccgtataactattttctctatatgataatactatgtgtttgcttctaatatatactggagcataacatgtaatttgtgcaaagatgaaaacatcagtcacagcaaaatctttaaaaaagaagaagggaaaatagttgcataaaagagaagctttgaaatctggatcaagaaatgacattgtcccatgaactatttctcaaaaggacaaatccacattcttaaaagtattagtatttcttaattttctccacaagttcttcaacaacaaagacatttcatgggtcaattacagaaaatacagacctaaaaacaaaggatagagcctcttctttataagagagaagagggggaactttttggtggatattttagaacagtcgctatggttcaaggaaatagctaatcctcaagtgggtaatggacaatcaattctatggttggatgatacataagccaaaaaaattgaattgaattgcatatgagcacagaggtagccattcagggctcctggacccactaaattgatactttgctgaaaaaagggaacaaatcaatccaaaagtcagctctaaacaaatgacattgatctgttgatgtagcataagcagtgcaattaaaagccatggaatatgagtaaacggatggaaggtttcgtacagaaaaccccaatttttgatagcctaacaagaaccaatttagggagcctcataaataggggtggaaaaaaagctcgggctcgtgagcttagctcgggcttggctcgagcttggttggcttggctcggctcgtaagccaaacgagccaacccaagccttctttttagctcgttgctgaaatgagccaagccgagctagctcgcgagccgcttgttttggctcgcgagcctaggccatcgtgtgtttatatcgattattttactttatatggcgttattatttgtcaacttgaaatttatcattaagattttgaactattgaatatataaacttatttaaattttacatgttgatgatttgttctttgctttttttaataattacaaaatatatatgaagaggtgttttaacaggaaggcttgcaaaccagctcgagctggctcgagccaggaaacaagccaagccgagctcaagttttagtttgtttcccaaaccaagccgagccaagccaagcctagtttattgcgagccactgcaagccaagccgagctaggctcggctcaactcgtttccagccctactcataaagctttctacaaaatgcaggccatacaaaatgcaggccacacaagaaatgctatctacttacatcaaaagaaatctagctttgttcttctgaaaacagatttgtaggcagtcctagcagcctatgtactcctatttgtaagttaaatatttcttaacttattgttaaaaaaaacatgtccagcatccttgagtctagcttgcatcaacactggctacttcaatcccatgtaaacatatgaatatgacaggcaacaggataaagtttaagagaaaaatatagagcaaaaggtttgtagttgcagcctcaatcccatataaatgtttaaaagcttgacagcctgatgtaagattttttttcattttccaccgctggttgtacgattttgggtagcaatcgattgggtgggctggacaggtgcagccaaaaacgccgcaacaatcagaactgatcagtctcaatatgctgtgacttgagaatttaatgcgttaagaaaaatagagcagcacttaatcagaagttatgtgcaattgatctgaagatagcattatatagtttagaaaggatatggcatcgaggtggggaacaaaagtgtgaaaatccccaatgatggagcagaactcgatagtgaagcattacctagtcatcgaacatcagtttcttatgccaacaagatctcaactaaattgcaagctcaataaacaaaagaatcaatatcctctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaactgtaatggttgaaagaacgagatctagcgatgcttaccttgtccacagcatggtggagagagttctggtggcatcggaaaggagagcgtgtctgttaggtagcctcctagtccttgctcacgaggaaaagcagataaatcaaccataggagatggtggaatatcattcccgttgtgtttcaaagccctagaataacaggtaatcaagcatgcatatcacacattttatcctataaatgatggacctcaagcatgatttcaagatagagtgaattcacattgaaaacctaaaaacgggctagtgcaatttacggatactaaaaaaagtaggaatgtccactcttacgtgagtgaaaatgtcaccaaatggatgactcccagagaagtcatctgggccaccacctgacgcttggcgctcagaaaatccagtagaacaatcgatcgcaaatcgaaaatgacaaatcacatattcactatttatgtcagtagtaaggaaggcaccatttggcattgagacagattatcatagtcctgtttggtgcaactgcttttaaatattattttgttgtttggataactgtttcccttagtttgatttataaaacaaactaccaggaagatagatctatatctctacggaaacttaaaaagcacatgcacagtcacagaaaatagttaataacctggtcgtatgtttcacgcttatcttcatgcttcaaaacctgagataagcatgacaaaacacaccctttagaataagaatgtccaatggttaatgtaggacaagctaagatggtgcccaaacaaagaaaccaaaaacatgttcaatgtaggacaaactaaaaatactctgttacttccttgtttcaggcttccattttaatttatgagtttccagatggatgttacatgcagcttgcactcatgcggttaggtctgcctagcgatggaactccgcccaccagatctatgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaattagcatgcaaaaaacatcttaatggactgaataatatgcacataaataaaccgatgaaaaaaactcacatgatcttgttaacgatgttggtgtgatgcccccaatattgttatccatatcttaatttagtgttagccagctgaacaatcctaacagcatgcttcacatcgagagttaaaacttgtttctgtaaatcagaagaaaaattcaaaagtaaactaatgagagtgaaaataaattattctgaacttaactctgaaaacagcttagaaaagctgatgatattcgcaacatcatgttccttttgaataaaaagtatgaactccaagcagctattatatctgtttattccatcgattaaagatactttccattaggaaaaagatatattagctgcacatttcgtagaacacatgaatgcttgcaggtatatattagctgcacatttcgtagaactcatgaatgcttggaggtactctccatgcattggttatgtatatgtgtgtttctggtgataacctaaattagttacagattacaccttcagccaacatttagcttgtacaagtccaactcaagatcaacttctatattgaggcataaataaggaactctcaatttattgaggataaattatgaatacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactatatacttattaagccgtaaggctgcactatcaggtcacttattgctattttttgggtttttaaaaaaaaatcatcatacacatggagggtctatatccttataactatgtgaatttggaatgtgagtcttatcctacaaattattggaagcatacactaataaaccattttatttgcactgtgcctcaactctgtagccaagttaaacacagaagtatttaatacagtaatgaccttttcaattcagagctttgaggcaaccttctgccacggcggggtgatcggttgctgctcggcgcggggtcgtgtcgtcgggggccagctcccatgatccagtggcgactgcagagggcgaggagggaggagaggcagtgtggggtcgcgttgttgggggccagctgccgcgatccggtggtgggcgaggagggagggaggcgcaggcggagatgggggtgggggcacggtcggagaggggcggcagcggggtgaccgtctgctgctcggcgcagggtcgcgtcgtcgggtgctagctcccgcaatccggcggtggttgcggatggcgaggagtgaggggaggcagacgcgtcgtcgggggccggtgtcgcgatccggtggtacacgaggagggagggaggcgtcggcggcgctggggtcgcgggcggaggggcggcgcaaggggtgggtgcgcgggcgcgattgcgctggggaatcgggagcgagcgggggcagcggcgaagggagcggggagagcagttgggaagaggggcgcgatagagggagccgaaaggggagagggcgcgcgtctgaagcgttgattttgcaggaggatcctagaagcaatcttagcccttgaattatccaggactcaccaccaccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatagacggtgcagcttgacattcaccgagggcttgaggaggtcgtggtggagagaaatgggaaaaaaagagaagacgatgaatctgacaggtgggcccacgtgcagatgaggaagaagactgaaaacatgacgtcgatagtatggttcccattttgtaaaatttaagtggcacggttacgaataaatgaattataatgatatttatctgaatagacacatttgtaatgacacggatcaaattaacccttttcagtttgagctagagactcaagtctttttttctcaaaaattatgtgtattattccatgtaggtcctttttccacatgagttttgttgtgcgtcctctgttttgcctatacaaattaggcattacttttgcactttttaaaaccgagacttttaagcacatataggggccagttttagacaaaaactggtacatatagtattagtatttttttaaaaataatacctataatatattatagctggtgttttttttaaaaaaaataaccaacatatgtaccactacgagccaagcttgccacgtggggagcaaaaaaaaaatgttgtgttgtgtgcgagccaaatatctcagcttctccctcacctaattcgctccctctctataggtctccctctccctctcccgatccccacttttccagctctccctctccaccgatgcctctcattggcagccaacggttcgccttggccccctccctggtgcaaggcggccagtggcccatctctccccagccccctaatttagatttggggattttaatttggatttgggacagcgaggagcaattcgatccatcggtttgattcgagccgatttttttttacctcgcgtgcatcacaaaggtgtcgatggtggaactgacattaatgacttggagtcatctgttccacctctgtggtgccggttgggaaatccggcacctacgaaggtgtcccaaccatcaccgatggcactttctgtggtagtagtgtggctatttgggaaatcatgatgttatatcatgcaagtatttacaatttacatggtgaacacgcattgaaatgcgttcaccccagttcattcatcagtcgggagaaaataacttcaagcattcatgcatgtagaaaataactgccatatactcgagacatatctacatcagtatgcacctttcactttacatagctaggcttagtgcttttttagcatttttcattgttttttattagaaaacagtttcgaatatgcgtaatttactagtcttaggaagcatcgggaatataaggtcaacgatcatcgtcctcatgatagaaattatggtagacacgtgtaaaaaaatatacatgtcggaacatgagagtttggttgttctgtgggacaggacacatcagcaccttatgtttagattcttgacttacacctgccggtggaatattggtggtaccttccaccatggtgcatcaagatgcaagatgtggacaaatatggcatttgcatagtttgcttaagaaccagaggcagatttaaaagtcactaggaatatggtagatgtgcttcctttattagtccttccttgaatactagctttactttgtggtttcttctcttttcttcgaccatcacatttgtttctctatgacatgattagtaagcatcaggaacgaaaggtcaaccttctcagtgaacgctcgatatcaatcattgcacacatattggagatgaccaggatttccttaggtgaattctggcaaggaggaatgatcacacacataaccccagcttcaaccgatggaagaagacccgaaacacaaccaatgtaaatactaatgtaaatcaaccgtgtgtacatttaatcatactactagaatactaacactacgtgcaggggttgaggcaagatttcaccgagagtaggaccaagctatgctgtttcaaaattttcaccgagtttctatctaaattttggtatatattttgccattgaaattctttgtcacgtgtggggcccaagcccaagctgcctcacacgtggcttcgtccctgactacttagtggaatgtactgtaaaagctcccacaatccttaaaacaagagataataccttctaatagcttagagcttcagtgtacaactcgaggttgggctgtggcggtgcagttgggctagtagcaaagcaaggtcgagggttgggtgaagcatcgctcgcacaaacgcatctagctagctaccgttccgacaccacttgtggaaggagctcatgtgcatagggatcccacatgcatgcctttcactttttctgtgatattttcattcccgagtaagatgtgttcgctcttcaagctcacgccacgcatttttggcccaactaattaagcagcgtattgcccccaaaaaactggattgttctcctgtctaaacctgcgttgaatcaatataccaaaatgagtagggcactacgttcgcttgctagatggtgcaaagacagaatcgaaggtgaaattgttaagaaaaaatggagagagatgagtagaaataaccaccgagagaaagtcttcctaaaagctggtaacaaatacttcctctgttttaacatttgagcaaatttatagaaaaatataataaaatttgcaacacaaaacacacattgtcacttatatgggcctgggggtacctggctagggaaaagggaagcccttcctgtgcgacgcgcccagcaggcccaacgcccctcggaggaacgcgcgttcggccacgaagcggccgccctccccccccccccccccccgcggggggcttggggtaccttgtcatacccctcgggcccgaggggctgaaccgcccccaaggccctcgctcggccgccacgtggcagccatgtggggacttgagcgggcgagagcgccgtccaccaggcgcatttatgggcagcgctccaaccgccccagtcgcatttaatgcaacgtggcaggtcgtgcgccgcccactgatggacgtgcgccgggcgaccactttttgactggtccgtgacccggcgatggatggatgggacaggcggcagcacacccacgtcccacttcatgtcagacggcgtgggggccggtatgtcccgtcccatcatgtgcagggaaaggacgtgcaggtcgccacctcccacgcgtgtgtgcccacgaagtcgccaagcatttaatagggaatgacgggggacgtcccccgtgtcaggcgaaagacttcggtgggggccacccaaaggtagcatggatcgcttccagcccaaggcatgggacgcttttttgtataggcagtgtgggcccctcttttaagaggagagcgtaggggcagtgtatatggtatcccctttatctataaaaggaggatctcgccctgcgagcaaggggacgactcctggtagactagattttggttagaagctgtccaagccctaatttgtacgcccaggatccgaactctctgtaaccacgcgaagatcattacacacacaaaagtagggtattatgctccatagcggcctaaacctgtataatctccctctctcatttcctcgccatccacctcgcaagcctaatccccgcggatccgcctcgctttcgcgaggatacgtccctaagcattgtgcctggtcccctagccgaactcacaaaggggggcctcacaatctcccgctagacagtatcaccctctgacacacatgttatcaaaatacattcactgttcaatttaataaaactaatttggtgtgtgtatgttgctattttttttttataaaccttgtcaaacctaaagatgtttcaacaaaaaaaaggtaaaaacgacttgtaatatgaaactgagaaagtaacaacaacattatccattaaaaaatgtattgaatgtgagtatcaattatgaggagattactatggggttaaatacactaggattcaatttgtgaaactcaataggaggctgcgatagttaaactaggtgaaaccccgcccattgctatgggagtttactatgataataataaatagaaataatgtgtaagatagctagacgacagaaacttgcatatagtgatgtggtttatgataatttaaataatatagaatgatgatccaaatgtaaaagtaatatcatgtgactttatgatagaagaaaatgagggagaatataattccgaccatagattaatcatttgatggctaaaaacaatttgaggtgatatggcttaatgagagaagagagaaataacattgactaagtgaggatgaattgtataggtatatagatattaaacaaaatgatggagagatatattgaaatattttgagaattatttggaatgatgatttgacatgcttggattttaaaagctctaaaatttaagtgagggtgaactgtataggcatatagaatattataaaaagtgatggagagatatattgaaatattatgtgaattatgcgtaatgataattcaattaacatgcttgcaatttaaagctctaaaacttaataaattagcatgcttgcatgaggtttgagatgcaataattgttaatggatgatgtggcatctttgcatgttgaagtttaggatttagtgtaccttaacattatagaaagataggatatgtgaaccagcatgtacgtaaacatggacatgatagaaatgtcactggtgcatactgcctcaaattagattttcgcgagattcacatatttatctctatatgcatccatgttttatgcttatgtgtaagttaaatttatgccccatccatgtaatcctaaaaataattatatatgtgcctatgcaaatggcattacgtacggggattcccattagctagaaaaatgtaaatgggatggcaataatcatagaaaccatttactatatttcctttgtttccacctacatatataaagtcatcatcttgactgtactcatctcctcacagtggttacatatagtcatcttattgggcgcccttctctatatcgtatggattgatgttccatccaccagccagtattgtttcttaggtgcataaagcctagcaagtaggtttaggaggcgatgggaacttacgattcggttcgtgaggcaaatggagtacttttgcaccttatgttcagattgtagactattggtatattggtaccttcctccatagtgcatcaagatgtgtacaagtatggcatttgcatttcgagcataggagcaaaagctaggcaagatgatagctggataggaaaatgggtctggagtggatatcttaatcaagggctatggttacatatcgtttaacgcggaacaatattatgttgctttacggagcattatgtgcatgctattattttttagataaccgcatgttattaaattgtgtgactgtgtacattttgttttgagcctgaactatcccatcttcagtacattcatctgacaaaaaaaaaagaaaagaggagcggatcggacaataaatttatccagcactagtattacagaaaactagaagaaaacatattacaatacaacatgcaaagcactaggaaccattttgggagtataagatttactctgtgcgcaccactatacacatgcagtgtcctgcgcaaaaccttgttcctcttctaccggtgttcagtaatcagtaggcttgtttaagttgtttatttgcttagtactgtacaccctattttttatgtgatacgtggtaagtttagatagtattcagaatacatggaagacttaaatctcagtgcagagaatcaggtgcatgtgcacagtctttaaaagaaagtgtgagtttcataaaacctattaggctgtgctcgggaggtgaggttgggaactcacctctcgcgcacgcaaaatagagtgacgtattttcttgtgattaattaagtacttttttgaaaaatagattaatatggttttttataaaacaacattcgtatagaatttttttttgaaaaaaaacgtatcgtttagtagtttgaaaagcgtacgcacggaaaacgagggaagtgatctagattgaaaagttggggaaagaactcagtctcagtccttttatgaagtatgaacgctagctcactttgtagtttcttcttccttggatcatcagatttctttaattttatggggtatccgctctgtcagagaaaatggaaggagaaactaatgagcagaaataacaaggaaaagatagcctatgtaaagcctggcaacaagcactactaaaaaaaggggcataggtgccggttggaa

SEQ ID NO: 81013 - DNA, 24872 bp, Oryza sativa
cttgttttgactctacggaggagggaaaagcattataggtgccagtttagctgttccggcacctatagtgccgatctctatgaggttttttttttactagtgaagagcattatccataaaaaaaaatctgtattgagtagttcaaaataaacttttattccaatgattacatggctatggggttaaacacaccgggcttcaatttgtgaaactcaatcagtagaggacatggttaaatatgtgaattatacttgattccaatacttgaagtgccaatgtcactggtgcgtactgattcaaactggatttttctgagattcacatatttatctatggcatccaagttttatttatgtcttacatgcctatcatcctaaaagttgttatcatatataaaaaccatttagtacttcctttgtttcagcctgcatatatgaagtcatcacgacattggtcatcatgacattaattcactactggagaaaccatctttggtcgatcagccaaatttcacaatagttccggttctaataaaaaccgggactaaaaaatatctttaggaccggtttaaaagctcaggagtacttctgatctttagtcctggttcaaaaaatggtaggcagtgtcagacccctatattttctttaatcccggttggtgatctatttttagtcctgcttagtaacaccacccgggaaaaagatcagcatacacggagatcgaggcttgtgcgtggatcgaatcgagataactatctcctcctccctcccagctctacttctatctcctttcctcctctcctcacttacaccctatctcttcctctccttctcctcccccctcccccctcctccccacttctggcacgcggcggcggccgggtggcggagggccgggcggccggcgcggagggcagcgcagctggcggcggccggcagccggcggaaagcagtggcctgcacggcagggcgcggccggttgcgccttgtgttgttttttttctagaatttgtggtttggatctgagatatatttgatttgtgtgtgatgtgaatatgtgacgtttttgtaatgaattttgtagaacttgtgatgtatctttttaagattttgtgatgtacctggagatgaacgatttgaggatttggaggtgattatcgatttgggattttactattcggggaggattgatttgggatttcacgatttggggacgggggatggagtgaaatcaatatactaaaaacaatgaagaaaataaaaaaaataaaggactaactagaccttgcctgggactaaatctttagtcccgggactaaaaatggatttttactccgggttatttcaaccagtctttagtcctagatttgtagtcccgattggaaatccaggactatatagggttatcaaccgggagtaaaaagcatttctccacaagtgattgcttacatatagtcattggcactactacgaaaaccatttttcgtggcggccattttggatttttgttggcggaatttgcagccaccacaaagcaaaggccagtgaatatcaagatcttcgctagcggttattgacagccagcaaaaattcattttcgctggcggtcatcttaagccagccgccagcaaaaatacattttcgctggcgttggcttaagacggccggcagcgaaaatccattttcgctggcggctgtgttaaatcagccgcctgcgaaaatggattttgggaaaaaaaaaacacgcatgcagctgccagccgtcagcgaaaatacccatgctgccgcccattgattcattaatttcaaatttcaaatccacatctagattcgctgctcatttccaaattcaaacacgaaatacaaaatcatcattagcacagatcaaacatcatttacacaatcaaacatgatttacacagatccaaacatgtgcatcatctggaacaacatgcaaaaagaaaaagaaaaaaaatcaaatctagctgaaggcggagcaaggtcgacggtggcggatccggcctccccgctgcccagcggcggcggatcccgccaccccacggcctggcggcggcggatccgcctcctagcggcctggccgctgcggatcctgcctccccgcagtccgccggactccccgcgggctgccgcccgctcctgagcgccgccgcgcccgcgcccgagctcgccgcgccacctcccgccaccgtcgcccacccgcctaccgtcgccgccgcgcacccgcctcgcgtcgtcgtcggtggagaagagagggaggagagagggagagaagggaggggagctggagagagggggcgggtgggtggtggactggtggtggtggtggtgggccgcgtggtcaatattaatagatggtggtccatctatgcaagcggtccttctaccgccagcgaaaatctggcggttgcttaagtgggccgccagaaaaaataattgtattttccctaccggtctgtatgacacaaccgccagcgaaaattatctatctttgctggcggcgcacctaagtgaccatcagcgaaaatagacatatcttcgctggcggctggtataatgcgaccgccagcgaagatccattttcgctggcggtcggtgtcctttaccccctcgttacaattttgctggtagttttggcatttctccgccagcgaaaattataaaccaatgccatgaaaaatcgtttttctagtagtgtggtctttctctacgtctacaagtatggatgttgcatccacctgctagagttggttcctaggtgcataaagcctagcatgtaggtgatgagaacttaggattcagtaactgtcacatcggattgttgaatactttctctgaccagtagagcactgtgtgggagtgcatgcgagaggtgacggcttagtatgacataattcagatgacaacgcttcggcaagcaacgatggctctaacttatagagaaaggggtatcagcgtacaactgcagttggctgtgatgcaaagatagatccttgcatcctaatgtggctgtgttttttttttcttttgcacctatgtatcggacaacaataaggttatagcgataatcagataaaaatttctccaaccttcacatacaaaacttgtgactagtatataaccactctgttaagtgatctctaaaagcaacctattgataaaaaaaccggctgatgctaaattgaacatttgtactgtgaatgccattgaaactatctaggaacatgatattagatgatcacaggcaaggaaacaagttgcaaccgcaacaccaatcacagcagaatattcatggccatcataaaatttgttcaacttgtgtgtcatttatttgagcctttataagctaccgacgattcacctaccactaataatagtctcatttgtccgaccatactccctacatttacataacatacattatttcttttatttttcctataatgtttatagtgtaagattttaataatttatatcattccttttagaaaatgatttttaactcgaggtgaatttatcggggcgtgacagaactcacctatatgttctctcttttttgcatgagtgatctgctaccctgctcccaatactaatatatgcatgcatctcagtattcttgatccaaatccatctcacaatgtcttttgctaatatggataagtaaatttacaactataggctgttgtccgtgcatttgtttgcaagtcttgtttcttagtcgtatacatatagtaaagtatccaaacataagttctagaccaaagataatattttgtctttgacctttatgtatggagagtgggttcgtagagatgtcttccaaattctgctagccaggtgaggagcacaatatatgtcagatttcaacccttggagatactgcacacttagggttctacaatggaatttgaaattccttaattagtgcaaaactgtgaattactacattattccagtgatatcttagttagacattggagatggatatcttaggggctggaggagtaacgtgggatagactgtatagtaggtaagaatactacatgcatgatgtggcacttcaaagcagaaacactactagaaaaggcattttctccgacattggatctttttctttttgcgggcgggtatggccatcggagcgaaaaccccgccggcgaaaatgagtatagggaggagttggaagtccgcctgcaaagataggttatcgcaggcggaccacataaggcaccacctgcgaaaatgatctgacggtctgactgggtgactctgtgagatagtcggtttcgtgttgttttcttgaaatttctagattgcttcatgtttacgacttctagatggtttctatccgtatgtgatactattgtgtgctgatttgagtcaagttcgtgcgaacttgtacttagatatggagtttctttgttgttaatgtgcaggtgttattttaggccatgggagtatagccggtgatggatctaggctaggctttattcttgtgtttgatcctattaaatggtattagagccatgcttgctctttttaatcttttccgattacgagattttgtgacaagcctactagtatgtctccttcgtcgtcttgtggttgtttgggtgataataataggaaccctaaacttctgaagaacaaaaagtattcatcgatcaagcatgctctaattcacgaggtgttggataattttgataatgacaatgatcatatacttttagttgattttctctcaaatcaaggtaagtcttgtgacatttgtgatttattgcttgaggagaataagtggttgaagaatgtagtaaaatgtttagaatatcaagttgaattcttatcaaaacattgttcacatttcaagaattcttgtgttgatttgaccgttcagaataatttcaattattgctttaaatgatgaactataatattctatttcatgtttaacttttgaaattgatgttttaaagtgcaatgcttctatgccatgtgaatcttgtgttgctttgcaagatgagctattgagcttgctagtgctagaagtaagataagtgatctcaagtctttagatgaaatacactctgattcttgcactaacttggctgttgaaaatgagaagataaatttggcttatgcttcatattttgatcaattagaaaagattagagctgaaattgatgagtttaaagcgtagctttgctgcagattatgatacaaagatagtttgattttcattgtagaacttctaagaacaatttcaagtatattttaaatttatcttcatgatagctaggtgccaggagtgatgaagagaagcactaaattaaattacataatcaaattctaaattttggaatcggctttatagattataatccaaacttacctcattagagcgtataaagtctggatgacatcttgtctcaaactctcaatggcatttgatcagtacatatgtatgacacaaagtctttcaatttacacagtcttctagtatttgtattagccattggttttggatgtcataacgtagtcttaggaggcatagggaatgtaaggtgaacaatattgggattgtcatgatagaatctgtcagaagaatgtacaaaacaatacatctaatctagtgagactcgagagctttggatattcggcatatatatgatgcgataaaattggcatctgtcatatgtatgtttagcattagaactagaggcagatcatggaaggttagagagcacaagagacgatggtgcaggtcaggatattggccgatgaaggcgatgtttttggctggatcaagctagtttatgttacattgttcaacggggaatatgaggtgatggacttgacaaatagcggtgaaaaaactcacctcgattggtgacggtgttacatttgaagtaaaaaaacagagaggtcggatgtggaaccaataatcattttgattcaactggcagccaacgccataacatttgtatctgattctagttatttgattttcaagccattactttggacaaaaatggagtgttaaataaaaccttggatggccattcaatccaaacatcaacaattctcttttggaatataatgttgctttactgagcattatattcatgtgattcgtttgtctgtgtgtacattttgctttgagccacaattcttcctttttcagttcattcatgaacccaaaaaaagagagcagctagtggacaattaatttatctggtactagtatttctgaaaactgtgtttttccataagaaacatattactgtacaccatgcaaagcatacgtgactctgttatacttgagttgaaattttgtgatgttcatagatctatctcccttctcttatgtccatgtgtgttatgcctatttaagaggaatgactcacagaagtttagatgtgggataatgtgtatgtgcttatgcgtcttctctctaatctcaaaaaatagctacattgatggcaaatattgaaaccatttattttatttttctattttggcctacatagagccagcaagactttgctcgtcttctcccattgctcacaaagtcatctcattgctctactctaagcctacaagaatgtctgttctatttaggcttaggcttaggaggcaacggggatttagatatcagagaatgaagaagataaagtattgaactgttatgtattttctctccatgccaatggtggcaatgtgtgagaggcatgaaaaattggcatttgcgcaaataagaaagcctccgtggacaatatcggctatatcagtcaagtgttgcccgatgggagcagacaaacacatcatttttttaaataaattgtcctttaattcctaattcaatctaaatgtgtgcatcacacggtgcagaggcttcatatattcatatatatgaacttagtgcgcgtaggaggcatcagagaaatttagattagaggggtatgttagtatcagattatagcatttgctacagatgccccccaactctcctacagctatggggcagtggatgatggttcacctgaccagaagcaaagtaggagaaggatggaaagctagttatcaaagatagttgtgttttggggtacaacgatgaaatatcagttctccggtagtgctagcacggagtcctttacggttcttgcctgctattagggtacttccaacaaatgtaagaaagtaactattttcctcctaaaatttgatggtaaaatgtaagaaaggttggattattctctcaaatgaagaattccgctccaatctgctgttttattgtgggacaaaccatcttcatgtctcttatgtgtggaggcaaatttccaaggttccgatattaggaacaaagtcagaagacgactgagacgtactggccatttgggaaatcacgatgttatatcatgatgttatatcatgcaagtatttacatggtgaacatgcattttgttatgttgaataactgtaatacgtttcattgatcaagtttcttgctagtttgttcatcacgtactggaaagaaaacagaaattcagtcatttactttggccagtactaagtccaaactcaagaatcgttatcttttgttgtgacatctcatacattagttagagattgatatctttgcaaaacttaggtgtattggcaggaatcttatacgttgtgtgcactatgatgcagaaaaaatagttgtaaaacatttttctattataacaactaggaagatagcccacgcttagcgcgggcatgggtcgtatgctaagattgagacgcttataagatgaaaatattaaccggtgaacatctaccacgatttctccgtaaattcttttcatcaacattaatttcttttataattttctaacctattagctttatattatatcatatttaagtaatatcaataaacaattatttataatcttcttcatcatttgaaaagaaggtagacttattttccctagaaaacatgtcaacgaagagtaagtgcaaagtaaaactaaggtatttttctttttttaattgcatatatattatcatggtttcttcgaggattaattgggtgggacatgaagctccactaaatatatgggtttatatagcctaatatgattgatgtgatttgagagccgatccatctatgaacatttaatgtagagtgggtcagaagtaccacgcaagctaatgtgaaagccaaatataattgcacaataatattttaaatgtgatgtaccatgtatacacatttgtttttcttatataagatagctctaactgttagaaataatgattccaccggtttaaagggcataggagtattccagaaatgtagtttaaaaattatggttgttttaatattcaacattactacgaagtaaacgttggttgtgatggaattttcccactcgtgttcatgtcccagaattaaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcactcgcgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtgtcgctcggtgatttgtagtcagtgttcgttatgttctttttttttctattcgtgggaaaaaggctgttggttactccctgtgtcaaaaaatttagatataaatatggacaaattcacatttatccatatcttaactacttataaaaaatagtaactttccaatcgtcacaatatttttttgtccgtcaatccgaccaagcggtaccctctatccacacacacgcaattacatcccatacgatatccaaagaaaaaaaaagagtttgattcaaaatcagctaaaaattaaaccaacagactctgaatcgaacttaataaaatcagctgggatgatccacaggagtgaaagctggaaaccaacggaatcgagcaaatcacaaagcaatacgtaatatctgaccggcgacaagctcatcgtccgaagagagatggcaggtgacggacgaagatggagaggagagacaagctccagcggctcaagacacgccgtcgccgagggcgctccgtcaacccgcaggacatttctgcagccggatccacccatcggaagtagcggatggcgccgctgcggcggattgcggtggggtaggccacaaccgccgccgctcacggtgggcgaggcggcggcgacgctctgtgttaggggcaatctcaccatttcaaaaaatttctcacctgttttgactcgaaatataaaatattgcctccggtgtcctatagccaattacataatttttatagtttccattagccatgtcacgtttttacggtgtctcccagccaattacacatttttgggtgtcctgtatcaaattttgcttttttttcttataattttaggacatattatatggtgatttatgagcgctctagagcgttttaattgatttttgttaggtatagtgatttagtatcgcataatacatattatgttcgattaatttttcgttgttatttagttgccattcaaacgatagggtctaccatcaaataatgtattttaactttttatagtaaaatatagctaatgttatcttgatttatttatttaattataaataaaacaatagttatattatgttagttaaaaaaaagaagaggagataattgaattggtgaggagaggatggatgagtcatctttttttttgctttatcatcttttatcgttagtagatgtttttttttcttccgcctaacagtgggaagctttatttgtttttttttcaattatacttacgtacggacatttagttttatttccttttcccagccaccagttgcatattttttaggaaaaactatcacctttttaataatagatctaatctaatgttctaaattaacgggtccatcaatttaagtgaaaatcgacggtgagattagatagtgccacatggcaatccacatggcggtccaggagtgtttgtagaagcgccacttggcgactcgagagcgtttataggaagtttaatgtacttttagtatataatagaatagaatggatagataagtaagagcaatggcttgcagatcactctaaaaatactaataacctggactagaaacaatagagcaatggccgcagccacaactacaaactctgcgtgtcctgtggaaattatttcctaaattataacctggacctcattagagtgatatttattaaggttaattggattcatgccactgcaaatatgccgattcacaaagatgccaataaaattcgtctattcatatctatgccattgaaattcacataaaattagaaccatgccatcaccgtcacattttccgtcactgccgtctagttttccgtcacattttctttcttcaattccttcttcccttttcttcccctatttggtgggtggcagggacagaagtggtgcgtggtcgacggggaggaccatcctgcagcggtgtctgtcgccccaccaagcacgacgcgggcaagccaagccggcatgctggactgacgatatcatgctgtgagcattggccatgccgtgcaggtgcactgggctgagccaatccggccacgccaaagccgcggaagcgcctcgccggctccggcgtgtgggcacagcagccaaataagaacagaagaaaaatagaaaaaaggaagcaaacagcatcgcctgtgtctcaccgcctgcgctacgtcaacggcaaacaaggaagagcaagaagaagaagaagaagaagagaaaaaggaaagcagcgacggccgtgcctgtggaagccgcaacgacgacgccgagctcgcccaccaagcaatgcccgaacctccgagcagctcgcattttggtccgcaccggctgcatgctcggtcacgccatcccgcaccgggatatatgcccgttgctccgtcgtcggttcccatcttagatgggtcatgccaccgccggtgttgagtgaggggatggcatgggcggcggcgaggggtggtgagcggcaggacgacaaggccgtacctggggggtcaatgaggatgctgcccactctggtggtggattggaaggagagagaagagagagaacgtcaataagagagagaaaggggataataagatagaaattgacagtgatgacagaaaactgtacagcagtgccatgtttatgatttcataaaattttactaacatctagccgatatcgcgaatagtaatggtatttttctaatatggtaaatttgtaatagcatgtataaagtctgaatgacatctattctcaatctctcaattgtatatgctctagacattaagacatatgtacaacacagagtctttcactttacatggctacgcctggagcctttgtgaattttccattatttctatcagacaccggtcttggatgtgcataacatagtcttaggaggcatagggaatgtaagctcaacgatcttgggattgccataataaaacctaccaaggggatgtacaaaacaattatctagtgagactacttgagagtttggatgtccagcatgtgataatgcaacaatagtgagttttatgtgtgtttagcataagaactatatgcaaattttggaaggttggagagcacaagcgataagcagggagggcaggatatataggctgatgtgggtgaaatttgtcgctagatgaaggctttaggttacattgttcaacgagagtaggaggtggtggaggtgacctgatatgaatagtggtgagaaagctcaatttgattgtcaaatgtggtatgtggagtaagcaaaatagaggttggttgtgcaaccgcgatcattttggctcaaccgccaaccaaatgcaacagtaacatttgtgtcgatctgattctagttatgtgattttggagccaatactttggagaaaagatgagtattaaaaaaaactttgcatgcacattcaatctgacgtcaacatttcgcttttggaatataatgttgctttactgagcattatatttgtgtgaatcgtttgtgttattgtgtacattttgctttgagcctaaattcttccgttttagttcattgatgaaccccaaaaaagagagcagctactggacaattaatttatcaagtactagtattacggaactgctattttcaaacatattactgtataccatgctaagcatacgtgcctctgttatactagagttgaaagtttgtgatgttcatagatctacctcccatctctgatgtccatgtaaaccgggactaacgtggttttgcaccacccagcaaagatcagttctccggtagcgatgtgtgttatacctattttaagagggatgactcacagaagtttagatgtgtgataatgtatgagcttatgcgtcttccctgtaatctcaaaaaaacagctatattgatggcaaatattgaaaccatttattttatttttctattttggcctacgtaaagccaacaagactttgctcgtcttctcccgttgctcacaatgtctgttctatttagccttaggcttaggaggcaacgggaatttaggcatcatagaaggaaaaagatgagaacttaactgtaatgtattttctcttcatatccttatggaccttatccctgtcaaacaatggtggcaatgtgtgagaggcacgaaataattggcacttacacaaataagaaagctgccgtggataacataacacctcgatcactagaagaaagtattggctatatctgtcaagtgttgcccgacgggaacaagacaaacacattatttttttaaaataaattgtactctaattcataattcaatcaaaatgtgtgcatcaaatggtgcagaggcttgatataaacttagtgcgcctaggaggcatcacagagatttccattagattagaggggtctgttagtatcagattacaacatttgctgcagatgcccccaccagtacaaaaagggtttttctagacggacctaaacctatgtttgcatgtggaagcctggcctgtcaggccaaaatggtctgcgaaaatccaatttttacgtacgggtaacgcacctgcacacgaaaatcagattttcgcgtgcgggttatgtcaacggcacaaaaaaataaaatttcaaaaaattcaaaaccctagcaatcctagcggtggcgacggcggataggtccatcgtggggccggcggcgccactcccagccgcctcgtcgtccttgtccgatattctattcaagttgatacaagctttgcctatcatatatattgattctatctttaattgcatcattgtttagagtcgtatgggctaagttagaactttttcagttaggttgatattctaactaagttggtatttctctactgttgttttagattgatcaatatatccatcacgtctatgtagatatatcggctaaatatgtttttctcattatcgtcaatttttcgtttaggtccgatctattagattattgctaataagttttatattagtaagccgataggtttttctgcaatgtttcatcgttcatcgggatgtatcagctaactaggcaatatatatgtgaatctacttgcatcagatctctagcaaatgtatgcttttaccttcggacttacacttaccacactatatcagtattagctaactagtttattggttcagttctttctattattcttgttagtagcaggatcaaactaactggcacgtccaaacctcatcaagatttagggcctatactggagctaagcagatgtctcgggccttcgattgttgtgacgcattgtccatcaacgatacgaaagggggtgtggagttggtagctatatcaaggttttttttttagaatttgatcaagggttattgttacattgtttaaggacggataactttatgttgcttttcctgagcattacgcatatttgtgtgattgtgtacattttgtttcgtgcctgaactgttccatcttcagctcattcatcagcaaaaaaaaaaagagcaaacaatagatttatgaaggatcaatattacagaagattaatttccaaaaaaaaaaatcaactgtacactacgcaaagaactagttaccagtgtgtgcattgagggtggggggttacaagatacactctctataaaaaaaatcaacttcttaggattaacctagaaatatacttgtcgagatttgttcctagaaattctttttttttaagacagagggggtgactttatgtgcacatagccttttaatgaaagtgcgagttctataaaacctgttgacatcactaacacataacctcaacccttttttttacaggatgggatgttctttgtctttagcaacacaacaatttattgtgtgcttgtgtatatatgcatatctctgctggttgctacaactacaatgtccatggccagattagtccttcctcgaagactagcctagtttgtactttcttctcttttcttagaccattagatttctttgatttatggggtatcctctctatgataggtttagtaggcatcaggaacgctgggttgagctcggaagtgaatgcttgatatcaatcattcctcacaggttggagatgactataatttctttaggtgaattctgacgaggcgaatgatcacatatcaccctcgcttcaaccgatggaaagaagagctgaagctaaaccaacacgaaaaaatggggccttcaatatttcagcggaaccccaaccaacacgatgggtgtggatcccctggagttacatccaaatccactgggtggatttcactaaacccaagccgtccctttaatttcgatggctttgtttaagccatctcttcttccaccatagttatcttgtagagtctattttcttttaaaaaaaatattgtacagcttataaaaaacattatctcgtagagaacatgttatcttcgaattttctaacatcaattagagaagaacaaacaagacacgaacattgcaccgacaaaagcttgaggatgaattagttcaatgagggcctcgatgccgttaatttcataatagctcggttaagaaaagtttacagataatttcctatccagaatgctcttccgagacgctagatccaaatggacagacttcgcaagaaaaaataaaaagagaaaagaactggctatttctgtcgtaaatgtgtaactaggaagaggtgacatggccacatctagcttgtagaaacaaagtaaggggtcagatcggcccaaatccaccagggtggagttggaaggcaactccagggggtctacgccccaacgtacctattgtttacacttctgtctacattttttttcttttgatgtgcacaataaagtagtaggaacttagacttgagggcatcgagaatttaatgttgagtttatcctctccatcgctatatataagattttggtacaaatatgctaggccatttatctggttaagtatgtattatcctaatgagaataatggaccattaagaactgatggggcagagtcagagtcaatgctacttgaatcaccagagcggagtatgaccttgcattttattcccctaaatgaaatccgcacagtggaaatctaaggcctttcacagtgctcctacgtggagcattacctccttgtgtcagctaggaaagcgccgacgtgtcgagccggaccacgtcctacctgagtcgcttgcccccacacaagcagacgcgattctcgctcgcgcgagatcacacgcggcggagagaacacctggatcctgcgctgtagagggcatgcctccgacttgccgtcccttcgggccctcccgctcctgtgccgctaacctcatcaccgtctctcgctccgcgtcaccaacctcgtcgtcgtccccgcgctccgaagacaccgctgccatggccccgaagatgccgctgtttgccagagacggccccaaggacgtcgccgccactcggcgttggggcgggcggcgcttcccggagacgagcacggggatgccgtcgccgcttcactccggatccacgcaccgccgccgtcgacggtcagtcttctcatcaccggccaagagaggagggacgaggcggattggggaagaagtgccgcggcggatttgggggagaagcggcgcagtggatggcgaggagaagcggccggcggatttggggggagaagcgcgcggtggatggggaggagaagtagcagattttttttttcatttgtgcgtgaggataaaaacgaaggggtaggtggctgtggggtcaaggattcttttgttgggtcacgagcacagtgaggtgcgtggctttcgggccaatttcatcgcagaaatgggccagaggcacgcatagcatgccttgcactgccactgccctaagcatgacttaacataaccaactgagaaatgttagtgccaagagtgtcgaggaattaatggtgagaagaaagtacacaacataaagcggttctttagaatgactctgcttcttctacttattgagaatggtgccaagactatgcatgactctgttggtctctagttctaaaatgttcatggcctctttatccctttcaaggctacttagctacattgtttcgtctattttctcttttcttggatgaatctattggcatttgagcatgtctcatggcctattagatttctttcttaagtgctatcatagtattataataggcttagtaggtatcaggaatagaagaccgagcacattcaggcatggtaggatcaaactctggtacaattgttcaacatggaaaccactgtctcaggcaaagtctatatgtttctccagaagacgagaatgggtattagaagatgttcaacagctaaagaacttaagaacacaaagacaggacagtattgagggattaattgggcaggttttttttactgtattgtacagcaacaatgcagctaagtatgctgatggtagtcctgccagtaagagttagcagccttttttatggccatcatggaactcacctatacatttggcttgagcgatctcccaccctgctcctgatactaacatgcgtctcagtgttcttgatttaaatccatttcactgtgtatttttacgcacatgtgcacaaaaatttcaattttacatgtataggctattattcgggcatttgtttacaagtcttgtttcttagttgtacatatagtataagtaggcttgggatgtcttggatacaaacataaattatattcaaagacaatatttgggtttacactcttatacaatatttgagagatttgaatgctggaataacgtgtgataggctgataggtagcaattctacataatatggcacttcaatgcagaaaactcacatagacaacagtaatgctaaaatattttcctgttattaaacaaaagaatcttatgcacaacgaatactcacatagacaacagcaatagttgtaagagaataacaattcaatgtgattatcaagatgccaaagccttttgtttgttgcttgagagaaaaaaggtccagactctcaattgatcgcagcagaaaacaatattaggacgaggtagtgagattttatttaagataatagattgaaaccaagcctctacgttaacaagggtgtatacagccacaagtattcccaagcacaagaactcggtccttaccctcatgttcagagccgaaaggcacacaaagggtcaagcatcttacaaagtactgaaaggagcacaaaggctccaatacctttcaaggcaaacagatgaaccaaactaaaaccgcgaccaaatacaaattacttttttctcctctttcctagattgcaaccaactttagcaaacaattgcataaccaccatctccaacaatttgcaatcttccatcatcacaacaccatcctcttcttttaacaacagtacagattaagacagtcatttttctttcaaatcttcgtgttactttatatattacatcattgatgaagcaaattgtgtcagttctagttacagatgaatgtgttgcaacaataaaaataatcgtcatttattatattttctagtgcaatactcctatcacgctaaatattgattaggtcaaggattcacttacagaagtgttcatatatagctgtcatgtacccctgcttagctttgctgctgattataatccaaaaatattattctgattttcacagcttgctttgaagaataactttaggtagtttttttttactttccttcgtggaaagagaaccggtcaaagaaagtaatgaagaaagagctcaaattaaattatggatataactaaattataaatttgaaaatgagcttcgaattatgatctggatctcactcgagctatctattgtttacatatatatagtctggatgacatcaagtctggagctctcaattgtcatatgctctgaacacatgtatgacagagttagtctctcactttacttgctttggcctagagcctcttagagtttccttgtttctattagacattagccattggaggcatcaggaatgtaatgtctccaataccttgggttcctcgagatagaaactatggaactcatgtgcaaaataatatacctatattgagacttgagagttggattttgtgggcacaccgtacctgcacatcatgttgagattcctgacttgcatcggcgagatcgttagcacctttcaccatggtgcatctagatgtgacaaaagtggcaattgcgtgtttagcttgagaattggaggcagatcttggatggatggagagctagatcatgggttatggttgaagtgaccagatgggagaggggagctgcaggccaacagcgaagaagcacaaatcgagttggtgattgtgacgatccacctgaaatatttggatctaacaggggagaaagaggaagaacaaggaagaacagagacagagttggcttgggagagagacagatagtttctgtgcgtgatggattagttcccaccccacactaacgaacactggagtttttccctgggtgcatgcatcaagtttagtaggcttaggaggctatgggaattcagcctttacattatggatgctttcgagtttcgaattgtcatatactttccctagaaatgattggtcaggaggagcggtgagtataaggcatgtgaggtacggtatgaccggcagtcacgcagacaagtaagttgtcgagtagtaaatgggaaaggataggattaaggtattgcaaatttgttgttgaaagtgaaacacatgcaactcatcttaagaacgtgtggtctatactagacaagtgttccacaatgggaatatgagaagcatgatatttttttaaaaaactatctttaagttctaatttcatagacatatgttcaattgaagtaaattttacagtttgaatccagcccaaatctgaccatatactttattgagaattacaatgacacaaaaagtgttcttgtttggatttgttagttttgtttataacgtaatgttgtagtctttcagttaattcatcgaccacaaagagaaatgctttatgagatgttggcatagattttgcactatggtttatatatatcagcctcacgcatgcacgttcatatcgtttcgtactataatacggggaaatttgcgtagacatgtgttctattgagatgcgtttgtggttgtaatgatcaggttgatgaggattccattaactgcatcatgtgaaatcggttggataagcatctgcatttgcggctacagagaagtgttcgcaattttgtcaattcttttctctcaattcaatccctgaatttcattcagttacatacctagcaaggcgtataatactgcgaatgcatttcatctcgagtgtaaaagtagtaggcttaaaaaaaacccagaattgatgtatgatacattgtctgaaagacagaaagttgccttgaattagattactcaactcatatatattcagaaccagactatgaaatcttggcgataaccggccatttaccattcctaagagagagtgaccggtaaccattaccagcccgaataatttaaatatagcttgatagaatgtctcagggactcaaaggtcccctttttttctccaacgagagttggatcaagattaacattttcgtggcacgtttttcaaactgctaaacggtgcgttttgtgtaaaaactttctatataaaagttgctctaaaatatcatattaatctatttttcaagtttgtaataattaaaactcaatcaatataatcatacgttaataccacctcgttttgtgtaaaaaacttaatcttcatcttcatcttcaggagaaaagaacaccacctttgacggcgtagtattagtatattgattgcctctacaggtaatcgccaatgattaggataaatttaaaatttcatgatcaacagctgatcataaatattcactaggtgattccccgtactttgctgcgggaattactaagcgattcttttttctgatagtcaagctagaagtaaaaaggacaaaaataacgaaacatcagggtttatcagtacttatcgtgaaacaaacaaattttaccatactttaatgtgaaacatattgataagaatatgctaaatattataaaataatagatagatttgttaaaatattgtgcaaatgatgtgaggggtgatgattggatatgcttgcatgttgattcatagaattaagtaaattgtagatgatgttgtatgcttgcatgaggttaaatacgtaatttattctaatggatgattatgtggcatggttgcaggttgagtttttttagttagtgggttataacttaaaatataggtactcaccatcaatatttactgttcctattcattcatcctatccgatgatccctatttataaactcttttgcttttctctttaatttcacctttcaatttttcagctcgattaagatttttagcatatatgtgccttgtgtttctctgacaactatagtgcaatgggcgtaggagttgtcgggattgcaacattcacctctgcgctctatccttcttctgcttgacagtacaaagcataaatatttgacggcatgcatgaaacataattccttgctagtttgcccaccttctccgaacgagttagtattatgtataaattgtctgattaactgacatgccatttaatctctaagttaattaatagttggacaacgtacattaattagtatctttttatgggtaccttatgttgacataattagaggcatgtacaaacgtacagtctgatatggtctcttagttaatacatatcacttagagatcatacttatacaatagttgagacaacaaaacatttgagccattaatgcactaacataattttttattacccttattttcttatattatcaccatacaacaaattttttctttaataaatgctaagagccgactctgagccgttgtcatgcctaacaaaaatgtttcccttttcaccctcttctcttttccatgttatcaagtttatacttgaatgccaacggaaatagcacgttaattaacaccgttgtacatgccctaagcaatcaaccgatggtgtgcctgatcccaaggaccctagaaagcttcgttgcaatgagattcttgtccagctgttgggtggtggggatggtagtggtacatatgtcactgtgtaaagctgtagagatgagaatgctaaggtttttgacctgaaggatgggaggaaggaagaaagtcgttattgtttttgccaagagacccatgttttaatagacgattttgtaaaatcaaaggtgtttttgattattattttctgatgaacaattgggcattgtagattattggttttgttatttggaatttattcacgaagtggtttcggagatgattgggtttcacaggtgaatctacaggttatcattttatgtggtccggtcagactgggctctggtagccggtcagaccggcgcagtccgcggtctgactggccgacactgtgtcggtttcggtttcgggttgtttatttggatatccgagtttatttcatgattatggtttctagatggatactatacgtatgtaatactattgtttgctgctaatgagtcaagttggagatagcttggtctcggaatatggtttctttgtttgttccatgtgtaggtaactcgatgtctcgggagagtatttgcggtgatggaccgggagtcggcttggggataagacgacgtccggggtggtcagagatcatgcgggatacttatgctagagttgatgcacatggttaatggagattccatatggcatacgatggagctattgtgtgcacatgggatgcggagtcaaatttggaaggagtccaaatttggtatgtttggttatgtaaagtttctttcttgtactagagggtttcctaaggtgtttaggactcctagtatgagtttggttcatggctttagactgcctacctcatgtataaatagagggggagcgtgaggcttcccggtatcgcttttcagagcaatagagttgagttttgagttagggttttgagtttagtcgaaatttttgtaaggagtgctgttggtgcactttgtaaacacagagagaatcaataaagtcgtcatccactttaagagttcttcgatttgtgtttcactgggtttcgacggtctaaccggcaactcaccggcggtcagaccggcggcggcgacaggcgcggcaggcgatctcggcggtcagaccggagattcaacaccggtcagaccggcggcatccactcggtcagaccggcagatcaatctcggtcagaccgcgatccgtcaattttgagggtaacatttatttccgctaaaagttttcagtttttgggtataccaaccattcaccccccctctggttggcttagttcttgtgattcgatcctacaagtggtatcagagccttgttttcttctttggatttttattgatctagagtttttgccatggctactcccgctaggttttcaactaagccccatgttttcgatggaacggatttttctcattggtgtagtaggatgcaatcttatattatggctgaagattatgatatttggagaaaagtttctcatgcttatgtgattcttgaagctattaatactgctgctgaaaaaactgtttttgaacaaaattgcaaagctcgcaacattcttttgagtggtatttctcgttcggattctgatcgtgttgctcatcttcaaactactcatgagatttgggttgctttgagcaattttcatcaaggaacaaataacattaaagagcttcgtcgagatctttttaaaaaggagtacattaaatttgagatgaaacctggagaagctttgaatgactatctttctcggtttaataaaattttgattgatcttagatctgttgattcttcttatgatgctaattatccacaatctgagatttctcgtcactttttgaatggtcttgacatgtctatttgggagatgaaagttatatctattcaggagtctgttaacatgtctactttgactttggattcactttatacaaaattgaaaacacatgagatgaatgttctttctcgaaaagctgattctaagtctagtgctttggtttcttcttcctcgtctttggatgttgatgcttcttcatctaagtcttcttttcttgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcgttcgcattgtcctaagcttggggaggcaaaagagaagacaaagatggtgagaagacaaacaacaacaagcccaacaacaacaagtcgaagggttcttaccaagggaggaagatggagaatcttaggaaggcttttcaacaagtttgcgccgccttcgagccactaagtgatgtagatggtgaaagtggagatgatgacaagggaaagaacgtctccgatgtttgcttcatggcgcatggtgaatctgacacagagtatgaagataatgaggtgagtacttttgaggaagctattaatattttgagtgcaaaaaataagaagtgtgagaagatgtatagaaaacaggaatttatcattgaatctcttaaatctgaaattgataggttaaaatctcttattcctaatgatgatgattgtgaaaattgtgaggttttaatgaatgagatttcaaaaattagagatgttaatgctgcacatgatttgaaaaatagatcttctcttgcttgtagttttgctttgcacacactcactttggatgagttgtgtttaactaaaaagttgttgcaaaaat

SEQ ID NO: 81014 - DNA, 28043 bp, Oryza sativa
ctttgaaggtttatttgtctctagcatagcttgtatgtattctgatctttacatgagatttagattttgcttttaagggagatgatgcatgacacttaaattctatacttgaattaagaaaatatgcaatgttgatgctagcatatggtttgatttgtaaatgctctatatatatgctttattgacttgttattcctcaaatagctttaattgctcattgtgaaaaagagaataaaaatatgaaaaaaatgaataccgaatccttggaaacagtcttgacgacaaggacgtattcgatgtgagcaaaataatgggtgccaaatccctagaaacaatcttgacgacagggacgtacccggaataaaagagaaaaatatgagcacaaaggctcaagaaaagaaaaggttataaaaaaaattctcttggttattttgtgctaaagtttatttgagaaagagtgataaatgcaataggtatatgtgtttagtgtttattcttcaacctatgtgcttgttaagatgttgcattctaaatcgtatgaaatcatgaattttgattgttgattcaaacttaattgtaaaatctttggttcatggttatactttaatgcatgcttcttttgttatagatgggttcatcttctttttattgcaacacatgacttgatatgctatatgtatgctaagctcttgaacattaatgaacataattcctatgcttgatgaaatcattgtcaaaatggggagaagtaatgtgaaaatttttggatttttggagaagcaaggtgaatttttggaaagttgttgagtagagcatgtttttggttcaattgggaatttctttcttttaaaaagggggggaagttttcttttggatttttcgaacacttgtacgaagtgtgctttttaccacttttgtttttatttttccaaacaccaaaacattttttatgagtttgccaatgtgttcatcaagggggagattgtaaaatcaaaggtgtttttgattattatttgtgatgaacaattaggcattggagattattggttttgttatttagaatttattcacgaagtggttttggagatgattgggtttcacaggtgaatctacaggttatcattttatgtggtccggtcagactgggctctggtagccagtcagaccggcgcagcccgcggtccgaccggccgacactgtgtcggtttcggtttcgggttgtttatttggatatccgagtttatttcatgattttggtttctacatggatactacacgtatgaaatactattgtttgcctgctatgaatccagttggagatagcttggtctcggaaatggtttctttgtttgttccatgtgtaggtaactcgatgtctcgggagagtatttgcggtgatggaccgggagtcggcttggggataagacgacgtccgtggtggtcagagatcatgcgggatacttaggctagagttgatgcacgtagttgatggagattccatatggcatacaatgaagttattgtgtgcgtatgggattaggagtcaaatttggaaggagtccaaatttggtacgtttggttatgtaaagtttctttcttgtactaaagggtttcctaaggtgtttagaactcctagtatgagtttggttcatggctttatgctgcctacctcatgtataaatagagagggagcgtgaggcttcccggtatcgcttttcagagcaatagagttgagttttgagttagggtttcaagtttagtcgaaatttttgtaaggagcgctgttggtacactttgtaaacacagagagaatcaataaagtcgtcatccactttaagagttcttcgatttgtgtttcaccgggtttcggcggtcttaccggcaactcaccggcggtcagaccggcggcatagcggcggtcagactggtgggagcacagcggtcagaccggcggcggcgacaggcgcgacaggcgatctcggcggtcagaccggagattcaacatcggtcagaccggcggcatccactcggtcagaccggtagatcaatctcggtcagaccgcgatccgtcgatttcgagggtaacttttatttccgctaaaagttttcggtttttgggtataccaaccattcaccccccctctggttggcttagttcttgtgattcgatcctacagatttatcttgcatcagaatgagctgtccattagaccacagaatgtaagaaaatattgtatcagtgtgcttggccacaactgggtcattcaagagggaatgggtcaggtctggacggaagtagtagagaaatcccacaaaaattatcttcactggttttttttgtgagattcattgatttatcactgacattatatatgcatgtgttaattcttctgtctataatgttacatcttccatgaaatccatagaaaccatttatttatccctcaatccagtggaattggcatctggtgatgcgtgaaaggtggagcaatgtggctcaggagggacgtggaaatatattgaagaaaggtattgcacatatggctgtattattgttaagggatcatgagttcaaaagcgacattactatttattatgtttccatgtgaatcagggaatggggttaaggataatcgtatatacctttctccactctccatatacaaaattaacaaattacaagcatataaccagctcgatatatattggacagaaggcactgtgctcatgaggacgatgatctgctttgtgtgatggcccaagagaaactttactggatctgttcttttcgtgtccgtttagcaggagctgctgggatcgtcttcgaattagatggaattcaaatttgggaatttatcaaatgttggtactggcaaagattgcagtttagaaggaagggtttccttgagatcgtgtcctttgcttgctattgttggtaaattgtaagatcaaagtgtgttttgattcttattctgtgatgaacaattggcgtctgtgattattggttttgatatttggagattatcgtcgaactggttttgaagataatcaattttcaggtgatgaacagggtttgctgttttgtcgggaccggtcagaccgggcggaggttgccggtcagaccggcgctatgtgtgcggtcagaccggccaggcccgcggtctgaccggccgacgctgtgtcggtttcggtttcgggtagtttctttggatatccatgattgtttcatggttatggcttctagatggatactatacgtatgtaatactgttgtttgctaacaatgagttaagttggggatagcttggtctcggaatatggtttctttatttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatcgcatacgatgaagttattgtgtgcgtatgggatgcggagtcaaatttggaaggagtccaaatttggtacgattggttatgtaaagtttctttcttgtactagagggtttcctaaagtgtttaggactcttagtatgagtttggttcgtggctttaggctgcctacctcatgtataaatagagggggagcgtgaggcttcccggtatcgctttgtatcgcttttgtatagcttttgagagctagtttagttagggtttcgagtttagtcgagatttttgtaaggagtgctattggcgcactttgtaaacacagatagaagcaataaagttgtaatctactttgagagttcttcgatttgtgtttcaccgggtttcggcagtctaaccggcatctcagcggcggtcagaccggcggcatcgcagcggtccgaccggcggcgtaagggcggtcagactgacggcggcaacagcaagcgggagctgatcaggcggtcagaccggagttccaatctcggtcagaccagtggctttcagacggtcagaccggcacgactacctcggtcagaccgcgatccatcgaattcgagggtaacttttatttccgctaaaagttttggtttttgggtatatcaaccattcaccccccttctggttggcttagttcttgtgattcgatcctacagtaaaggcatatatggaggcaaagaaatacgaaggtttttgataatgtgctaccaagtgaagatagttgatttgttgcttttaaaaatgagattctcttacatgtttgtgggatgaatgaagtccttagctcttctgtcctcagctggttacaacttcttgtaatttaaggctttctttctttgttctcctgtacaatgttgtaaatactctttcttttgatatataacttctaggctaggcctggtagtattttaaataaaaaagaaccttcaaaataatattaacccccattagtagatctgacttaatgatgagaccatgcatttttatagacaggatgcaaccctttctcaatcaagtacggccaaagtaacgtgctttattcatgagaggatgcatttttatagacataatgcaaccctttatcaatcaagaacgccagaacaaatcatcttcaaattaatctcgtcgcgccaccgggcagccattctgtcccatcgctgcaccaacgacaaaaatatccgtggccattcaacttgtcaccgatggcctatcgatctgccgcgtcgaattggctgagaagggaaggattcgtcgacttttttgtgcccgagttccattgaacgtcctggaatggaggtgatttggatgggtatctgggagctgcagatcgctgctattaggggtggcggatggagtttatgtgtgtagtgacgaaattgctaatgcgcaaccactcccccccccccccggtggacacgtggcgcgtgcagagagggccccgcggagaggtgaggggctgacacgtcgctggattttccttttttttttgttttctcttttcccttttttgcggttttctgtttcgtttttttctttctggttttttacacttcgggtacgtatacaaagtttgtatacgtgtataaaactttatatacatgtattttttttgtttttaaatgtacatataccaattttatacatatatacaaagtttgtatacacatatataaagtttgtatacgtgtatacaaagtttgtatacgcgtatgtaaagtttgtatacgcatatatatacatatgtagactagtaatagtaatacatactactagtagtagtagtactagtactagtagtagtactagtactactagtagtagtactgtagctgaggcgccgcgcgcaccgggggacgcgcgactggtcgcgcattagcggccaccgtgtagtgatttgggctcctcatgtgcttctttcacaattgttgtattagagcaggtacaatagcaagctataagcctgatataaccacatatcgagaagaaaagaaaagagagataagaaaacggactacagatttatagtcggctgcaacatggactctaagacgttatgtgtgtatgagaggtgggaccgtgtattaatggtgtagtatatttttataggtaactattgtattaatggactattagattagctatagatgatttggagctagcagttggctatgctattgaacttgctcttaagagcaggtataatagcagactataagccagctataaacacatatcgaggagataaaagaggagagagaagagcagcgggctacagatttgtagctagctacagcacggactccaagagataatgtgtgtatgacaggtgagaccatatattaatagtgtagtatatgtttataagtaaatattatatgaattggctattaagttgactataggtgatttggaactagtagttagctatactactaaacttgctctaagagcgagtacaatagcaggctacaagtcagctgtaagcacacgtggaggagagaagagaagagaagagagagaaggaaagggggctatagatttgtagccagctgcagcacggactccaatacgttatgtgtgtatgagaggtgggaccatatattaataatttatatataactattgtataaatgagctattagattggctatagatgaattagagttagtacttggctatactattaaacttgctctaggtagtttccgccgtgattatcgaaggggcagctctttgccttctcaacgcatggagtgatctggaaagttcacacggccttctgggttttaggaaatatttctgctcgcgcgaccatgaatggaatgatgctccatcctctctaccacatggcagattttcagatgagtacacttgatttctaggatgccacgtgggccaatcaggtaccagggatggtaccctgaaatcggtatttgagaagctctacacacggtgccatgtgccccaatcaaaaatcggggtttaaaccctgaaatcggtattagagatttaccctgtttcgaaaaaaataactaaaaaattataaggcgcgcatgtgtttttatgcatccatatgttacgggcaaagattatgtggagaagaatcaacatgaatagggatagattggatttagtagatgaaataagaacgtgactataacacgcacggtatcgcgttagcgctaaccagcgatgccctcaatttccaaaaatggaaccgcgttcttttccccacgcgcgcttagaatttccgaaaaaggtactgcagcccacaacaacaccttcgcccctgaacccgtggacagcataatgaagaatcaaacggaaaaaactcacgaacagctgaaggtggagagaaaaatcaagaacaagttgagaagaactaggtcccatgccctaatccaatgtagaaaacaaacccagacctatccaaatcacaaactttgtaagaagtttacatcccacaaatttataatgctatgtcaaattcataaaataaaaagagcacaaacaagcatatcaacttggaattcatgcactaatctgcagttcttttctctcagaccccaaaatccaacaagttactttgaaacatataaaaatgaaatacatgtaaaagttgtaaaagttacttcctactaacatgcaagttacttttaaaatttgtgcgctcattttggatctcttacatgatatattttgttaagcgattttaggtccattgctgccgtcactgcagcggcggcctgatagaacggacccttttggaactttaccatcgacagcgacagatgaaatgagacacattcttcatttaatcaaacaagttcaggctttcagagattctttctttcataaggaaatggatgaatcatcatttgcagaaaagctaaatacaaccatgaatcagttctgaatccatccatccattcacacgtgcatgatcgatgcagaattggattatacagggacacagattgcgcatgcatggagaagatagacatatattactaacattactgcatatacatattccttcttctagctagtgaaggagagggggccaaatgaacaacatgaggagaggaggcattgctaatgctaatagtgtctcatggcattattgaaatatgccaaaacaataaattgacagaccctccctaggggccacttttggctagctttcagttagtagatgttactttccctagctgagaaacaaacttacatgatcatatttggcttcttggttatatgtaagttacttttgaaacatatagaagttacttttaaaatataaaagttgcttcccagtaatacttaagtttcttttagttttattgatcactttttcatacttgcaggggcatatctaaagtgggtacttttagtaataatttggataaaattaagcttccatacccaaatccttttaattagaaagttatgtataatccatcgcaaagcttagtacctgaaatagttatacagaaagttacttttaaaatatataaaagttacttcctagtaatacgtaagttacttttagttttgttgatcacttgtttatacttgcaggcacatatctaaagtgggtacttttagtaataatttggataaaattaagcttccatacccaaatccttttagtaagaaagttgagtataatccatcacaaagcttagtacttgaaacagctatacaagctatacagaaatttacttttaaaacatatgaaagttacttcctattaacacgtaagttactttttaaaatatgttgaatttatgctcatttttcatcttttaattgattacctgtttatactagcaaacacaaattggaaccttaagtttcccaaaggatcattgtttttgttgtggatatacgttggtctgtacagaaccaataatatcccctagaccaaacaacaaagaaaaactaattgctctagtgagtcagccgtgctcatcatgttcaatcatactaatgtcaggttcgaaactgatgagttaggacagatagattaaactagtgttgcatgcctgcatatagttagtaaaaacagtaatctatcattctatcctgaatcaattgatgaacatggatgaagagtgatcgagccttggagaacgagatgacagtgaaataatcaaagttaattaggaaaaagggaagaaaattaccagtcaacaaatgaattggaaatcactgtactactgatcccgtttccatccatgacagtatgacacatgtattttttttttcgagcaaccgacgacaggagtttctcctgccggaatttatagaagaagagaattgacctagttaataagggaaacagggcccgaaaaccgaacaagcacggttaattagacaggaaaccggcaaaacctatacataaaaggaaaagaaagcaactattgagacctcacagaagtcgtcattgccgagcttaccaaaggcaagcagctttgacaacataacacgaggtctccagaactaccaaacgtctactagtggagcagaaaccttctaagcagagcctctaacaagggaacaacatcaaggatgctatcaatgctcattccgaaaggaaccgggttttcacctgaaggaagagagagctagcatgacgatacctccaaggagaaaacggtgcccacaggcgtcgatatcgtcagcctaggaaagcactaggcaaggttttcacccgaggctctctcaaaatgctccacctccaacccctcgcctcgttgccgggacgtttgttgagggtcatcgttgccgagcttgcaacgacaagcagctccgactccgcctcaatagacaatcccactgcagctcgaccagagaccacctcacatccagtaacccagctgcaacaaaacctatggcacggccgatgaccagagagaagatgtcagaaaacaactccgcacgccacccctaacgagccaaggagctacccggcatcgactggaagcagcctagcctaagaagggaggagcgcctaagaagaggggagcggtcgccgcaccgccagtgagcacaggaagaacaaccactgaagaaggggagaaccggatctgagaaagaaacaggagggagggagatggatgcgccatcttcgttgccagcaaccgcaccagaccggctgcccccggctagcagatgcaaccgccgccgccagacgaccaccggggtgccgccgccgccattccccagcacaccgggtgccgcccgccggggcgccaccgccagatccaggcgcggatctggcggcctcttcctctgccaccagcgcctccaagctctgccgcctgttaacgatgaaatttggtaaatcatgcatcggatttggagttaaggccgaagcggatctgagaggaaatcgataatggaaacaaggtatgaatcggcttcagaaccgcatcgactacagtgtgcattggcagttaccgaatcggacaaggcaagccgttgtaaccgattccggcaaggtggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataagggtttcatcggggtttcagctaatgagttatctggacgttgtatcggcttacaaggattgcatacatattggatttagccgatcgcaacaaaggttttactgtttaatctaatcttgtggattttatgatatcggaccaccagccgatgtatgctttaaccttcagatcagtgcttattatatcttgtttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaagcagatctcccaggctggtgttttcgatttttttcgtcaacaccgccaccgccgccatccccgccactcccatcagaacgccgccgccccaatgcacaaccctgccgccagcttcctcccctccggccagccagagcggatctgggcggccgccgcctcccgtcgccgagcagcccgcgaagcgtagccccgccgccgctatccttgtggccgtgcggctttgccgacggctgctcgggcggcggcgaggcggaggaggaggaagggagaggcgggcgatggcgggctggttgcctcccgtgtcgcccgagggtaggcgacacggagggaatacataatgaagttatgacacatgtatgcatcgatcgggcatcgcttcaactattgacacgaataggtgcccattttgctgcttacctgcctactcccactgcaaattagcatccaccgcccagatggggattgggaacaagaaggatctactattgacgtcgtcctcagactcgaacaactcctcttcctcatcatcttctctgtccttgtcgctgatgcagatggcttcatcgaacaactagagaaccccacaccggaattgctgccgccattaaggagaacgagggcctcgccaccacgtcgctggagcacttccgccacttggcaccaggggcgccggataggatggcgggcaccttgcacttccccttcaccgccatggggagggaattgggaaagcgagtgaattgggaggagtggagaatggagatggagaagagagagaggagagggccacgctagcccaatcgcatcggcaatcagacaggcgtgttgtcgatcacatggatcaccatctatcggacggccccgtacagcgtcgcgcgaaagcgcaaaaacgagagcgatctcgatttagattttgcgatgaaataacaaggaacggtcctgaacctaaacaacgcgacgctctccgtcgcactgagaaggcaggctgatgggcactaagataaatctttatctaatgcctaactgacctaggatagtatccctccttatatagatggatgactccttaatctaatcctaacaaaccttatctaatcgtaacaaaccctaatcctatccaatgggcctaggacgtccgacccaaagcccatggcattactcccccccccctttttgagaaggtcgtcctcgagctgcaccacaccctgctagacttcaaacgaaacaccataacctaaactaaaactcttaagccttttgcatctcggcttttatgaaaaaacagaaataaaaaacaatttatgcataggaggaccttagcctaaggcactgaaggagaggaaaagcccattccatgatccaaatcgaaaggcccagaccaaaattgcttggctcaaaatatgagaatgatccacctttgcgtcataggccaacgtggaaaccacccagcccaactgagagagggtagaaaccctatctcctttcctttcaggagaccacgccgctaggagcgacgcagccgtggttgatccgccaacttcgcaaaccagtgtgtggggccggtgcgatctgcgccatagcgacgcgtgaatgccacgcccacctgtcgcacctacgaattacaccacacgcacgccgccaagctctgatccaaccatcaccggtatgtgcgcctccacctgtggaaacaaagccgcatcgctggaaaatagcgcctgaaaatcagatgcctgtaccgagttgtatcgctgtcgaagtggaaatcgccatcgtcttctccgccaccgttgagggcgccaatggcaacggcgccatcgccagtcccagcggcgaggtcgaagatgcactgccactcccggacttggcaccgccggaagaggaaacatgagcgcctcgccacgagtcacgccgtccccgcgtggttgcagcgtcaccactgaatgttgcccccatccgtgctgcttgaagacacgccctcgcggacgcaaggtcaccgcatgccggtataatggttcggcctcctcaaggaaagccgttggatcggctaactgagccgccaaggcccggagttgcgccgccaagtccatcatcttctttgagatctcggcaaggccttcactgatgttgggaaccgcagcgatctcagcacccatgggcacggaaccgaagctctgataccaagttgtcacaggcaaggattatgtggagaagaatcgggatgaatggggatagattggattatagtagataaaataacaaggaacggtcctaaacctaaacggcgcgacgctctccgttgcactgagaaggcacgccgatggacactaagataaatcttgatctaatgcctaactgacctgggatagtatccctccttatatagatagaggactccttaatctaatcctaacaaaccatgatcctatccaatgggcctaggacgcccgacccaaagcccatgacaccatgcatgtattgtgtatgtcatatgcctcccttctaattaaaatagaagttcacttttggtctcagcaatgggtagttacaaacatgcagccgatttatctatgctacgtgttgtgatagtaaatttctcaggtaccattattatacaccaaccatgcatgcaaataacttctttgcaaccgatttataggaagctcaagtgagcacttccattttccatcgcacactcactagtctggtgctaataaatttctttttttttttgagaaacacagtacaaacgcaggcgctcacaacgtgcgcacactcacccctatatttacatgaatttgcacattttcatatttacaaccttttatgttaattatatagtaggcttatgaggtatctggaatacaacagaagcatgaagccaatatgattgataggccaagcaggcgagaagttctgggagacgggcaagcccttacaaggaaatccaagaccctgtaattaacagcccactaatacatataccaaaggtgctagtgaggggccgtttggtagaaatgcatctagagttctctagaggtgtttatatcaccacccaataccctggtttccacccaaatccagctaattaacatcaagtccatgttttatctgttcttcatggagcaaacaacttttttttactgagatggagcaaacaactttgttgttgctgtccagaatgttaattttcatgctgcctcaagaggctttctgcatcattgctattgcttgtacttactatgtgttatcttaatgcatatgtgaatagtacaatgttttagtttgaagcaagtttgctccttggctttgtcaagcttcgacatcgttctttcatcgatgtaacttgcaacctcttattcccttcaatcttaatgaaattgtttggcctccttcgatagtcctggcaataatcagaatgtatataatatactccttgcttcacaagtacggattgaattttatgttcttatgtcatctatgccacaagacttgaacttctaccaacttgatgcactcactactaaagaaacacacaaaagagatgacactataggtgatggaaatgctaaaattggtacatgtaatgcttttcccacctacaaaagatgaaaatatagaacaggcacctttaagcaactatagatgtcggttttagagaaaaactggcatcaatactataggctaggcggcagaacgagcagcggcggcctccccttcctctcttgtgcattctttgatttggtttttgaataaacttattgatgaatgcttggttctatgatgcgaacttatcgatgaatatttgattctacgatctatgaactagatgattctctgatatgaacaagaacttgtctcattttttgtggctttgaggcatcggcttgaagtcaccagagtcaagtcgcctttttttcaaaccatatacctcaaaagtgtcggttcttaaaccagcaccattgatgaatcctcattagtgccgcctgctagttgctggttgccaaatccggcacccatgtggggttggcaaccggcatctaaagggtttttttagtagtgagtaatcttaaagtaattgggcaaattaagctaacattacatttattgctctcatgaatgccaatttagtcaatttagtcaactccaacagggataaaatactagcaataactcttaacagtgttatatgttttgcagtacgtataaatcgatggacatcaagcgcatttgtggtgtgctgtactagtaatagacgaacattatgtatgaatatgtagctaataataaaaatcttattagattgaatgttttttatcaccatctctattgtacatatcccaaatgtttttctacatcgatgtatttcacagttgtgtgttccataataggattaaagcatcctgtagagaaattccctctggactattttggctgccaaccttttcaaaactactagctactgtttggatttttcgtgtggaggtaacatttctagatttgtcaccaaaagtactttcatgtaattatgtttttcatatttatactgaagtaaatttgaaatagtgatgatcaaagcattgactggaaaatgtctcaatgtctaaaataactacagatgtaattatcaatttgttgtcccatgggctctactttcagtggtttcttcagcccatgctcaattttgctagagtctctcaggaacctgcgtagatgcatcttgtatagtgtcaagaagttcatatatgaaatgaattttgcataacgttttctgcaagaccgcaagttcctgacattttctatatatgtgtcatattcatggatcaaacgaatgattctggttgagaactctcttgttgattccatttatttgtaaagttctagaccaaacgcatcatgtttgcatgacccatctcatttcaaatttaattatggataattttaaactatatatattcatacataagcattgtacagcacactgagtacactgaaaattcatttaattttcattaatttaaaatattattgacattgatcacaattcctccttgctaattactttcaaacagcagagaagtggttgagatatgaatttatacaaaatcatacaacctatgcatgtgatttggttgtgcaacaattgtcaatcatcaaatcaacatcgccggctttaggctccatattgtcaacttgtttggtggcaccggtttattgttttaccggatgaatgaaattggtggctgatactcactcattttaatgtgctagggttgatcagtgttgtggttgcgctcctctgctagaatctcttgtggtaattgaagatatggaacccttttgttttcacttatataacaacagggatctagtttcttttattttttaatatattctaccctttttcacaaaaataaaaaacttatatgtgggtgcatgtgttttcccttgtgtataagttcggcctcataattgaaacaaaagttcactatgggtcacaactcacaataatgggcagtgacaaccaatttatctcatacaatggggctggcataacgaatttctctcaggtaccgttattgtaaaccaaccacgcatgcaaaattgcttctctacaagtaccattgtaggatattaaaaagggggggtgctggtgtggtcggccacatttgcggagataaaataaggggtttaacaactcaagtgaacacctcgattgatctgtagctctgctcccaatgcaaacacactatatttgtgctaattttatttcaagtagctatgaatttacacctagtcgtgcaccttttcgggtgcatgagatatgataggtttaggaggcatcaggattaatacatcaggaggcatagggactaatacatcagaagttggattagcatgtacaacagttatgtgtttcctctgtttcggactacataaagttagcatgagactttgcacatgttctcctacttctctcaatatctcattggtctttctttaacctatagggcatgcctttcgcatctaccagagagatttgtttcttaggttcatcttagcttacattgcttatatacattcatcttaattacagtctacaagcatgcatggctgttccatccacctgccatagttggttcctaggtgatataaagcctagtaagcttaggaggcaaacggaccttagaattgagcttttgcgaaagtgtggaagttgtcaccatagcttataggagtttatggtgtcagaggaatgatctaattttcagcaatgttaatccaaatttcattttaaggagaaatttgctatacatttgtatagagcaagaggagataaaacagcctggacattatggtttgatgacaacctttcatagatttttttaaaaaaaaagtattttttccttgtatgtatttataacttgtaaatattattcttttttaatataagcatctcctactattttcgggtaaataagttattgaatactttctttagctagtacttcctctgtttcacaatgtaagttattctagcattttccgcatttatattgatgttataaatgcggaaaatgctagaatgacttatattgtgaaacggaggaagtagaacattgtgtggcagtgcgtgcaagaggtgattgttaagcatgcatgactcatttctgcgattagaacgctagcgatgatgagaaaacgtgtatcgaatgcacatgtgaagttcattggcttgtgtggatatcccttgcatccaaaagtggctgcaatttcttttgcacatgtatggatctagctatggtgttatagatcatagatggtcagataaagatttctccgacctctacagacaaaagtcttgactagaagccattgccactacataacatcgtatagttacatgacatcaaagaaaacaaccctaatgagactaagtatggtagtgcacctcaatatagttttcctctgatattgtcggtatgtcaatgatgtctatgcagttgtactatttgttggccacaaacacatggatgtgtattatcttaagacaattaatgcgataacattatccttgtctctacacgccatgctcttcctaactactacaattttgtagcatttctatgttataggttatgaaacgatatcggattcataaaaataaaaaatatcacaagcctaagatatagattacaatttacattaacacttgtttgtaatgtacatggtttttccgtgtgtatgtctcccttataatcaaaataaaacttcactatttttcacagcaatgtgccctgacactgaatttatccaggactacagggttgagatactgaatttcttcaggcagtattattgtaaaccaaccattcattaaaatagctagcttctttgcaagtaccattgcggcctatatgagtatcagtgcactcatcctcatttgtgctgaacaaactgaatcatgcatggttcagcggaccccttccagtgaacacctctcctcttcaaattgctcactcacttagagtctctagactcatgctattttcttttcctgaacctctgaactcacacctagttaatacatttccgggtttaggctgtgttctccccccaccccccccccccaaaaaaaaaaaatcccaatccacctctctcgttttctacacgcatgctttttcaaactgttaaacggtgtgatttatgcaaaaaatgaaagttgttttaaaaaatcatattaatctattttttaaaaaaaaataagttaatacttaattaatcatacaataatacgagcttcgttttacgtgccggggaggaggggttcccaatccatcctctcgaacacagcctaaggctatgaaaaaactttctatatgaaagttgtttaggaggcatcacgattaatacatcataagcataaattcaatgcggttagaaaattgaaggctatggactggattcggtggacaaggatgatctcttggttgtagtgggctgtcttttgtatctagtcgtggtgtactgtgtcccagagcatatcatgcctcagattgcactgtgagaacaagaagaatagattcctctggcctatgagggtgcagccgactacggatccggcggggcgacgacagcgggtgcctcggggggggggcggcgacggcgtgcggcgtggatgcgggcggcagtggcgggctagggtttgggattttttggattttatttttcttcgtttgctgaatttattttcgcatgcggccggtataagcgaccgcttgtgaaaatcccatcttcacatgcggatgcgtcggccgcatgcaaaaagggtgtttttacagacgatttcgtccatgcggttggggcaatcgtatgaaaaatgcatcccaaatacatggaaagacccttttttagtagtgcgttgcacccgtcgtcatcgtggtgcccggcaactccgccagaaacgagaggcaccagatcagatcattaattagtgagtaatgcaaatgtgctagtatcaattactactagagttttctgcagtgaggcattactgtgcaattgaggtatatatatgctcccacatctacaaatgatcagttccacgaactagaaaagttagagaatttagatccaagagcttggattagcactagcaaatcctagcgacgaatgattcgtgctgcagggtggtggcgatgcagagggtatagacaccctccctcgacacgattgaggtcgaggggttgccaacatccgcactaacagttgagaattgagattggtttttgagttttggggcactggtgtgaacaagctgagcgaatacagtactacggtagaacctggctgaggtggtgtttggatccagagacttaactttagtgtctatatttagacattaatttagagtattaaatatagactatttataaaactaattacataaataaaagctaattcgcaagacaaattttttaagcctaattaatccataattagagaatgtttactgtagcatcacataagctaatcatggattaattaggctcaatagattcgtctcacgtattattccaaaattatggatgggttttattaatagtctacgtttaatatttataattagtgtcaaacatccaatgtgatagggtcttaaaagttttagtcccatctaaacagggtccaggtctgaggacggacttgtcgggcgggccatcgtggttgtaactagaggacatacgggcagccctagcaggtggggatgtcgagatggagagtttgcttgccatcgtcaaccatgtatatacagtggaaactacggtatcatcaatagtatatacgtatgagatttagctatatcatcaatagtaaatgttttagtcccagattcaattgtaaaacttttaatatcaatgatgtgatcaaatatcatgtgtccttttttttaatccaacaatatttctatgtttttattatatatatggtttgcgctatatatattcccactttagagtcactaacatgtaagtccacagcaaaaggagcccatatgtttagtgactcaaagtcatgtgagtcgcaatcttgcaatccaatgtgggggatagaagagatgaagagagagatacagaggaggggacactgacatctgctgagtcagccactgacatctgctgagtcagccagttggaccatatcaataagcctcgtcaacaattaccgttgtaattactgtcttggaagtcaaattagactggttttaatagttttagggtattacggttaaggtatataaattatatcgaacataaatttgagcgactcaagttggacttatttcttcagaaatttggttcataaatgtaaaagaaatgtgtaatgaggcccattgctgcagcccaagcatgaacaagcccaacaaatcagtgccatccattccatccaaattggacatctactatacataagaatggtttagctagaactattattaaaacgggcttcactagaataccattgtcaacagagtgcagtttgatattttgctatttttatcattttgggttaatgatgaaaaagattttgctctcttttagaaccttttgtgccgaaactgcccctagttttttctttcgtcctctctctatccaaaccgagcggcatctttttttaacgcacgttttttctctcgcgtctcttctgtcgacggtcgaccacctgtttttgtcgctcgctgaaggactgagccgaccgagtggcgctggaggcggaggtgcgagcaccaggcgctcgcagtggctacgagcgcaggtggcagcgggatcgggggtggcagggagcggcgaggttgggggtggcggtgaggaatggggagatgtggcgcgccggccgacaaagcggtggtgggcggtgaggttgggggtgagcgccgaggataggagtggcggtggggagaggtggcgcacaggccggcagagtggtggtgagcggcagcggcgtcgccgcgccccttctctcgcctattatgtttcctctctcacgattcaacaagttgacctagggatataatcatctgagaaaatgtgtaatttacaaaaaaaaaatgaaataccatcgacaagcaccctaatcctaaaaatgtcattgacaaaggcaactttctataaataccattgcacaagtctctttctcccaaaaataccattaccgtcaactccacaccattacaaccgttaatttttttatagtgaccattttgcccacagtgcaaaatatacccaattttcactgtcaaagaaaaagatagatgaaacaaaatttataaccctaaccctaccaatcctgatcctagcgaggaggtccatggcggcggcgcggtagggtgtggcggtggagcggcaacacgcgacgaggaggtccgcggtaaaggtggcacggggcgcggcgaggaggccgcaagcgacggcacggcggttgcaggctgcggtgcgggggctgtaggcgccggcgaggagaggcccgcaggcgtcggtgatgagggggaggagaggcccacagccgcagtcgcgaggtcgccgtgcaggaggaggctgcagtcctaacacgtggcgcaattttttcccttttgtttgttttcattcggcgtcgccgaaggggtggaacaagccatggcgatggccgccgaggtaggcgtcccagaggtggtcggcgacgttcttggccgacctgggcatggggagggagtactggtcaccttcaccaccaatggagaggagcacggtgacattcttggcgtgctggtagtgcttgatgtcggcgccgacgctggcgacggggtggccggagaggtcggcccagtagcggccatggccgaagacgctgaggaaggagatgatgacaatgttgtggaagctgttccacgcaccatttgttcaagaggatgaggagcactataacaacaaatgagagcagcagacatttttaatttagttatgtgtcgatcgttatctgcaccgcagacattttttgttgactaaagacaaatgttgtgtacgcgtaagtatacagaagttgcttgcaatgacaaaaccgaaagatgtctcctgatgaacaaatggttgtctagggataagattgtcttttcatataacttaacggagagatgttttttttttaggtttaacagagagatgttaatagcagtttgatggtgatagtatttttgagagaaagaggcttgtacaatggtatttctaaaaagttatctttatcgatgatatttctcggattagtatgcttatcgatggaattttatggattttcttttttataatggtattctatcgaagcgatgcttataccatgctagaaatgccattttctaattcacgaggctccaaccgcgagaaaggcgagacagaatgaatcctcgccggcgacgaggcgccgacacctccctccggcgactgggtctccgacctcgtcgccggtggccggacggggcagcctcgccgcacggggagccccatcgcctccgactccgtctcggagtcggattcccgccctccttatgggaaaaagaaaatatctcaccccgattcgatcgcgacgaaccctcgcactccgactccgattccaattccaactccaatgtcggtggattttatccctcgacgataaaaagggcgccacatcctccacccgagatcaccaaatctctcaattcccaaaatcaattcgcgcaccaaacctcccaaatccctctcccaccagttcttggattcgccgaggagctcttgtccttccatccatggcggcggggtggcgcgagacgcccgccgcctccgcggccttcccggtggcctacaccgccgtcctcgcgctctacctcctcctcggcgtcttcccgcgcccgcgtggcgccccgccgtgcgaggcgctgctgtgggagctcgccgactgggcggccgtggccgtctgcctcgccgccgacgcctacttcatctactgcatcgcctcctcccgccgccgccccgacgtcccacccgcggctgccgccccctcccccgcagatggatctctgctagggtttagggcagggcctcgccgtctcgacatcgtcagggagtgtccttaacccttcttttctcatcatgctgctactgttattttcttcagttaattaggaaggtttctttctggtgtagtttagttgttagcaacagcccttgaactgaaaccatggttagaatttggaagattaatgctgtagtctagtgtcaacaacgcttccttgtgctgctttaatgagcttctgcatcacaattgctacttctgctactagtcattgtgtgattaccttttgtcttgcaagtttctacacttattaggaagaattctgatgctcttagaatattgattagtcattagaatctagttttgttagatgtgtcgatgtagaaatagtcgattgcgttcgtgttcctttgataagccttctttccaaacttcaatcttgtttttgtaatgcatatgatcctccacatataaggatcaaatagtatattctattgtcatctgctctgcaagtcttgaactttggtttttatcatactgcaaaacacccctaatagtactttctgcagttactttttgtcacctgttctgctagtattactttctgcagttaggatgatttctgttgtactgtagttgttagcaacagtcttgaactgaaaccttggttagctagctgtgaaagtgtctcagccaattttctctcctttcttaatgaaacaacagagttcctgctttagtataaaaaaataccaaaaaaaaatggttagaattaggaagatttccaatgtagtgtagtgtccacaatgttcttcatgctgcttcaaaatcgctacttttactacagtcattatgtgattaccttttgtcttgcaagtttctgcacttaagtaggaagatttctgatgatattagtcattagaatctagttctattacatatatcaatgtcggaatagcatgtgccatgtttgtgttcatatgctcctacacatatagatcaaattgtatattctactatcatctgttctgcaagtcttgaacttcggtttttatcatagagcaaaacaccccaataatttccttttgggaaaacggttgagtgatcatgaggtcgagagttcgagcctctgtcaccccaaatattgagtgatgaggaaatgctcctgtgacaatcgggttcgtcacattcatctgaccatcagatattaagagctagtctgaactcaattaacttgaatcttctttttgtaatgcatatactgtactccacacatgtcgatcaaattgtatattctattttcatctgtgctgcaagtcttaaactttggtttttatcatagtgaaaataccccaataatttccttctgggaaaacctaactgccaactagatgcactagtctaaatatacagttaagggctggatatcaccattgacttggtctcttggttgatttattgctctgatgactaccaattcaggtcgcattattttgcacttgtgcctgcccccacatatttattggtcaatttagttggctccaaaagggtataaaatactagcagttactctaacatagttctgtgttttgcagtataaatccaggcacaccaagtggacacaaatatatagaatacatcatgacttttcaccatatcattcagtatgaatatgtaactagtaataaaaatgttattgatttgaatgttttcaatcaccatctatattttacctatctcagtaaacttcttagttgtatttgaccccatgtcctttagaattgcatattccttaacaaagggagcagttgatgagtgatcctttctaaaacagttatttggatttgtcttattgtagtaatattacttgatttgtcaccaaaagcacttccatgtgtaatatctttatactgaataaaatcgaaatagtaatgatcaaagcatttactgaagattgtgtcaatggtctaagacgacaatagatgtaattcaattaggtatgcctgcattctattttcaatggtttcttaatcttgtgcttaactttgctgcagccaaacactgtcgtagatgaagtggtcaagattgtctggaaggagcaaaacatgaagtcaattgctctccagaagacaaggtcaatcactgctgtgctgccaaacaaatcagttgttctccagagcgccaggtcaatcactgttgagttcgagaacttgagcgaaaactgaagttcgtgtatgcttggagctgcagtgttgagagcttactaacttcgtggctcactcatctgaactgagaagttacaaaacccagtggtggaaaccaaactacacaggtgtaaacctggagtagcagtagcactaaagtaattctggtctaacataagttacttgtatcattagctgtactgaatcattgtagagctaatactaatatatgaatggtatatataaactaatacgtgtactaagctgtaccaaacgatgcacctatactgttgagaagttcatatatgcaatgaatgttggttgacattgcttaatgttatctgcaaattcttggctttctctatgtaccatacacatggatcgaacgagtgattcaggtcgagaattcccttcttgattcgttctgtttgtagttctgaaccaaatgaaccgtattggaaacttggaatgtgaatatcacatcccatttcaaaattaattatggacaaactgtcacaactataatcaacctccatttctcttatcagatggacagtagtcaaccacaaattcattcatgaatatgtgcaccggactaagtacaccgaaaattttcaggtagttttcatcaataaaagagggcattgactttgatctcaagaactcctcactaatcactttcaaacagcaggggaaggaagtagttgagatatggatttgtacaaaaaaaattatccaacttgtgcatttggtttgattcgacttgccggtgagggccgtccaagtgacatgtgggagtttcgcctttactgcaatcgggccctaccccgccaggtgttcgaccagtgccccgaccgccgcggcgccacgagcctaactgtcgcgccgcggcggcgtggccatcgcttcggtgttcgccacggatgacgatgtcgatgggagcgacgccaggtccggggtggcggtggatgatgacgtcgaggcctctgatcggtcggcgccgccgcctcgtgcggtatagtcggcgagcatggccttgagctcggcgagcacctcgcccatcgcggggcgctcgtgcttgtatgggcgcacgcaccggcacgcgagcgcgaacacggcgcgcacggtgggcctgtcccagtcggcgccgaggcgctcgtccaccatggactccgcggcggcgccggcctcgccgccggcctgggcgacggcccagtgcgcggcgtgcacgatggactcggcgccgcccgacggcgtgggcacgacggcgcgcatccccgtggcgagctcgagcagcacgacgccgaagctgtagacgtcgccggcctccgagacgtgccccgccgagaagctctccgggtcgacgtacccgcgcgtgccgcgcacctccgtcgacacgtgcgtcccgccctcgggcacgatccgcgacaccccgaagtccgacagcttcgccgcgccggactccgacagcagcacgttcgtcggcttcacgtcgcggtgcaccacggcgccctcccggaacccgtgcaggtaggccagcccctccgcgacgtccaccgccacctccagccgccgccgccacgccagctcgccctggaacagcgcgcgccacaggttgccgccgccgaggtactcgtacaccagcgcgtggtggtcgccgccgaggcagtagcccaccagcgtcgtcaggttccggtgccggagcttggcgagcacggccacctccgcgtagaactccgacaccttcttcgacctgtagatcttcttgatggccactcgctgccccgacgggagccgccccaggtacaccttgccggcgccgccgctgcccagcagaagcttctcgtcgtagccattggtggcctgcttcagctccgacttggtgaagatgtacaggccctcgcgcggcagcggcggcagcgacgccaccgactcgtcgtcgctgacgtcacctgccgtcgtcgtcgacctacgccggcgacggattgttacgattgccagcgcggcggaggcgaccgccacgacggcc

SEQ ID NO: 81015 - DNA, 713 bp, Oryza sativa
tatggataccccagacccacacggcatgtgtatccgactgggtatgggatgccatgtatagatagaatatctttaaagggactcgggttaaattctaaacttgtatgacaaggaaatacccgggatcctagtcgtttacgattgtatccaatctgtaactaccaattccgttagagatatgggctttattttgtaatacggaccccttcccttatataaggaggggtccgggtgcctcaaggggcacgattttgctcccagatcatacgatcaataatacactcgacggatcaatcgttgtacaggagtagggtattacttcttattaagaaggtctgaacctgtataaaatttcttgtctctaaacccatccacttttctagcttgatagccactccttttagtattgccgaaatcttgtttcgacaccgttcaaccttcctaaagatatctgagttgggcagtagcgacgttaatgtcctaggggaaatcgttttgtgcctgtgatatgtaatggaagctagtgtccctagcgcaaacatggatgtttagtttctgctgttatgtgttttttttttctgttttttctgtatcagactatgtttctgttctgggcctgtgtttcagactgggtgagtaaaattacctgctgtcaaaaaaaaaatccatctgcagactccactgaaaacgttaatccacagggctgcaggaat

SEQ ID NO: 81016 - DNA, 2789 bp, Oryza sativa
catcgcccgagagcgaacggccgtctgccatgtcactttcgccgccctctgggatggcgatttttaaaaatcgccctcccagagggcggtaggcgaccacttctgtcaattttcaaaatgaaaaattatttttataaaacttttaataaaaaaattaaaaataaaaaaaattcgagaatatacggtattgggctgcgaggctttccggctgttttggtgtccttggcccatgtactaacactggcaggctaccagcccacgtggtagctgcacctgcacgtcagcttcgctttttatttaggagtatttgtttatttttggaatggctaagatttcagttacctgaaattcttaaaatttcagctgaacttacttgctgtcttgtccacattaagattcatgctccggcgatggcaatagagtctttctctaggtttagaatttaggtttcaaggtgagggttgagatgggagggggagagaaggggggatggttttggtgttagagcgatggctatggacggaggccaaaccaacgatgtgtggcgaacaatgcgagcagcaaggtcgatgccgctgacgaatcaaatgtataatgtatatataagagaaacgactagtgatgtcttggcggcgcaagccactgaaggtgaaaaagacagatggtgctaaggtatctcaccatcgctcaagcatagaaaagagaactagtgaacaggagggggagggagggaggaggccggtctagtagagaacacacataacttttacttagggatagcgtctaaaggcatcaaactaggtttagactgagtttgacagcgtcggttgggagcctgtggttgtggttggtagcaagtgcgcactgttcatgtactgttcatagaaatcgtgggcctcccaaacggcgtcgtgcgcggctttacttccgtccaacatctacagtatgtcaaaagcacgtgagcaatccgaacggattaccaacctcaccatcccgctcccaacgggcgctgtcgaactcagatttattccatactagcttgtagaaaggaaagtacactagtacagtactattgtacagaatatacccttgaaatacattgatattctttattttcgcagacaaagatgtaagtgctttttttccataccatcaataatagctaggcaagtcagggtgtgtttagttctttggatgtaaagtttttgaagtatacggacatatatttgaagtattaaatgtaaaacgtagactaataacaaaacaaattacagattccaactgtaaattgcgagacgaatttattaagcctaattaatccgttattggcaaatgtttattgtagcatcacattgtcaaatcatggcgtaattaggctcaaaagattcgtctcgcaatttatatgcaaactgtacaattggtttttttcccacatttagagtctcatgcatgtgtccaaacatttgatatgatgtttttgaccaatattttttgaaatctaaataaggcctcggtaggaaaaatgaaatgtcgcctacgagttttcgcagaaaaaggacagaccacaatatcttatgtgtcctcgaggtccatacagcagcagcagtgaaaaggatttggagaatctgccccatgtggtgcgtgttgtgttgtccacactccccttggacctcactccttgctgaaattgttctgcacaaatggtacacatgaacccaagctgtccaccacccaaaacacacggctagtttgcctgagatatcgacacacaaagatgtacctcggaaatggcatatttttgtttctccatctgaagaacggatcatcgtatcatgggcttgttgttcatatctttagtcctttttttcctattaattttatgtataaacgtgtgatgtaaacttgcgaacaattaagagatcaactaaaaaaacttcgaaatatcacccacggctttgaactctcagaggtctcgctgagacaatcgagttgtcaaatttagatgatttctcatgtaaaaaaactgcgaaatattttttaaaaatgaaaaatagagtttaagctatcagccacacaagatttaggatctattcagattacttttaaaataaacctttttaggcccctttgattcaaaggaaattcatagaaatttttagaggatttcattcctataggaatttttcctacgaagccctttgaatcaaaggaatgaaccctatggaatcttatgaaattcctataaaatgcctcttcccatacaagttttggaggaattttaacaagagctagaacctcatggaagaaatcctttgagggccactttgaatcacatgaatggaaaaacagaggaataggaaaaacatagaattctgacaggaatgtaagtgtaaaacagatgattgcaaaacacaggaaaaacgtagaaatgatcatttgattggaccacaggaaaaacacaagaatttgaggagagataaagactcaaaagattttttttccatgaggttttacctcttgttaaaattcctccaaaacttgtatgggaagaggcattccatattaattttataggattccatagggttcattcctttgattcaaaaggctttgtaggaaaaattcctatatgaatgaaatactctaaaattcccatgaatttcctttgaatcaaatagggcctgagtctttatctctccttaaattcctgtgtttttcctgtggtccaatcaaatgatcatttctacgtttttcctgtgttttgcaatcatctgttttacacttacatt

SEQ ID NO: 81017 - DNA, 3923 bp, Oryza sativa
tgcaagttcagattacctccaaggtagttctgaggaggatgttgtatgttatatatctgctgtacagaaacaaactgggctccaacctaactgggctccaaccggctgatgttgttgattaactggtgttctctacccagtcagtatcggctgaactatttgctgcccaatcggctggaccacatgctgcctgattggtgtatgctgaattggttcaacaatctgctgagttggcccaaacattgccgcaatctgctcttgagtcagcctattaatattctgcccagcatgctgaggctgctctctagtcaagacatgaggattaaccacctgtctttgtgccgatgatgaagcaccaggtgctggagccgaaactgatgccatcggctagaccagtggtgcattggatacgggttgctggttaccagtcaccaaactcctatactgtggaaatacgccatttggtagaaagactggtaccgtgttttgatgctcaactatcgtgccatcaaccacagacttaaccatattcgttaaagtattgacaaggacccctgattggttgatcaaagcatgttgaaagcatagtcaacatgatcttggaaattattgaatttcaagggctcttgctcctcatcaccatcttcatccacatcctcaacctcaccatctcgaggttcctcaccttttcacctgagccatctgcagcacctttagtccctttagctttaccacctttggatgagcttgttccaggttcatcggcagcaaccaccttcaccttgtacttttgaataacttttccctggcggtttccccgaatgaattcatgaattgctcctaagcactcttcatcatttgttcaaactccttcctttgttctagtgataatttgtctatagtgaccgggacgatgttcccttcattaacctcagacggttgctcgggcggtggcttagtgaacggaggtttagttttgcctcccgttgctggtgactgtggtggattctctgccatgaggaaacgttgtcgcaacttgagtcccaccggacgtgccaaaagcgtgttgatgcgaaaaacgcacactggcctggaagatctgcttaacttctgtgcaggtccaaaatcttgcttttaggttcgtgagcgtgccagttgatttgatcctacaatcaacaagaaagaaaaacaagaaaaaccgtggttaaattcataaatgatagctgatcggctagttgccgatgacatatcatttatctttgagccgatgtcatattggaatcgatcggtagtcatgaataaataaaataaaactaaatctactcaatcggctgtagatattaatgacatataatccttccttcgatatatatttaaactaagtgattgggatagatcggtcgctatgccgagacagtataaatcacttaagtcgaaatatatattaaagcaatgattatatagacgtttatagcatagccgattaaatagatccagtatgtatcggctaatactctgataccactttaaactaggatattagaacaggcagaatatatcaaacaggagcctaatatacttgatgcatagacttattaaagcaattagttataatcaagctgtgagaataaagaacagatcaggtagatcggtgaaaccccatctatatcttcgatgatataaacagccagatttatagtatagattactaatagatcgactcaaccgatgcacattaagcgtaatataaatataggatctaggcagagatgaaacctataagagatggtagatacacgatataatctaaataataacaaaacataactctatcggtactttctaaccgatgacaagttatagatcgcaactagcggagattacaacgtgtatatgataacttgacgaatcacataaacaagattagagtgtcataaagatggaagcactaatcccgagaacgcaaggcgccatgacaagtttacctctagttgaagatcgtaatcgatgcagctcaacccgaaagtaagaactcgtcgaaatagaacgaaagtaaaaagggtggtgatgcactgaaagtgttactgaactgttgttgttgattacattgagttcgggtcatatttatacccaagatacaaaatatgtccttgccggacacgactcttatctctaacaaactctaagatatcataagtctttgcggcagacttttgcccaaacatatctctaagaaaattacacgaaatatcctaattaatagatacaattgccttgttcagagctctatctctatcgtggcaatcctcatgaagcacattgatcgattctagaaacagccccgaagccatctttatcagaatcggctgtaccgaccccatcggctttatcagttatcctctgtccgatccatctctgccgatgcaaacgccaacaaatgccttcgcaaccgatgcatactctgttcttcgagtctatttcttcgccgaatccgcttcgattccaatgtcgaacctggttcatatcttaccaaatttggtcgttaacacggaggtattaaagatgtgggcgaagtgctcgcaccacagtgctccgggcgttttcggggcgacgtgctcaattccgctgatgtccacatcatccggcgctggtcctggaaattttgcaaaaacgtcctcgcttaacttgacaatctttcttaagtccctcaatgtaagtttactgtcttatgtattcttacgtaacggccatctgtgtcctagtatatcctacgtgaaggagacgaaattcctaatataggaccgcactctcagaaaatgaaaagaaagggttttttttttgaaaaagataacatccctatcccctcggttcgccgaaccctagccgccactgttccccaccctattctctcctccttccccttgcatgacggcgccacatcgtcttccctccttcctcgcttctcctcgccaacgacggtctccaatcgcgctctccccgcccccccatcttctacccctcttccgaatcaagcaggggaaagagaacccacacactcctcttctcagcttctcttaccttaagagcagtggcatgagcgagtcaacttaatctcaagagggaggcaagcaatctgtgctagggagtggatcaaagagggagaccgtcagtgggcagggaggggcgacgaagtcgcgagccgccataacggggacatggagggaagggtgctagtatgctacagagctcgcctatgtcactctttcatccttttcttgtcaaacatttgtagactaaaaaataaaaaaaacactgcattatttttacgtctaatatatacgaatctttggatcacctctagatcgaacaattatttaggcacaccatggataacaatcataaaagaaaaggcagaactcatagaagtttaaaataaaatgcaattcttcaaattttgtatattatgttaagtgcctcttgagaaaaataaaagacgagcctaaatacctgcagttaaagtaaataggacagcattgttttgcattcctatcagatgcatgataatacgttatgtatatgtgtcttagtttggccatatcacctaaaggatcctcgtttagcttatcttactagaaataagcaaatcctataccctacagttttataagtagtggacttagaatacatcgcaatatagtcatctagtttacttcaacatctaattaatggatggcttaatctggcacatactctggtaactggtaagtacagtatacttccttgattatataaaggttgttccattatgcaagaaaggaggcaaaacaaataaatacatagacttgcaattcctaaatatagttgaacaaatcaaagtgccttcataaaaggcagaaacatccaagacaacttcctatttgtaa

SEQ ID NO: 81018 - DNA, 960 bp, Oryza sativa
ccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccggaagatggggtcttcgccataacaagcccaactttgaag

SEQ ID NO: 81019 - DNA, 2302 bp, Oryza sativa
ctgaagttgtgctactatctttgtggtcttgtgtgaagcttcctatgtggagctatgtgattggtggaaaattaatacttctggtgaattgaggtccctttggtgagattaattctttatttgagatgtgtggcttctttgtgttaattagccggatgacgaacccgacttaagtgaggggtgccagacggtattagccgatctaggtatctcggtgaacggttgaatatacaccactttgtgtatgggtctgacggcaacatttatttacatattaccttttgtgtataaaaggggtcaagctatgtatgtcctgtgcaaccgtatatttaaatatatgcggctgtgttctttgccgtgagtcctcaacacatctccctcgttttccgtgtgcacgcttttcaaactgctaaacggtgtgtgttttgcaaaaagtttctataggaaagttgctttaaaaaatcatattaatccattttttaaattttttatagttaatacttaattaataattcgttaatctatctctccgttttgcgtgtggagaggaggggttcccaacccctccaaaagaacacagccagtgtacgtttatgtatacatgctgactgtttatagtgatgtttgttcgtataatatttccatgttattattattagtatattgtggtggtatattggacattatttatttgttttacttcaacagatgtgaatgttataaattttgagtggcttattcttgtttccaaaaattttgctagttaactgattaattaatgatatatgtcacataatttttaatttttttaaatagcttaaaattccgggttgtttcaccattgaaaaatctttggattaaaacactatattacgtacaagtcaaatagaaaattgagaaagcatctaaatttatctatgaataaaacaaaaaacagggaactagatgagcagaagtaagggcaacaccaatgtatcttgtttaactaggtaataagtagcagggctaagtagtaggtctttgtaaagtgggtcccatgaggaaaaaaatattgctttttagttgctttttgtccaactcagcatgcagtagtagcacatcttgtgttggaaggagagagtgagagagattttaatgtttttttattcttatgagtgggtcataagcttactatctagcattagttactacccacttccacaatgcttattactagatcatagaaatattatattgcttaatacctgctttttcctaacattgtggatgccctaagtagtaacttgtaatttcactggaaaatgatagatagaaattggcaatcgaagacatatttgttttaggatatgtatttccacctgattacacagattctattctgcacatctgaaactatctatataatggaaacagcactaactttttagatgccattttcccgtaatattgtcttccgcaatttcttgaagttaaatgatctatctagcagactagcacgtaaacccactaatcacgatatattcttattaattgaacgtttgtggataaaccttttatatctatggtattagcggtttaaaatccaatgttgaaaaaaatctatgaaaaaaaaactaaaatcaacttaaaattaagttttaaaattcaatttgctaaataataagcacaggctataaagtggttggcgcgccaacatgcgtgctcattttctactaatagactaaatccatcttatctgtagcgctcattgtctactaatagactaaatccatcttatctgtagctgtgttgcccgccctgtgtttgaggtggatttaaaaagtgtggaactagctggtgtgttattccgggaggagctctctctgaaacataacatcaatggtggcttcattgttgaacgcattgctgatgattctgctcttgagcatcttggtgttagacggggtgacgtgatcttttttgaggacgagtgtgggactactttgcctgaggtgaaatgaattctggtctcaagtaatagtttaatataaatcaacatttgttaagaataatacaaattctggaacagattgaagattatctcctttctcttggttggagatacctgcaggggatgaagtcgatggttcaaggtctgatattacacaataacaaatgcatgtaaatgtttttttctctttttgaaacaatgggaaaaaataattaacagaactgcctttcttgtgtagttgctagtacatgacattgaaggtccatgtaaggagacaattaccttgcccttagagttttctgtcgattcagg

SEQ ID NO: 81020 - DNA, 592 bp, Oryza sativa
acgggtttgttgagatcgactcttcagaccccgtccatgatgttctccattgattttctcgatcagctgtacgttttggtgtgtttggactatgagaagcatcggatctactatccttggtggaggtgacttgtgatggctttaaaccacctcgaacagttcctgtgccctctgatctgtctggaagattccagccagcagctttcctaacagttccttgactaaaatagaatcccaaaaaaataataataataaggcacaggaagacaaacacgataacgcttacaagttattttctaaattcaccttgaaggagagactacatcccttgtagccctctcaaccttgatagtaccagtaccatcatcttcttcaacatgtgttcgaccattttgtgtggcatccgcactgctttttactggaaacttcggtcgctctctgccaataacagcaattgaggaacaagggaatcagataggtgttgagatgtctcaattatcagcaaaagactgcttttaactcttctctctgttatgaacagaagtactataccacataccttattctatccagaagctttggagattttcta

SEQ ID NO: 81021 - DNA, 580 bp, Oryza sativa
ctgcagccctgctagtgcttcatgagctatggccatggtcaagtcttcgatgacttacatgtctgccttgcaggctgtgatcggaggagctgacaactacgggctctgaacattcagacgctgtcgggattgacgaatgtggattaccagacatcgcttgcttagaaattggcacttaactggttttgtactggtaaggagggagaattgctaatagcttagcatacatacctatttaatatgatcagctggcagcgaatcaatcttggattcatgtcattgatatattgctggcggatttcatttgacatgtttgatatattacgatcattgcacaatgttcttcagacattgatacctaagagaatatttgcatgagatgcgagaaatactttccaacaattccattgtcagttattaaactcagtgcgagcatatatgctaacaggatttccataacgacattatgcaaacgggtgaacgttaggcagctattgcaatcacgcatgaccaagtggatatgtggttcatgccttccatcctctgccagcgtattatgccatgtggagatttgcatgct

SEQ ID NO: 81022 - DNA, 672 bp, Oryza sativa
cccgtagctgttaataaggatatctcatgtaaattctttagagatatgtttgggcaaaagtctgccgcaaagacttatggtatcttagagtttgttagagataagaatcgtgtccggcaaggacatatcttgtaatctcggatataaatatgacccgagcctatgtaatcaaataacacacattcaataacactttcggcgcatcgccacccttttattctatttcgacgagttcttgctttcgggttgagctgcattgattcgatcttcaactagaggtaaacttgtcaaggcggtttgcgttctcgggattagtgcttccatctttatgacactctaatcttgtttatgtaattcgtcgagttatcatatatactttacaatctttgttagttgtgctatataacttgtcatcggctagttcttgctgttaagaagtaaccgatagggctatgttttgttgttaacttggattgtatcgggtatctaccatctcttagaagttttcatcatcttgtttagatcctacagttatctttatgcttaatgctgcatcggttaagtttgagttcgatctattaagttctatctataattgtgatatctagcctgttttataataattaatagagatagtatcggggttcagccgatcttacctgatttagctac

SEQ ID NO: 81023 - DNA, 1740 bp, Oryza sativa
cgcgtgcccgagccgcgccgctcaaatcgccgcgccgcccattgcttcccgcgcgcgcgtgccgtggtggccgaccgcctggtcgctgccgccgtcagcctctgtcgcgcctgtcgcttgtgtcgccgctccgctccacaccgccccgccgtcatcgccgtcgtcatcgcctccggccctggcctctccgcgcgcaaagccgccaaggggacagagagcagagccctcctcctctcttgccgcgacagcccccgctccccttcctccttttcccaaagaagcaaggggcgagccccctttctctccccctttttcctcctttttccctctcgccggcgtcatcctcctgccgccgttttggctgctagccggagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggacttcggccgcgccctcttcttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccctggccgttgccgtcgctcgccgtgtgctcgccgccgtcgccgcccgagctcggaagcgcgtcgtcgccggcctcgctcggcgtagttccgcccaattcgacgctagcatcggattcccgtagccacgtagatgctctcgccgccgggaatcggcccctcgtgacctcgtcgtcgtttcccccttctcccgccgccggttgccgccgccgcgattcgccgccgtcaagctccctccggcgaatccgagccgttggctcgtctcccctcgtcacgtgcaaccacccggtgtgctcgcttttgcctgtatcgccgtggttcgctccgccgctcgccgccgtcgtccgccgtccgttcaggccggcgtcgtcgtctacctcccgccggcccgcgtggcagccacttaggcgccacgtcggcgccagctcagccaagactgggtcgagccgaccccggtcagcccctccccgtgcgcgcgttccaccgcgaggcgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagctcggccgacccgccctttctctcgggccgcgccctagccacccgagaaaagtctatattccctccctcctttcttttctttttcttttccaaaaaggatttaattaaatcctttttccgttagaccaaaaatccaataatcttagaaattcaatatcttcccaaccgtaaatcgtttgactccgttcaacttccaaaattcctcaaatctcgagatccatctaatggcatgcttagaggtc

SEQ ID NO: 81024 - DNA, 11512 bp, Oryza sativa
tccatttttacctgatttttccatagcaggcagcatctattatatatattcttttgctgagatacctagcagtatttaagtataacgaaaaaaaaagtattcgtagttgggaatgaaatggctagatacaatctgaatccatatttcttaaattgatgttgataaatttaaagtaaaatctagtgaaaggtggtgcaacatatctacagctctcctgtgtattattttgttggaaactctgaatagatccaagggacaccgacataacgttatagactctacagtcggagcagattgatatcggctttaaacttctttttcttattgtaaaacaataaaagtttagcttaattggatccaagagatgtaccaacatatgcctaaagtccatgcatcttgttagaatggatttaagagatatcattactgattgaataactcctcaatttataccatgtcagagcggattgatattgttttaaagctttccttttcttattgtaaaagaataaaagtttagcttaattggatccaagggatgtactgacataccgttatagagactaaagtctgtgcatcttgtcgaaatgtatttaagagatatcgttactgatcgaataactccttaatttatatcatgtcggagcggattgatatcattgtaaaaaaatgtctccttttattattgtaaaacaataaaagcttagctttattggatcaaaaggatgtatcgacataccgttataaaatctaaagtttacacattttttacgaaatggatataagagataccgttactaatcgaataactcctcaatttatatcacggcggagcggattgatatcattttaaagatttccttttcttattgtaaaacaataaaagttttagcttaactagatccaagggatgtaccaacataccattatagactaaattttgtgcgtcttgttggactgcatttaagagatatcgttactgatcgaataactccccaacttatgtcatgtcggagcgaattgatatagtttttttttaaaaaaaaacctttccttttttattgtgaaacaataaaagtttagctttattggatccaaggaatgtaccgacatactgttatagtctaaaatccgcgcaatttgatggaacggatttaagagacacaattatcgatcgaataactcagtttatgtcatgtcggagtagattgatatcgttttaatgctttccttatttattgtaaaacaataaaagtttagtttatttggacccaagggatataccgacataccattatagactaaagtcggcacatcttgtcgaaatggatttaagagatatcgttactgatcgaataactcctcaatttatatcatgtcggagcggattgatattgttttaaaaaacctttccttttttattgtaaaacaataaaagtttaacattattggatccaagggatgtatcgacatatcgttatagagtttaaagtccacgcattttgacggaatagatttaagagacagttctcgatcgagtaactcctcaatttatatcatgtcagagtggatagatatggtttcaaagctttccttttcttattgtaaaccaataaaagtttacctttatatattttttccaactagctgctgcattttatcaataaatgtaaatttatttgtataatcagctgccagtacatactgggaagtggacaacgaacttaagcacccattccttcgttttaggcggagcaagaatttaaattatggctttagtgccacgctgtactgtagtaggacactaggacagaactactgacagaatcgctctagaaccaaaatgcatggtttggtggcctactgttaattctagctgtagctagccttgcataattcaaccttattgatcgtccatgttttccggtgaattaaacccacatgcaaacgtagtaggttttttatctctctcggttcacaaatttggacccctgaattccgatcctctgtaataagctgagtagtttgtgcaaattacgtgaaagcctgtcgtttccgtggcccacatgaactggcccccatgcttgctgactcagactccgatcacttcgcccggccaatgctccgctataaaaccctccctttttttggcaaggagttcccaccgtgagatcgagatcgcctcctctctccgtttccttttatttcccgattcgctcggcgtctcggcggcgaccttgcgcgagcgcgcgatgcggtgaaaaaaaaatcatcgcccgcgacagagtacatctgtcccttccgcataaggcaacgtcgctataaatactgccagcctcttcgttcgtttccatttttcctcgtccgctcgctctcgttcatgtacaaataggagggcgcatgcaccttgtttgccattagctctcgacgtagcctagagcgcaagcagcagcagcagctagattggttggttgccaatgatcccggccatctccccgatgatggacggcgccgcgcctctgcttcccgagacgagccccgagagccgccagcaacgtgatccggagagggggaagaggcggacgccggtcctcccggccgtcgtcgcgtccgccgtggtccttctcggcctcgcggcgctcttcctggtgtatggatttcacgacggtggagacgggagggcggccgtactcgcgcccggcaccgtggaggtcgcggcctcgtcgtcccgcggcgtcgtggagggcgtctcggagaagtccaccaccccggcgctgcgcctcggcggcggcgcggtccgggactacgcctggaccaactcgatgctgtcctggcagcgcacggcgttccacttccagccccccaacaattggatgaacggtatgtatacacgttgccatcgttcccgtggtttcatctaggccgttggatctgtaatcgcacggctccgattcaccggttatacaatgttttctcgtttctaatcttgttccctttccgtttcttttccacggacgtctcgtgcgcatggccgtgctgctcgtctttttctcggcatctacagatccgaacggtaagttgctggcgctgattgtcaatgcacggcgcaatcttgtacttgtcacgcattgacatcgatgtcgcgagacgtgacactttttttttgcacgcactgaccgggccgtcgatggatcgatctgcaggtccactgtactacaagggatggtaccatctgttctaccaatggaacccggactcggccgtgtgggggaacatcacctggggccatgccgtgtcgcgcgatctcatccactggctgcacctgccgctcgccatggtgcccgaccactggtacgacatcaacggcgtctggaccggctcggcgacgcagctgcccgacggccggatcgtcatgctctacaccggcgccacggaggagtcggtgcaggtgcagaacctggccgagccggccgacccgaacgacccgctgctgcgggaatggagcaaggcggaggcgaacccggtgctggtgccgccgccgggcatcgggctgacggacttccgcgacccgacgacggcgtggcgcaacccggccgactcggcgtggcggatcaccatcgggtccaaggaccgcgaccacgcggggctggcgctcgtgtacaagacggaggacttcctgcactacgacctgctgcccacgctgctgcacgtcgtcaagggcaccggcatgtgggagtgcgtggacttgtacccggtgtccacctcgccggccgtcgaggacgggctcgagacgtccaccccgccggggcccggcgtgaagcacgtactcaaggccagcctcgacgacgacagaaacgactactacgccatcggcacctacgacggcgagaccgatacctggacgccggacaacgccgacatcgacgtcgggatcgggctccggtacgactacggcaagttctacgcgtccaagacgttctacgaccccgtcgggcggcgtcgcgtgctatgggggtggatcggcgagaccgacagcgagcgggctgacatactcaagggctgggcctcccttcaggtaacgtacattgatcgacaacccccataaccttggtttcatatttctgataggctatagaattagtagtagttacgtataaacaaactttttttatttaattttgacaatggattgaacgagacacggatagagatacgaacccgtcaaatttctttgtgaagcatcataactgaacataattacaaaaatataaaaataacaagttatattaatctcaaatgacgtaggaaaactattataaagctgtctgaaaagccatattgatctgtgatataattcattgcaaaactaattagtcttttttttttgcgatgacatgaacaagatacttaattaagatttttaggtaactgggtatgtactatctcaattggcacagaacgagttactattaaaatctgaaaagccgtactgatttggtataattcatatatattgtaattaatttaacttgccgtatacatccctttttcccaatcatgtactgtactccattaattactgtgtcaaaaacatttagctcatactatttgaatcgctagagcaaaaaagtaaagtgactaggacgatataaactcatggaaatccattaaaaccttatgaaaataacgcccctagctaagccagctagctgctagccagctggatatgatgatcatgctgatctggctagttaaccatggatggctagctaggacccggtcattatgtagttatacacttgcatataccatttctagaccacaattccgcccactaagatataatgcaaaacgtctttacctgtgcaccacgagaggcatgcaggcgtgcggctttcttgttgcgccggccggtcgatccagaagaaaacgtgcatgaacatagttggaccagtagtatatgcagtagtccaggtctgggcgggccccacggggatcacgtccttttttttattattttttgaaaaccggatcacgtccttctaccggtctacccaaacgagttgcacgatgccgacttgattaatcggtccgagtcacgcccgcccaaccaccagaggtagccgggcccggcgagatttgcaggctgccaatagactcgcggggatttgcatgcagcagcggcgccatgacatcggactggatcggccggcgttttctggtgcccgaccgtgacttgtctccggttggccgcgagagcacgagagccgtacgtctaagcaaactagttgtcaccacgtcttagtgtggagaagtattagtactctattaattagctaaggctagagttagattaatcctcaaattgcgaagggttttttttatgcgtccataacgtgtcttgcattggcgcatagctagagattagctaggacatttacttgacgaaagggggatttgagtaaatttctgatttgctagagtttggaattccaaacaggactattcaaaggggttgttccaacgaagcagcacgtggataatgacttgcttagcatcaggaaatttaataccctgacctgtcgctgcaatcgtgttgtttttttaataatccgtaatcatttgaataacttagtaatttcgcggtatatgtacatgtcattcttgtggcaagcgtgaaagtgagttcttgagtggccggttcgactcctaggggaattaacttcgtttttgagaaatttgttttacgttatttttggaactaaaatgtttggcaatttattttaatcgatgatgaaatcaatggtttttgtgaaatgaaaaaaaaaatccactcatagttattctaaagatgaaattgaggagttttcgatatttgtactatactataatataaaaaaggaaatcaacaaacgtctcctttctcagttggttaggcaagttgttgtgatgctaataggctacacaagtctaaccgtgttatctaagttgtaaagatacttgagatgtattttaaaaaatatatggaaatggtaattgagtgagtgtgttcaaacttgaacgcggtccactaggtttctaattctaaactttaccaactgcgcaaggtggagttatcgaaattaggtgatagattaataagtaaatgcactttcttggtggtaaagatacttgagatgtattttaaaaaatatatggaaagggtaattgagtgagtgtgttcaaactcgaacgcggtccactaggtttctaattctaaactttaccaactgcgctaggtggagttatcgaaattaggtgatagattaataagtaaatgcactttcttggtggccagttaagttgtaaaaatacttgagatgcatttgaaaaaaaaagcaccatggtggaaagggtggctgttggcgagtgttttaaaactcgaacgcggcccgctaggttcctaattctaacctttgccaactgcgctaggtggagttatcaaaattaggtgatacacaaatttataaatgcactttcttggtgaccagttatgcaaatacactagacttctattaaaaaattatggtggaaaaaggtgagcatgataatttttatattaaacgcaaacgaaaacaagggtgaaaaggtgagtgtgctaaaactcaaacacaataaacaagggtgaaaaggtgagctgctaaaactcgaacacggtccgctagtctgtctaactatagactttgccaactacactaggcagggcttcttaaaaaagcagtggactttgagtaaatatacttccttggttagatggccgggtatgaaaatatcctagaattgtatcaaaaagaatttgggtgggaagtgagcgtgttaagactcgaacccgggctgttatattttacaactctactatttgccattggcgctaggcgagtttatcagaattaggtgataggttaaccaataaatgcattggccttttgttaaattgcgaactatacaaacttactaaaattgcatctttttttaatcatgctaaaattatgtatttttatctgaatgactgtaaaaacttgctaaaattgtatatttttaaaatcatgctacaattttgtattttgtctgaatgactataaaaaaaactaaactgctactaccatctctaaataaatgtaattttaggtgatccactagaccattttaatactagtttatcttttttttttcgttttctccaccacaaggacatcgtagttttttaatctcttgcttaataatatatctttaactagttaaaactatacatttttagagtcggagggagtagatccttaactgtctctccttcaatcattcatgtcattgtccctttttctttaaatcttatttttttcctgttttaaattgttgttgaattcaatgtgcccttgatgggccttgaccgaggcccatccaaacaaggcatttccctttatttaaattaaccttttattattattattatttgcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacaggtacgtacgcgtgattttgacacatgaacacaaaatgtgtcatacatttataaaaaaaaagtgtgccatacacatacacaacaactgctatatatccgacccgagaaactgacgtgcaagtgtggttctggtgtgcgtgcggttgtacagctggacatcgaggccgtgttcgaggtggacacttcggcagccgacggtgtcgtcacggaggctggagcagcagcatacagctgcggcacgggcgacggtgcggttggccgtggcttgatgggcccgttcgggcttctcgtgctggccgatgatcagttgtcggagcggacggctgtcttcttctacctggtcaagggagtcgacggcaaccttacaaccttcttctgccaagacgagctcaggtgtgtgtggtacacattttccagtatatgcgtgcatgtcttcctctgtgtgcacatatttttgcaaccaaatattcacacttgatcttgttattagaggatgtattttttttcgatacttcaatttgtggacagaggatgtgtgctgtcgtgtgtagaactccttgtgtatatataaaggaggcttaaattttgctttaatcgagtcaagatgtaaattttaatgcattttaaatcttgtttttttttcaggtcatcaaaagcaaacgatctagttaagagagtctatggcagcttggtacctgtgctagatggcgaaaacctgtcaataaggattttggtaagtctttctagcaaatgttgagtacatgcatattcatatgccacaacgcatatattttaatacgtcgtaacctacctttttgtgtgaattttctttcaataggttgatcactccatagttgagggcttcgctcaaggagggaggacatgcattacctggcgtgtgtatcccaccaaacccatctacgagtaggccaaaatctttcttttcaccaatcccacaaatgtgaaagtcactgccaaatcgataaaaatttgggagctgaactctgcttacatccgtccatatgtagactagatcatttttaatgtaatgggaatgaatgatttgtatacatttgttagttatgtttttatagactaatttatcttttttgcttccttctttatgtcaaactacaactatgacatattactagcagttgaaataaaacataatcaatcatattgttttgcctcaattttgttattgtgtgtgcgcatgcgcacacgtacgtgcacatgtgcgtatgctatcactctacccctgatgttattattagccatcaccgtaatgttgtcgtaagccaattgtgtcatgtttatcctacataaacaatatacgactttgcgaacattcctcttcaacaatgccacaaatttagggcccctagaaaatcactcaagattttggagctaaactctacttaagttcatcaatatataaactacatccttttaaatgcaatggtagtgtggtatgtttagattcattagttgtatctctatagtcaaatttgtttgtcttcatctttctacctatcaaaccacaactgaaaatttttagtcaaatatgtttgtttgctttcttcttcttatcaaaccacaattgtaaaatgtaactacaccttgaaagacacaaaattaatcacatatttctattttgtaatctaatttgtttgtttgctcttctctttctatcaaactccaactagaaattgttagtacacaatttaaagacactaaaaccaatcacatttttgccacagtatttataattgtgtgtgttacatttgtgtgtgtgtgtgtgttacatttttgtgcatgtgcattatatttgtgtgtctctgtgtgtgtgcgcgcgcccgcacccctactctggctatgttatcctcactcctcaccaatagccataaataaagtagtacaagtcatgccattcaaccagtcaatcgcgagacttcatctatacctaacatctacctagtggttgttagcaagtggggaaatgggtgagctcgtagcctcgtcatctccggttcaactatggacttattcggctaacagtttctgtggctgcatggcagctagctgtaggagcaaaaggcaaaactgtcctcgcacaacacaagcgctgcaaatcgcaggaatgacttccgaacgtgtcctatgtcttctaggacctctaaaaagtccttcccactttgatgtttgtttggatggccttattttcaattggaatcatttgatataaccaaaataataatcctttatatatggtttctctctaccatgtatcttgtttgaatccaatttatcactagattttaagaatcgttgacatcattatactagataatgattattaggagaagattcttacagcctgaccaacattaatcatgccatatacatacaacttgaaactatcaaaaccaatattatgacaccatacttcataacttgaagacaaattaacaacaatcacaatgatgccaattacctatcacactccatagagcctatagtcatgcgcaaaaactcacaccaaggcttcataaggtgtttgttccaatcagatgagactatatcagatatggcatgttaactgtcttttcctccccataccatcattttttgtaaaattatccatgaacaaattagtttgtgaaatttgaactatagtcagctgttgccggggtattatttttttatataagaacaagaagaagatgccttatttcaaggaaaaatgagaccaaaatttgcggtgcataattaattatacaaaactaagcaaaaaccgcaactacaacacattcgtagccaactaacctaaactaccacaactagaagtaagacaactaagctcaacactcaaactctgttggccacaaggcattattgccacacgttgttgatataggtgttgtagctacgagaaacaaactgaaagcatagacccccacacgttggcaatgacatgtcactgtcatcataccatcgcccacacgatcaagtgacccctaattcgctaggaagcaccatagcaagaactatacaacttgctactctacaccgaagtgaaacacgattgacaggtccgacatgagtcgtcattgccgagttcacatccacgcagcagcttcaactttcctaggagacaacagccaaacgcctctcccaacttgtcatggttacggataagacataccttctatcctacgacttataaaatatacggatatgtcatacttttgtatgtacgatacgtttttgtgtatgataaggaaatcgacaagagattatggaaataaacctcacgggcaagtaacgtggtagagttctactcagagaaggttgggattataccatatcgtgtaggatacagagtctcccagtagacgttctacttggagacaaaggggtccaaggtataaatagccaccccctggccgggggggggggggagccaacaccaccaccatagcctacaatctggaggacttgaagcctactcgttgggagatctcgtcgaaaccatctcgacaaggatctcgctagtaatctcgggattgactgttctctattgtaacatgtgattttctatatcaatctcatataaactggattagggctattaccttacgagctaggggcctgaaccagttgtagcgcccgttccgtcgtggcgcctagcggaaaaattatctcttaaaaaccctaattgcgaaatttgtttcttcgcttgttgtctagtgtccgtgccatctcaagatctcaaatccccgatctatcgtcaagttcaattccgaatccaaatccttccaaatcatatccatccccaaaagtctattttgcc

SEQ ID NO: 81025 - DNA, 20622 bp, Oryza sativa
tagtttatatataaaatagtatatcttgtcaaatacaaagtacattgataatataaagcaattgtctaacttgacagctattaagacatattgggcatcctatttcaaagggtaggtagtggattacgtaaataaatggttaaagttaaacacgtcctgcaaccaaataataaattgggtttttctcctagtgttattgtagtccgatagaacacaagtagttaactcaactcggttttagaccaaggtttagatctgacaaacacaacttaaaatgtgagagtggaacaattgttcaccccgtatatttataatagcaaagaccatttgcaaatacccctaaaaaaagagctgcccaaggttcggcataggcttttccccaaataagtcacgcatattaccaagattgggacttaaatctctcaaagtgaaggtcagaaaggatttcaagagggtaacagcatgcagaacaagaacatgggtattttatagagtagagctggcgaacaagagactctgcatatgttcttctcccatgcatattgcaacagaaagtctcaaatccaccaagtatgaaatgaatatcagaaaaagaatacacaagggcaacagaaaagaattgcaagttagcgctagaccgcttcttattcatatcagtaaattactagaaatcgattgcaactccaatcaaccacagatgaagaatagcataaacgaattaaaaagggcagttgcatacaccgtccgtccccaaaaaagaaaaattacttctggctatgtatctagacatagcctaaataggtaggcaaaagttttttttttttggaacggagggagtagatcaagaacaaaaatcccccttttgcacgcatgggaaatagaataaggatacatgaaagaaagggggaaaatcaataggcgtaacaaatgttaaactactgataataaactatgggtaaacaaaagaccaaactttatggctattacagattactttcatctcaaacccactaaatctcaaaagctggaatcattcttgcaagttagaaggaaaagagttcagccagctgtttgggacaggagaagggaagaaagaaggcggtttcgtgagatttcgtccagcgtgcaatgtgttactctcgagattccatgagatttcttccatagttcaatgttttaggttagaagcacaagaaaagctaacatacaagccttttcaccaacagccatcacatatggacatttcactcccgaaatctcaaaatgtgttactaatatacctagcaacccaagtaaccttgtgagagaatgggaatacccacaagcaagccaaaggtttctaaagagtctacagaaatgaaagaaatatgctctaccaagccaaagcatgttgacacaggttgtatcatttgtccaaatcttactattaagataagtccattctcatcctatccctttcctctattggcccagctaatcccttctctccttgcaactcttggttctttttctagactcgataaaccatagccatcattgacaacaaaatatatgatgcagccccataatcaaaagccttgtcctgttgtccatctataatgctacaatttgatgcataatcaggtctaccacattcacacacatacatggacagagataagtaccaaaagccatcaaatttgtataaagtgaattatccttctttcctcatcgaacttagacttttggattgaactggtcggtgcatgtaactcaatatggtatcaaagaagaggccttgagttcaaatcctgactggcatgcaattaaataaaaaaatacagcccacttctaaatattccacgctagagacttgaggttgtctcgtgtgaaggggagtattggaatacaaagtgaattatccatcttttctcatcatttagtttttgagttgaactggtcggtgcatgcaactcattacatcaaatctaaatgagttcatccatgaacaacataatctgagattaggagtatacctcagttttgggaggcgttggggaggggaaatcgatgtcgatgcaaacttgtgcgccgaatctagctgtcctatcctcgccgccacctactcgctgcgtgagccaacctgtgctcgtttgtcgaccggccgccgcctccctgctcgccgcacccgtcaatcgcttgccgcctacctgctcgccccttgtgctagcctgtgctcgctcttctgccggccgtcgaccccctgctcgcccttgcgtcggcctgagttcgctctggcttccgccccctgctcgctgcaaccgtcaaccgaacggcgtgattttttaatattttctaaaccttttgaatatataatattttaataatagatcctattagattttattgtcacatctgaatttggaccacgtcgagaatacttgcgttaccaaataaccgtaccacatcacatgcataggcatggcagaacacgccacagccacgtggaagagtgtgataccaaaatgccctacctcatcggcttcgttgccatcggctagtgggatgccgtggcacgggggcggccactggacgctgatgtggtgtgggcttgagcggtgctagaagctcctgatcgtcaggtgatgcaacaatcttgcaatgcttccacccatgcagcaccaccgccccgcagcgccaccgcctcctcctctgccttcaaccgcaccagcatcaccgcccccttctatcccttcccttccctcacccccttctcgtccagcttcctcttcacagaccgccggcacatcacgaccgcgcacatcatcaagcaacacgagcacgagctaccctctgccatcgccattgtcacgcccgaaaattcacaagtaatttccgaactaatttgtgcattaaaccctcgtccagaaatcagccaaagtacacaaactgacaatttaaaatgcagattcatcataataactaaagcgcttaaatacttacataagagacacttagtcatcaccacgaagaaaactgcagcggaaaaacttacataagagacacttagtcctcaccacgaagaaaactgcagcggaaaagaaaatctagcaaagcttcagctccactcccacaggtagctcaattgggatataagccaaagatcttctccttatggatcctttttctccaactgagatttgatgattattgcaaggcgattatatggaataatccgcaagccacacaacaagtatgcaagtgcacagggataacataggatggcataatgttgggttcatttgcgaaagcagcatatggcaaagagttgtgaatttgtaaaatagtagagtaattaattaaacagtattaatgcaacactatacaacatactcgttgcataggcccaaccatatctgtacaaccatgcccggttgaacagacccaatcttcaaccaggaattaaccatttcaaaccaggagctaaaccaaagtatcatcatttatcacaaaaaaattgctatgctcgtccatgaccgcgggcacggctattcgaatagttttacacaacaagtatgtaagtgcacagggataacataggatggcataatgttgggttcatttgcgaaaacagcatatggcaaagagttgtgaatttgtaaaattgtagagtaattaattaaacagtattaatgcaacactatacaacatactcgttgcataggcccaaccatatctgtacaaccatgcccggttgaacagacccaatcttcaaaccaggaattaaccattccaaaccaggagctaaaccaaagtatcatcatttatcacaaaaaaattgctatgctcgtccatgaccgcgggcacggctattcgaatattttaatatggccagaggtgtaccactgtacccacaagacacaaccccataacatgttaacatgccctcagtaccaccatggtacctcgaaacgggactatgacaaggcacctcgcataaagcaattcaaagcaatgcaccattcccagatcatagtcaccccctttagagcaaggtatagactccccagcgacccccatgggattatctccgccacttctcagtctagcactccacaatgaaccatgctatacatcgcatccagttgctgcccatgctggcttatggttagtacggttaatgcttcacaacagtagctcgccaaccggttcttaattatcatgagtacgaccttcaaaaccatgtactcataacccaccattatcaggttttagttggcaaattaattaattaaccaatcacgattaaccattatgagctatcactaaatattcatcattaagtaatagtgaaacattagttatgccaatactatgctaatgtttctaaacatggctaagcaattatatcaaatatctaatataacgcccaagctagtcaaataataacccatagaataataaagtcatcttcggccataatataaggaaaaggctcacaacagctaatgacatttgaaaataaatgtatatttgaatgaaatagagaatttaaacataggttcaacatgctcagaggaattatgtttgggatctgtatgacttgccttgcaatcaaacatcttcaatccatcttcaggagcttatccaacgaacgaacggtcctccaaaacgacagaaaactaaacctggaacacaaaatgaggaaaaacactaataaaaaccaaataaacaatacaattaaagttcataaatgggtagagattgaatttatatgaattacgagacttgaacgacctcattccaagtttgtatgaattagttatgaattaatgaagttttaattgattaaaacctataaagaaaacaacctaaatgatttattgcatcatatttaattattttataactgaaaaggaggaatatgacatcagcactaggatagaagagtgaaaggactggggacgagtgggacccacttgtcatagagacaagcggtagaccgggtctaccatgacccaactccacaaaggtggtccacgggtccacgggatggacggctcagatcgagttgaccaagatccaacggacgagattagttctggtctaggttttgaggtggatgccatgcggatagaggtgtgacatacaataaggccatggcctacgctccagcgtggagcgtggtctcaccccgcccgaggggaatattcccgccagctcagacgggaccacacctcagcagaggtgcgcgaccccagcagaggtttgcgtggatttgtcagagtggggcgaggaacgggcgaggagccatgttgagaggcctcgtcccgtaacgtcaccccggacgctgcggacaactacctctcgcgccaaggacgaagatggcgccgccgcggcccaatctgccaccgacgcctccatccgtcgccgttgccactcgatccggcgccgctgcatcgatccgcccccgccgccgcttgatacgccgttgccgcctccatccgacaccgccgccgccggggaggagagcgccggggaagggagaggtggagagaaaggaggcacagagagatatggtgatgagaggaggggtcggtgtttatatatgtttgtgatttttagggggtatactgcaaatattggacttatatgcgaataaaactaatctaagggtttaatgcaaaatgtgaccgacagataggtattgaattgcaaaaataagatggaggcatggcttacactatgaggcatatccctagccgggtctttattcacttttgctcacgtggatgttgggggtgctccctgcgttggcgatggcctaaggtgtcagctgacgtggacgcacgcgggatagacgtcgacggcatggtacgacaaccacgacggcaaacggcggcggaaaccgagagcacggggaggaagaggagaccgaggccatccttaccagtacttacaagacgacagacggtgaacggagacggccggctgcgagctcgggtcggcggctttctggcgacgacgggcggcggcaacggaggggtagacgggcttctcctcggcgctggcgatgccgaggatggcgatggggggaacaacggtgggtcacggctggaggtcgatgggaggcagaggcgctcgggttcgcatcagcgagcagcttcctgcggtcttcggtacaagcgaaccggcggccgaggtagccctcgcccttgtggagccgaaggaggcaacggcgcaaggcggcgtcgaccagagaggcggcgcgacgcggccggagttggcggcggtggcggacagagaggaaactcgcgggaagaggtggctaggccacggcggctcggggacaggaggggaaaccgaagaggagacccgggcatcatttatataggcggaggaggaagagatccatgcggatttggggtttcggcggtgggaaataagggttcccgagttcatcgggataagaatggggccgaaatccagcgcgaatttgttgggggctttcttgtggcgaacgtagaggtgatcgagggaattccgtttccgcggagcaacgacgaggccgaatttggtggaggtggcggcgttgatgtgcacgggcacggccgcacgggagaggcggctgggggaggaagacggcagtcacggcactgtagccgggtgggccctaggcgtcaggagaatgaaggaagagggacgcacagaggacttcggacgagaaagacgggcgcgggctgcgggctgaggaaggagagaggagattagtgggatggattcgttccaaaactcagggaaggaattttagttgattttctatttcaagtaattactgacatgttatttcatttattaaaaatacttaccatactcaaataattccaaaaaaatcctgaaaatacttaggatactcaaagtatttaataaatttttatctagctcaatttaatgttcgaattttttatagattttattcaaacacttactttcattattaaataatttctgaaattttctttttcaccacaatttataatttagctattgttagggtgtgacagctgtcactgctgctccagccagtgggttgtggtcctcgtccatggccgctcctagcgcgtttggggcatttttgttccatcaccattagagatggcaatggggacccgatcactgattccctacggtgaattcacatattaggggatggttaatatctattctccatggggaatcaaatggtcccaaactaatcaccatcggtgaggacggtgaaccattcgccgtccccgcctcccgcggtgacacttcttcagacgtttcgacccataatattgaagcccaattaacatgtatatgtacatctaaccctaatcaactagtcaacctccacatcttccagatccacacttccacaaactccacaccaggcgcgcgcgcgccgccacctcctattgcgcgggctctgtctagccccagctgtcgacgcgggcgcacgtctgcagccgtcgcatcgcccgaagccgctgctcgaagccgtcgccgccgtcgccccgcccggagcccgctgtcatcgtcgcgctgttcgtctgccatccgtcaccagcgccctctgtcccagtcgtcgacgcaggcgcgcgcttgtagccgtcatgccgctcgaagctaccgccatcgcaccgctcgaagccgccgcccggagcccgccgtcgtcgtcgcgctgtccatccgccatcctccaccagcgccctccgtcgctagcacaccgtccgtcgccaacgcccttcgtcgccagtatgctgtccgctgccaccgtttctctgccggctgctgagtgctgactaccgcaggacgggggtaaccgtgggggaaattcaccgcgtggggatcgaggctggagaaaatgtagccccgttatggttgacgggggcgaggacggtgaaattttatcaccgtggggacggggacgcggatgtgacccccgacggtgaattcaccgttgccatctctaatcaccatgtagaattgcgaaaaataatttaaaaatcaatggaaccaaaaaataattactgttttgatactgttcatgggttgattccgcacaatggaaccgcgtgactaccgcgtgaacagtattaaatcgctggctgcgggaccgttgcagtgccatgcgaccatcccgtgggccgttggtcccgcgttttggagctacgagatcatcgcggtcatgcgttttcaccccgcaggatgggtttatttatacaaatccttcccatgcaggtatataaacgtaaattacagaaaaaaataagtatattttgcaattttttattacagaaaaaaaataagtatattttgcaattttttttcttggtcttctttttttttgtgaactaggagagcaggagctcccccatttccattaagaggaatgatagaattatagtatccggttctaggcagcagatcaactttcttcgctcaccaggcgcgccatcccaccatggctaagaaagtaagaagagaggctaacaaaaagaataagacatacttgcacaccaggtgctcggtggcactgtggcagtgttcaggttggctacaaagttttaatttctcccacaaggaaaatccccagggttaatcaaagctgcgctaagaaattgctcgactcatttaccaccatggttatcttcctgtcttggagccccaaccatgcctggtgctataaacctcatttaccactcgttttagcagtctgcccccctcctgcagtcttcttgtttcttcctccttgttttgtaaaattgcccaatcaaagatacaatgagctacctgaaagattacatctacgagatcattaggaagaatattctcaaagcaggccattttccaaattgcccataaagcagccgcaataccaacagccactagctttgttataaaaataaatgcacaacagagatataatttttatggggaaaaccctttcgagaaaaaaccacggtaccgaccggtagcgatcactattaaggagttgattacaagcgtagtggatacattggactgtcgcaccctccccatccggcttacaagggatatatatagcaaagatctaggagtactagtggggaaagacttaagagtcatactaggaaactaatcggaaaatgcttacgatcggcatgccgatttggagagaaaaatcgggcgctctcctcttactataatgtgcacgcagataagtgctaggtagtttctcttctttcttctcctcactttaaatgttttttttctcttaaaccatttgtccgatttacgatccgatcacactgttatatttattataattaaatctttacaataagatattgcataattatattctgataaaagaagaatatatgtttcaaaccgttataactcaatgtttcatacgtgatagtgacatgtttcatcatgtgcttttgctatgtttcacaaaattcatttaactacttgcacatactctatctctctccactccttgcatgcatgcatgcatgtatttagctatctttaaaatgatttttctcctgaactacttattcgatctacgatctgatcacaccattctatttattgtaattaaatatttaaaataagatatcacatgattatgttttgatgaaagaaaaacatatgtttcaatctgttcatatttgatatttagtttcaatatgttaatatttgatgtttcatacacgataacaatatgtttcaaggtgtgttttcactgtgtttcacacactttttaaatgttttaatgactgatttttttttcaccatgtataacttaatgtttcacaagcggttaactgaaacatttgaccgtccggttttttgagagaggatcggatgtccgattggaaatttcctcccacttcttcaaatattttttcttctaaactaattatccattctacgatttgattacaccgttgtgttcgtcacaactaaatctttataaccagatgttacttgtttctattttgataaaaaatcaaataatgttgcaacacttaaaataaattgtttcattacttggtcaaatgttctatttctatgtataaaatgttttaaaatgtttcaaggagatacagcattcataatttgttattgcaaccctgacaaccgctccactaaaaatttttctatcatgtaatgaaacatcgatataaatcatatgaaacacaatttttttttacaaatacttgaaaatgttgaaacattattatatcatgtaaggaaacattaacttgtgactactaaaacatcataaaatatttgatgaagcattcgaagaacaccacctgcagcattttaagatcaactagtgaatcatcctaaaatactacctgaaacactcaaatataaccaagtgcaacatataggcctgtttggtacagctccaactcctaaatttagctccaggagttgggtctggagtggagttgtggagctgccctctagttcattttgtaagagagctccacccagctccactcctagttttggtggagttgaaactgtttggctgagctccaactctaggaggtaggggtgaaaacggtacggaaacgtacggaaacaacctttatcgttttcgttttcatatttttttttggaatcggaatcgaaatcggaaaccccaaaaacgaaaacggaaacgaatattattgaaaccgaaaacggaaacgaatattattgaaaccgaaaacggagcgaaaacgaaccgccgcggatacggtaacgaaaattcatcagaatacataaacccctcaaactgagcctcacagcaaaaacatattcttctataacttcatataatttgcataacaaatattctaaaaaaaattatagcaagatactatggtataataatgtatagagtatatatagcctattattcagtgctttcactccataatcagtacatactacatagttctcttctacaaaattaacagaagatatcattcatttacacagtataaccaagctccttagtacaaacaaatcaatcatttacacagtataaccaagcttcttagtacaaacaaatcgatcatttacacagtaacaactaacaaagagtgatagatagagctggaggttgaggaacacctgcttactgttgccgctaggctgctggaggcgttggcgtcggctcggcatcgatggcggtgaggaagccagtggggcttgagatgtcgtcggtgtggtgtggctgtggcctgtggtctcgtcgtcgatgtcgcgtcgtcgtcggtatggccggcgtcggtggtgtggctgtggcgtcgtcgtcgcctcgtcggtggtggtggcagcggcgaaaaggcgagaggcggcgggacggcgccgcgagatggtgggggcgaggacggagcgaagaggaagggcggcgcgagatgcgagacggcgggggcgaggtcgcggggagccaaggaagcgaggacggcaggccggcggtgggtggtggcgcgctctggatgcgccgctccgccgccgcctctggatggcgatgcgccgctcccggcctccctcccgatctgtctgacttctctctctccactctcttctcttgggttagcagcttgggttgggccggctggggacttggggagggattatggactattgattggatgggcctttttaacttcggaaatttcgacaaattttccggaatgtttccgaccgattccgagttccgacgcaaactgcgattatcatatttgattccgtttccgagaaaatatttccgttttcgattccgtttctgagaaattctgaaaattttccgaccggctgattccgtttctgaaaataggtacggaatccggaaaaattccttaccgttttcacccctaccaggaggggtggagctggagctgtgccaaacaggcccaaaatatctattgaaaaaagagctaaatattttttttccgttggaatataatcatgtctgatcttgttgtaaagatttaattacaacgaatataacagtgaaatcgaattataaattgaagaagtaatttaggtgaaaaaaatagtttcaaatttgctaaaaagacttaaaacaacctaactaaccctacagaaatctcatgcatgctcctacaacactgctatgtgaagggtcaacgtgagagaaaggggtctgaccaatttacatgtaaaggagtggagtggagtgtgcgtgtgttgaggagcgcacgattttttagccagttatcgggcgcccgatccgtagtcgtatcaaactaatcctaatagttaagttagtattagaaagacttatccaaatacattgcagatctaaaattcgaatcacatatttaacaagctttattgtcttttgggtaaatttcttcatccaaggtcccattaaattctgcatcccatttggcatttcacaatcaaacacacattttactgtactccaaacgaatttggcaatattttcaatcttattagatatcggaattgctgtcatgtacagattatttcagccaggcgcccaagctagctattggtctccatgtgttctgcgacgacgatggctgcattttccccgaaaatatgttcagactgaagagagagacgaagaaaaaagagaacttggttgaaataaacggaagattgctacgttctcttctttcatgtgccgatgtgcctcaagtgtcggtttccaaatccaatcaaccccttgagtaaagtagtacgtactgtatgaggaattgacgattgatcttaagaacagactcatcgatcatgaaagattggttgggattgccagtgagctgttcagtacagtatgcgtcgatctatgcgactatacaccaacggtatctcgactgtaaaatttgctacagaagcagagttcagtgcctggcaaaatcattatgatgtaacaaggccgaagagcgtgcgaaaaatagagttggaacagctcacgacggccagttcctgtaccagccggcccacgccgagacgagcccactgatccccaacgtgacagcgtggttgcagaacgggttgggctcgatgtccgcgatgccgatgacgaggtcggcgacgttggcggccgtcgccatgagccgcatcaccctgtccatccggatcttcttcacctccttgtccttgtccttcccgccctccctgagcagcttcctctcctgcctgaggcccctcctgatcatgatgaggtccatggcgatgaagaacacgtagccgacggactcgccgaaggcggagatgaagctcatgcgtcgcgcgagccaggcgtcgaggacgccgacgcgggagagccacgtgaagtggtcgaagaagaagtagaccatctcgccggcgttggcgagcacggcgagcgcgccgaactcccccggcgcgcggcgcagcccgttgagccccgtgaggaagcggcccgtgcggaaggccttgcggctgagccccgcggacgtctcccagttcttggcgcgcccggcgaggcccgggctggacgactccgccgcccagtgcgcgagcttggacacgtactggaacgtcttgaccagcttgtcgatgccatcgcgcttcgcgaggaagaccacgagcttgtcgagcgtgtcgccggcgctcatggctgcggctgcggtggcttggaaggctcagtgggagagcgcgcgtgcatgggagggagagagggcgccctctggcttgggaagtgagaagcggacgcggcgtgtgtggtttggtttgggataaagcggccgtggcgggtacttggctgggatgcgtttgtcctctgcgccagaagtgattttctggtggtggtgaggattgagatcgagggctcggtgagagttctacccatctttgtttgcttgcttgattggtcccttgtcttgttattagtcttttttatttttgcaacttgggctctcttatctttatttctccgcacaatgcatccgtaacctatgaattgttggggggaaacactaggcaaaatcatgtcaagtagcaacaccatacaaggctgaaagtgaacaactaggcaaacactctacctccctctttcaaaaaaagagaaaactgaaaaagtagtagtagaagaagaagaaatacacatatttttgaaaaaaagagagagagagagacaaacactattgtacagttcaaggcttcaagcccatagattctctaccaaaaaaggttcaaagcccacaggtgaaattccgtatcccacacggcccatcaaatctcattgttgcttattgggccagttacctctcctccgtcttcccccttagatgaagctgcagtgcaggttcagggggcagccgcgacctgcgtccgggactccggcgctgcgacgacgacacgttcagagactccgggctcccgccggcgagaggccgagggaagtccaatccggttagctctcgctctctcctgcctattcctcgctcatacgcatatgcgtgccttagcggaattggagtagtgcttgaaaccttgtgtttctctttagtacctctggatctgatcaaattggaggcttaggtgtgtgcaaggttttgccgatgtttccaaatgatatctgtattccgcgtgtttgcatacgcggttatattttcagcaggaatcgtccatggaggggcggaaatcaacttgccttcgataagggcaaagcctcgtttgataaaatggacagttaaggatttgcttgtggtaaatatgtttggattttagagaaatatttttttaaccagctgatgatttggctaaggaatttgaactcttgcgcacttctattggtcgtagatttgggtggtcagtattgcttgatgtactaaccggatagtctgttattatggcaattatgttgttatcatccttctgtgatttgtctgacattcagagcgaagcttaattctcaattatgctcactgtatctttggttggccctttaatattttcctagtcttaggctcttagcactaaggatttcaaccgcaatgatcgtttttacctgattgtgcctcacaatgaccatgtctagttcgatgcaaaatacagttttgtacgtttctttttacatctattcatgccatgtactcccttagttttctgtatgttttgaccagctatagtttgggacagaggaagtagttccgtaatatataatatgcaaacttttgctaggtgtagcttgaagttaggatgagtgtgaccacagaaatacataattgcaaagcatttggaaagctgtgttccattatattttttcgggaatacgcaaggagcacatttttgtattaagagaaataaaagttatttacatggaaatacaaaaacagcaggggactgaaaccggaatgaaacacaacattcattagcctaaatcttgcactagttttggcgaccttgatccctccggagaaccagggaggggatagccgagtttgcttgacgccaaagtgtcttctcctccgccattccccttgccacttcaacccaggtcctgcgttgctggttgaacacccggccatttcgttctttccagattctccggaggaaaaaaaacatttagaagattcaaacacacaaacctcagctgattcctgtttcagccaagccagctgtgttccattataaacaagtggcaaagagcagaaaacacacaaatagatgtacatggagttgtgatcttgattcttgaaactcagttgaatgagtatcataaaacacttagtgaagttaactgatccttgagttcctattgtattgtcttctttgttgcgcaactagtctctgtgatgtaactctttcatacatatggtattcatcacttggattgattgatatctttggttcagagctatccgtcaaatggctgtgttatatgggaaaaacaaaactaagccaattgtagatctatatgccgtcttttgtttcgttgttgttaacctgatatcatactggataacattccattgtttctgtctttttcgtgatactgttgagtttttgtttaccaatatgctatgtatagtaccatagttgaggcacttgataactagtttgttttgttccctttgcagtgttgaaggcacagatgtcatcctgtaccatggcctctttaatttgttcacagataaaattaagcaaagcacatattaggaacaggagacagattcatgagaatggacaaatcagattgcctaaatctctttattggaaacctctacactctggccattttgaaaatattgtcttgcgatgcactcaaaatttgtcttgggaggcctcccttccatatgcctctgcagaagatggtgccaacattattaagggaactgaagttgttgaacctattgatacagaagaagcaccagaaattccgatcctccagagtgaccaggattttgtggaggtgataaaagaaccttccatgcagctgacaacttttaaactgccaatttggcttttagggccttcaattctgttggttacgagtatagttccaactttatggctaccattgtcttcagtgtttcttggtcccaacattgccggccttctatccctagtgggacttgacttcatttttaacatgggagcaatgctgtttttccttatggctgatgcttgtgggcgtccggaggccaattcatccgaactgataaagcagatcccaacttcttacaggttctggaatctggctgccagcatagtaggctttcttgttcctttggccctgtttttcgcatctcataagggtactctgcagccacatataccattcattccgtttgcagtgctgcttggaccatatctcttgctcctttctgtacaagttttgactgagatgcttacttggcactggaaatcgccagtttggttggtggcccctgtggtttatgagggttaccgagttctacagctgatgaggggtcttcagttagccgatgagatcactgcgcctggatggatggtgcaaagtcttcgtggtttggtgtcatggtgggttctggttctaggcatccaactgatgcgcgtggcttggtttgctggactcaaatttgcaagcacttcaaggtacggagcaagtgatgataataagtaaattcggacaagaaaaaaatgttcaggtttacatgttttgctcatgcctctgccatctgcagcacgaaatgctattctgatgctactcctggcaccgtctggggttgctcacaggtgccttcttcatcaactagttcagtagatcgtatagacgaacaattatcagactgtgtgtaatcactcttgtacatacaaagtttttttttataatacagaaatatatgtctttacatttcctcggtgaaggctgaattgcattgcacatatgctattttctgtttcaaactttttttcacaaagcgcctggtggtattcatgtactacttgatactcctagtactacaaaccaagcaaacgtttgacaagcgatgtgtgtcactgtggttgtgtttagatggtggaaaagttgggaagttgagagaaaattgatagtttggagaaaaaattggtaatttatgtgtgtaggaaagttttcgatgtgatgtgatgtgatggaaagttaggaatttgggggaaattaaacactgcttatgttttcaagccaatccgacacggatataacaccaaatcacccaaacacacggatgtaagttaccgtgtctgttcacccacttgatggggagttgaaatcctcgtcccgaaatgtgacgctctgcctgcaatcatcaaatctgaatctgaaatgaagattgaagaacaccccaactgtcagaaagaaaaaaggagccacgtgagcactacttttctttctttgtttttctcaaatctaccattgccttaaccaaacaaacatgtggccttttccagaaaaaggaatgtgtagtgtagttaattactacactaggcttttgctcgtcttccgaatttccgatccacctcgcgcagccgtgctcgtgctcgtctcccccaccaaaagacccacccgaccgggggcgacaccatcacacaccaacccgacattccctcgtgctcttcccatccgcgactccaaaattcccgtccgctcctccaggcaagcaagcacggaaacccactcatcactcactcactcccccaaacccaaaccctagctactactagctccccgctccggatcaagcgcatctcgagttcgagcgagcattcccctcttcggttcgagtgggttggctggcggcagatgggctccgactccaagaagttgctcgggatcgagccgctcgagctccggttctcctgtacggtttcctcgccggaaattccctgcttgtgaaattccggagccacatgccgctggggttttgtttgtttttgctgattcttttgctgtttggattgagcagtcgagacgaagaagcagatctcatgctccatgcagctgacgaacagaacagatgactacatcgcctttaaggtaactggaatctttttcccccacgaagaaattcagcaatttggtttcacggagcatagagcttgggaattctgcaaaaaaaaaaaaagaaaaaaagttaatgagatttgacgcgctaacgctaaatttggtgaaatgttgtgctccttaggtcaagacaactagcccaaagaagtactgcgtcaggccgaacagtggcattgtgccgccacggtccaccagcgatgtcatcggttatgctcaattctcatctccttcatgcaaaacgttgggatattttcctcgtcctgttatctgtgtgcaaaaaattgacagttctctgcatttccttagtaacaatgcaagcccaacgggaggcaccagcagacatgcagtgcaaagacaagtttctagtgcagagcgttgtggtgactgaaggcacaacaaccaaggatgtcactggagagatgtagttcatgttctaatgtctatcagatggttgattcttgattatgttgcttgatgtttgtttctaacttcctagttcctatgatgccaacatgtgtaccttttctagtttaacaaaggatcaggtaatgtggtggatgagaggaagttgaaggttgtctatgtccaaccaccacgaccaccatcccccgtgcgtgagggatctgaagaaggctcgtctcctcgggcttcattatcagaagggggcaacttgaattatcaagatgtgagatgtctgattatgcattgtttcatttccttgtttttctttaattcgtgtggatatgactgattgtttttagacgcagacaactcgggaatctgatgagccaccattgctatctgttagtaccttaacttttatatgcacttccccattctgctcttttcaaagacgagttaaactgagtagtagttatttttccaggctacaagagcacacaaggatgcagaagatgtaacatctgattctgaggtgagtcactccaaataagttttctatgttcacttgtaactttacatagaagtaaaggaaacaacagtacttatgtaaataggtttcagtgatctcttagcaaacattgcatttcaatcttctattgaagtaaatatcaagtgcctttgagacttgactatttcaacaaaaacatggcatggatctgatggtcaacagtaccccaataaaacttgccaatttgttttacagctttaaatataaatgtcttttacagtcaatgattacaattaaaatttcaatgagacctgagcttggtaaagtttgcttggcacctgtaacgtagaaaacaaagtaatactgatacaagcaagatggagtagatgttgttgtgctgattgatacttgtaattgcagtatgtacttctcattgtaatgctggatatttgcacagtggtttgttatatgttaagggatcattggtcaagcccaactacgtataagttcaaaagttcatttcagttgacaccttatttgttgtcaattcgtcattttgttttgaaattggtcctttctactctctgtagcaattatttttgctctacgtgcaaatgcacataaattacctgttacagagtggaacattttttttttcgacattgattatttgttttatggcactaggctttcattacaaagcagttaatgtgttgtccttttcaacatttaacactgttcactcctcagccatattggccagcaaagtatctttcgcttgccttgtactgacacgaataatgcctcattaatttcttttatcctatgtgtagacatctgctttgatttcaagattgacagaagaaagaaactctgctattcagcagaacaataagcttctcgaggagatggttagtagatactgcccttatggaaacattttgtcgcatgctctactctttcattgtataagtaatttattcctactgtgataaaggttgatattttgtttaatttgttattatttatgtaaaaatatataattttctacttcatacttcctttttttaaaaaaatatattatgctctcacctaaatctgtactcctttttgcctctcatcattttggcgatgacaatgttgcatcacaaaaggt

SEQ ID NO: 81026 - DNA, 2687 bp, Oryza sativa
actgtacctacaagacacagccccacgacacgtttccgtgcgccgacatgtcaccacgacataccggaaagaggccgtgacaggacccttcgcataaccccctctaaccaagcacaccacacctcaggtttcacccccgtccccagcggtcaacgggcagtcccctctcgtgcctaggtgaatccggaagcgacagaggccgtcgcagggcccgccccgctccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcacattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcgaaacaatcttacggactcttttcctcgcgactgcggacttccgaaacgacggattctacacgctagcacgcaaaacaaggaaaaactctaataaaaaccaaggaaatagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaagggccggcgccgacaggcgggccctactcgtcagcggcacaaggggcaagcacacggtggactcgatccaccgcggccgaggcggcaccgtggacccggacctcggaagtggtccacgggaccgacggcctggatcggcccaaagccgatccaacggccacgggcggcgcggctggggcaaggcacggctcaaagctggctggccaaacgacggcgcgcggcggcgcggccacccgcggcgacggccggcgacagctcacgcgggcgaaagcggcgcacgcgagagagcagcggcgcggccggcaagggggaggcggcaaccggctgcccggcaccaccggcaacggcgcgggcacggagtgcggagcgcggcggcagcgacccggtcggacgaccaccggcggcggcagcacgtcgcgaggacgcccgggaggcggccgacgaaggggaggaaaagggagagggaggggagtgctcaccgagatgcacgacggcgaaggggcggccgacggcaaggaacggtggcgacggggctcctcaggaagacgacgcgacggagctccggcgacgggcgtcgctcgggatggggcggacgggctcggcctcgatcggcgaccgaggaaggaggagctccggcggatttccggcgaagaggggcggcggccgaggtcctcctcgtccttgtggagctgagggaggcaacggcgcgggtcggcgtcgaccgaagcggcggcgcgacgcggctagagtcggcggcggcggcggagagaggtggttcgcgtggctacggcgctacggaggtggagaggggaaatggagcggtagccgagcttgcccgggcggcggcaaagctggcggtggcggcggcgcagtgcgggggcgacggaagcggcgacggaagcggctggagggtcgtcggcgtgcggcggcacacaggagtggcgtgggaagctctaaagagcgcgcgggaggggccagtgagttggggaaacgcattagtgcaggtcagggtgcatttttataggccccggagggggagatcgtggccgtggcgggcggcaacggccggcgggtggagctccggcaacgtgggcaagtggggctcgaacggcgccgattttttgggggggggaaatgggggagaaagtggaggaaggggaggacgtggggtggaccacgtctgcacgcgcgcggaggaagcggcgtcgtggggtggctcaggcggccatggcggcagttggagctggaggaatgggatgacaggtggggtccatgggtcccacctgccggagagagagggaggaagaggccggctggggaggcagaacggacttgagggggagagagaggcgagcgggccgagggaggaggccggcccgagagggagagaaagggggcgcgtgtcacgtcctgataaattcatcccgaaataaaaatcattttctaaaaggaataatagaattaattaaaattcgaaaagaaattggcaaacactaaaatacgtgcaagaaaaattcaaatgtggcccggagaatttttgttaaattctccttggtctaaaaagagccctcaaattttagtggaattttcagagcacaaataataattattaagaaat

SEQ ID NO: 81027 - DNA, 9859 bp, Oryza sativa
atggcgcgtatcctagctaggtgatccctgcccggccggccggcgcgcgcggtcttggctttcagctgggtgatttgatagtgcggtgttcaacgaggagagggagaaggagggatgagactagtggagatgaagctagcggatggggggaggaagagggagggatcggagggggtatatatatgggtggcaccggcttatttggtccccctctggtctggatgtgatagtatttccgttgatgtgatgaggtgagggtgaggtgaggtttgaggcggtttctcttgatttgatgggtacgtgagtgagagtggctcgctgctactagctcctgatggatttgatgctttaatggaccttgcccgattcgagaaagcctcggatctgttgttgcttctgatttgaaagcccgggacgcaaataatggccggccggctggctggccggggagagaggacgagtgtgtttttttctttccctcttcgcgaccccagccgtgacagcgacaaagagagcaaggcaacgcatcagctgagcctgagctgctgctagccttggcccttgggtgaatggacgcagcaggctccactgttgatcaggccaggccacaggccactgcgccccgggggcagattgggaaacgcgaggggggcaacaaagccaagcgtccagtacacacacactctctctctctctctctctcgctctcgactgggaacagtggctgcgacagtagccggtagctagcatcttgggactgttccgtctgaaaagcgggcagaggggtgcaggacgagtggtggggatcggggtgcagacagaggctgatgccgatagagcttcgccgagcagcgggcggggacgggggatgcatatgggtgggcctcgcggctcggtgttgtgtaggccggcccacctggcgccctgttccatgatgtggtctggtcgcaattcgacgcgttcggcgcagtgccacagtgctattttcagtcgctcgcgatggggcgtaacctttgcagggatcatctcatcggttgcccatcaaacagaccatcactgtgtctaatctttgtatagctcggcgtggtcgttacattccgtccatagtcacaggcactcggattggacagatagctaaggctctaagctagctcgctggagaacacgtatatatatggatcaccttatccccttcctgaacagttagcactgttaatcacagcgttctcctttggcatttttatttttacctatctcagtgttccactcatcttctttggcaccaggtccatcacttgtaacccccagtgttccggccctcttctgttttgaaacgaggacgtgatttgtcagccgcatggtagggcttccctgtcaaaatactggctgcatcattacagcttgtccgcaggagaatgaaccaatcgagatttcgcgtgctgttttgggttattcgaggtctctggtcgatcttctgctttggtggtggggcgtacgtcgtctctagcttagcccggcctcttcagttttgttgctactttagcgcctctgcgaggcctcaggactggacgctcaggcaaaattcagcatgccataataactgaatctgcacttgtgcaggctacatagcaaagctacctggtgaattgatttccctcctccggcctccaatgtagagtaaaacatatgtgtaatccgtcgtcctttgcctgagcaagctgcacgccttggagattcgatccctgtgtcggtgtcaatgcgtgcctcgttgctcagtgtctgcccccctcctcccaaaacctaaaatacatatagtagtaaggagggaaaaaaaaaactgcgcatgcatggtcccgtaactacgcaggaagtaggacgtactactgttccgtagccggtgtaacccaaagatgaagcacagtgcgcagccgaacaggccaaagcgcaaggggagaaatgggataggcaaaggtaagcacgcacccgcccgggaccagctcatccaaatgaccaaagtgtctattgctgcatgtcgttgctcgcgtgtcagggggcacgattgcacagggggtgcttgccggtttagctagctaatcaatcatcgtggtaaaatctgcatgcagctagcggcctcgcgtccctttagctcaggtgcgagcgtgccggcatctcacgcacatggccctcccccgttacgccgatcgagctgcagcctgcaggcttgtgcagtgctgctcgctcgctttcgtctccgtttcactcttgccaattgccatgtgacatgtgagcgcggcctttggcgtcgcgaaaatacagtggctgctgcgctgccaagcttaagatcctgcgaatggaaagacggatctgagggggtggactttcggtatgtgaatatagaaattctctccctgtgtagcctatgctgcatgctccgatcgaagaatagggagtagctgcttggtttacaggccggtaacgacgctgtcgacgcatgcagtgtgcagagccgcggaactaggtatagctataggaaatgtgcgtgaggatccgctaaaaagcaagcaccaaagtgccatgcacatacttgtatgcgtagcctgccctcattatctaggtcaacttatagctagctttacgcatgattcagcggataaaaacgtacatgagtgttataatgcggttaacgtgctactagtgcgtccgaaaaatcttactttgtgcataggaaccggtctcagattgagacaaaacccagccgccagattgatccgatcgatgttgcatggctaccaactcgatcagtacacacgcctagaacacgatccgcgaaacacgaaaacagagacatgcaatatagagcctgctgtaactgtaaacgtgctgtcttacagaaggcgatggcagagaccaagctagctagaacagcggctaacagaccaagctagctagaacagcggctaacagacctacagaaggccccggagtatctagacctccttttgcaagttgtaacgtgtgcctagcctagcaactttaacagcggtaaaaaaaaaaagtcgaaggcacagagaaaaggctagcaacagtattccagcaacgttcgaaaggaagggtaaaaaaagagtgcacaaaagaataccacccacgaggtcaacggtcagaatttgtatgttcacttgaattcacaattgggacaggagtgctggacactgaactgacgaaactgtacattgcccatccacgaccaagaggtagattgttgtccaggccgatgctttggacccaaactttgcactctccttttcctgatttcaggtcctataacctaaaatttgttacaacggcccaaacttatgagccagcccaaaatcgcatttcactcgctaagcaggccacgccccagtccaacgcctgcctgggtcgtcccctttccttctccgcctaggactcctccccgtacacgggttcgaccttcgacgagctcgatcgaccgcaaggggaatgcgactcgtgagcgcggcactccgccgccgtgtgcccatccctccgcttcgccaaagataacgaagccgcgacggccgccgggctttctgatctctccgcccccgctcttcccccacggccaactcgtactgaaggctgaagcactcgacgcgtctcctgtgagaggtttagatcaaaacgctcctacacgtactgcagtttgtttttctttctttatctgtcgttatatgatttgctttatcctacattagtggattccgaggggttttagaaatctcaggtacatagttacatagacggaataataattaggtttgttcaggcgtagtagtattctttttttttcttcaggtttgtgatcaggtttaaatattttctttcttcggtatggaccgtatggtaatattctctagctcgtctctgccggtaaacttcccatcacagaaaattcaggtgcacgtgcgtatagccgtatatatcaaagagaaatagcgaattcgacatgtagtccttataactccgtaatgcggataatagactgctgtctatcaggcagccacttgttacaggcttacagctgacaatttttttcgtcatgaacctttaagtaactccttacggacttcacagttcaaacacggaagatttgatggcaaattaattaatcatgcatgcatgtataaccacttcggttatactttattagtatatatagatgggcagttggtaattaccatgacaatgctagctatttatacactgtatcaaatcacaccgcaatgttattaggctgtatacaatggcgtatatgttagtatgtgttttgcatcattcacgcggctatttccacaaatcctcctcccctccgcaggaggcagacgtggacacgtaatccaagctatcctcctgcttcccctcgacctgaaacacctgcaccggattgcagtaactgggctccttcgcagtcgagtcgccgtggccgaactgagacgccaccagcttgtcaagatccctccaatctgctgccgacgcatcggccgtcacgtagaccggctcgatctgcagctgcagctgctgcgccgtcgtgtggccgcacggctggagagcggacgacgctgcggtggcgacaatgatgtcggcggccggtagcttggggctctccagccttgggaggtgcatgaacggcgccgcctcctgaggaaggaggtggtggtgatactctacctccagcttgcaagggtggctctggcggtggccatggtacggcgagtcgaggcctggcgccggcgccatgaacgcgacgtgctcgttgaaccagaaaggtgagtcgccgccgtcgccggccgccctttgcaccgccgcgactcgcttcttgaacaccctgcagaccacccatccttcctcctgaacatggagcatgttaggtgtctgaagtctgaatcctcggtagcatgcatgcactagtacacaaacttacttggggagctccgtattcgttggtctccaagcgatactcgtgcatgatccagtccgacttctgtccgttgggagcccggcccctgtagaaaaccaacgtcttcctcatcccaacaaggcagttcttgacatagatcggcttgtccctcccggtggccttccaaaagccggcagtggtcgccctgttggtgcgtgtgcccgtcgggtacttcttgtccttgtggctgaagaagtaccactcgttctgctcctcgtttccaatcttgcattgttctgtttgagcatcattttggagatgtcgattaattagctagttatgatattacagggttagagataagcagcaagcttgtagaataagtggagtaaattgtgattaccttgtaggtcccaaggctcaattttgtacagatcaatatcttttatgacgtccaagtctatcttcttcagtgctaccttcttcctaaggtagtaatccacgagttcctcgtcagtagggtggaaacgaaaacctggcgggacatgggagaatgcgtccatcttcttccgcggatcaaagtatagctcccgaactggtagcaagttaatatgaactgcatgcacgataagaagctatatttcagttacaggctagtttgataacgatgcatatatgcatgtgtaacgaattccaaggaagaatttgaacatatagcatccaacttctcgttagctcatgtctactagtactagctagaatcaggaaatctcacaggaaatactccttttcttaattgagaaagcattcgatcggtttgcacctggtctctctaacgattctgaggagtttctttctttttgtaggaagatgaatcggaaattcatccagtgaagtttctctgaccagaggctggtctctctaacgattctgaggagtttctttctttttgtaggaagatgaatcggaaattcatccagtgaagtttctctgaccagaggctgattctcgctcttctgcactcctatagaagactagcttgatcaacaggaggtgtatccttgcttccacttccatttatgcatccatgatgaaacctttgccggtttgtgtgaaaaagaagacgagatagaggaggacaggagcatcgagttcaagttgttcagctaaacaaaccgagcgcaaactagggagagctaaagttgctcgccgtcctatccgacaaagcacactgcacacacctaggccctagggactcgcgaaccttgtacccacgaagacggaagaaaagacatcgctaatcacgcagcacgtaccccagttcagcacgcgcgcacagtgcgcggtaaacaaacaaaaggtaaaacaagctagcatcatcgatcaagcagaaaaccacgggttggaaatggacgagccgtctcttaccttgtgcgcgcgcgcctgcaattgctactgcttcgtagcttgcagcagcatgcagcgcctccctcggccagcagcagccagccttcaaacggatggagcagctatatcgatcgcatgaggagggacgaggccgcggcggggtctatatatcccgcgcgcggtggtggtgatggcctgggcgcgaccgaggtgggtggcgcgcgcggagggcaggggaaggggacgcggccggaaagcgcggacggattgcgggccaaggctggctacaatccaggagcaccgcggccggagagcgacgcggcggagccccgcgtttttctattggcctttttcgccgtaaccgccacctccccgcacccgccaacgacagcgacccctagctagctccctccgatcacgctcagcctcaccccccgaaacggagcttccactgccgcgtgcagcttatgtagcagcagagactagcagtggtggacaccggccagcgctagttgccacctttcctcatctgaaaaattcacagatagagtgggtgtaaacctttctctcgtctgaaatggtaacatttgatcgaccccaactgaaaacgagcaccggcgtgtctggcccagaaagccaggtaatcatggtgacgcatcaagcgcggtcggtcgttgcgtttttaccctcatgcatgactgtaaatgtgtgttagcttagtgtgtgtaggtttgatcatgcatgcggttaagtctgtctatatgtaaactctctttggttggtcgtgttcgctatctggctttctaaggattcggccatatgtgctcttcgcaggtagctagctagatagccgcctatagcttctagttgcgtttgtttgctcctggatggtcgctctcaagacggccacggctggaccccgtttctcgaccgacctaagtatattttcgatggcgaccctcctccaaatggaaacagatccagtgccacacaagccaaaaatatgctactcatgtcatccttactgaaacggggacaaaaggatctcaagcctttcaagacacgtcacatttggacaggaccagggctacaggcctagtgggctacatatgttagaactccaagaactccagactgatgcatgggttttctgataattaatttgcacctttgcttctctgctgcataattaagtaaaactttttttgctgaaccttagtactgtagatattagtagctaagtttagactttagtactgcatccgtacctacgtacatagtatatgggagtgatatatgaggtactgaagtgccaaggagtgatctatgttaaacctgattaaaagcagattagcatgtgcagagaaaatttgatgcaactaggcaagtagaaccaatgaagttaactgtgcggaatggggaccgaccggagatgctgtgcaagcaggcagcggcggctggtgtccggcgtgggctcgaactgatcattagccatccctactttatctctataggagtattatcctttcttaatttatttcggtgctctcgccggttggaccaagggctccacactcgccgtgcatatgcatatggttattgataccttatctggaaattgcgaatttgtgaagaaacattcgtcctcttggactgatttaaaaatcccatctgagctggaaataggatggctatcagatcgatggctgacaataacaagtgaactgtagcaagcgtgcaaaccaaccgggcagccgcagatcatagtacacaattttggtagtaagccccttgcaagcagcagtgatcaatagcatgcatgcacagtccaggatccgagttgcatgtggtccacagtgtgatacgcacgccctttctccgcacgcaaaaatgaaagctagctagctgatgtatagctttcccggccttgtttgctgctaattgagatcaatttacacatgcgcattttcatctctctgcaaacgatcagtcgcattgtgcaacgcacgtacttcacgtgcgcgtgtatgcaacagattctgcaacctgcttggatctgtacatctcctcaaacttaagggcccctttgaatcgcaggattgagaaaatataggaataggaaaaacgtaggattttgatagaaatgtaagtgtaaaacagagaattgcaaaacgcataaaaaacacaggaataaccgtttgattgaaccacgggaaaaacacaggaactggatgagagagatagactcaaaggaaaattagcaagaggttaaaactcttgctaaatttcgtccaaaatctctataggattgtccattccataggaatttcaaaggattggataatccaatcctttgtttcaaagggcttcataagaaattttcctataaaattgaaatcatctaaaatttctattttttccttcaaatcaaatagaccttatcgtctcatcgtctcggccttgtatttgccggagcttttagtgatcgacacgcgtccggccagtgaggccgacagcgacgtcaggccggagcagacgccgttgcaccggggagctcgtagaccgtagcctttgggaatacacaaagagcagaacaagtggatataatagataccggccggtgcttttgcttggatggcgatgcattctcggatgtttatattttgggtggaccgtattgcaactggttctggtgtatctttgggggagaagtgaagcaaaaggactatacgccatctggtgcatcatctttgctagatgccgacgtcactggtctttaatcagttttagcttaacagttatgtgatgaatttatcatgggtaaaatgggtgataactgtaatatataggactggttgcgcgttaacctcagtcaagtccgaccggcttaacacctcagtcaagtgaaccagccattggtctctctcttcttacgactgaagagcgtcttgagagttagtattgatgttactatttttttttaattttttctataactatttgagtcgcatgcaattgataggtgccataacacctatcaactagctatactttttacagtgaaacaatggcatctgactggtaacatacagtgcgacgaaaaggggacaggcaagcgtgaggcaaatggaataaagcctctgcaattcacctgctaattcttgcttgaactgtacactcgaaaccagttgcaccgtcacttttctatatagaccatgaccatcccgatgaagcgagagatgtgcatgtgagacactgtttgcagacttccatcatggatgaattcctgctggtcttatcaaaatcgaaaccccctggggcctgcccagtattccagtgtggacgtgggctcggcaccttttaaccgcacacatcatgtctctgctgcatacaagcatcaacaattcgacatgacagatggcatcattcgccagcagttggcctttccattctgaaaatttgccggggccaggaaacaggttcaggttcaggtag

SEQ ID NO: 81028 - DNA, 8969 bp, Oryza sativa
aggtcggtacattaccaatgagctgttgaaaaacatctcttaaagtcgaatcgggacgcaagtttcttttcggcccaaacttagaaagaaataaatcacttagtgatttcaaaatgtcttcaaatgaaagatttgcaaaacaaccttgcctctcttccaagcttgcattaaacacctaagttcccgtgacttgctgagtacgaaagtactgacccttgctctatataaatatatatatatatagttcctccgccctaaagagaagataaagtgaagtgaagattagggtttcgtcctggttcccagccgtcacctgtggtgttgggtgttagttcgttggttcctctgctgctgctgttgttggtgtttcctcgtccgtatcgtcagttgcattctcggtttgttctcagctgcaacctaagttaaggtaaataagtcctctatctattttaaggatttgcagtgattcataattgtcaccgtgggtaccagcactatgtcctgggactggtaccgagatcgcggtttcgtaggaagcggttcgcgccgtttttcctacgacacgctcctatcaggtgccgttgtgcggcggtgccggattggggtgtgacagatccatgccactacaaatatgcaatttagataaatgttaatactattcacgatatcgattacgtgccactggaatgtggggaaattggaatcgtgtcactccatcgcgttttccgtcagacccccagacgtgggacccacatgtcagttacatattccttcatcgtccccccttttcttttttccccatcttttcctccatcttccacaacttctatgaggggcaacgtggcggcggcacccgagccgtcccgccgcggaaggggtcgaagacgacagtggcggcggcggttcccaagccctcccgctgcagatggggtcgaagacgacggcgacgacaaccgatccctcccgccgtggaggtggtcgacgatggcggcagcgacgatgaacgccgtggagagagagagagaggaaggtgaagaagaatgaactgacagctaagtcccacatgcagttgaggcttacgaagacttttgacggaaaacatgacggagtggtatagttccaatttctccaaattccaatggcacgtagccgatatcgtgaataatagtgacattgatctaaaatagcttatttgtagtggcatgggttcaattaactctaaaaaaactgatgatggattggacaaaaacttattcagattcatcgtcataagttactacaaaatggcttatttgtagtacttctttttacggatggagtattgtatatgcatggtctgtataaaagagataaggacgaagaaaatatagcacacgttgatgtgacgtgagagaaatatgagagaaaatgaaggaacacacaacatcggtagagattgggttatcattctgcctccatcaaaactcatgttggtttgcaaaataaacgcttctattttcacaataaccaaatttcacaaaccatgctatgataactacggatatagttagagagaactttccagcgcctgtgtcgttctaatgaggacaacacaggcggcattttcgtccttggatacatcttccatgtgcctccatttttggattcttggatgacaactcaacttagctcttgggccgacaatggtgctgctttatgacgacatgtccttccaaaaggcatcattgtagaaatctattgttgtgttttagtagtttttggtctatcatgcctcgcgatggcatccacgggtagcctttgggaagtaattagagctaatgcgccaaggtgacaacgagctaggtaatgatgactcaaagttgtgtttggttgtgttgactggggatacctgtggaccagatgaatagtgtattggggtacgctagtacgaggatgtaacgctccgcttttcgtgagacgttaaaaactaattcggcaaaatcctaattgcgaaaatttcgttctttgtgtgcgagtctatgttatgccaaggatctcaattcaaatcccgttgttccctctcatcgaaatcaaaatcctccccctcatccaaattcctcttccgattcgagtctctgaaatcaaattctgaaattcaaatccttcctttgaatcctcgccaaatacttctacaaatccagaattattcaaatctcgccccgaatccttcccttgacttcaccttatgttcctaaagtcaaagtatcaaggttaaattccaaaaatccttctcaaattctctccaattgaaaccccccccccccaccaaatcagttctctcgaaaaaagtctaaattgcgtccttcttggctgtgggccgtttctccctggctcggcccatttctcctcagctccctccacctccacgtgcgctgcacgcgccgagagagagagaggcatcgcctctcttcttcctctctccttcctctctctctctgtttcctttctctctctctcacgccagcgctgccgccatcgccgcttcccgccgtcgccgccaccgccttcgctccttcccgcgctcgcgcgtggccgaccggccggtcgttgccgccgtcagccctgccgcgccctcgcgtccgcgcgcacgcgctcgcgcgtgggtcgccgccgcaccagccccgctgccctgccgcgctgcaccacgcagccgcacggccccgcgcgcgtgctcgagccgctccatgcgcgtcctgccaaaacccggaggccgagctctccctctccctcctactcccttcccgaatcggcttggagcgagcctctcttttttccccttctttttccctttcccgaccaccatcggcgtcaccgcctgccaccgcctggaccacgggcgcgaccgccagcccgcgctcacaacccaaaattcggccgtccgatccaccgccttcgccgcccaaagtgtaacgtcccgcctcccccaggccgggcccacttacatctgatagctttcataggtcatagactgccctcacataccaacacatgtcttttctgcacactttgtcctcactcgtgtgcacccgggaagaatttcccggtcggtcacccatcccaaattgctccaggccaagcacgcttaaccctgaagttctttggagattggcttccgaaaaagaagttgcaacttgttgatcgacgccccccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatctgatagctttcataggtcatagactatgcccccccgtcgatcaaccctaggccaggaacgtcctctcttggccacgtccatgtgtatgtgtccagtgccagcgcatgtgccatgctgtgtaaccactcccggtctacaccagccatgcgcaccatgcctgcgcaactgcgacacacgcgcgccgggcccgcttacatctgatagctttcataggtcatagactgccctcacaaaccaacacatatcttttctgcacactttgtcctcactcgtgtgcacccgggaagaatttcccggtcggtcacctatcccaaattgctccaggccaagcacgcttaaccctggagttatttggagattggcttccggaaaagaagttgcaacttgttgatatgagtattctattaattctattaagccctataggccgggatgttacaggatccaactaacattttttctacagagggagtacgcgtgatttcctgcccgacctcttgtttctctgaagcattacatatgccacgtttttgtttgatgtcacgtcaacagcatataattcttagaccggcacgcgtcttaccggtcgaatggtaagcagcggtcggtgggacaagtggccagaggcagccgccatctcacctcaaactgctgagatgggctgaggatcgatggaacgctacccggcctgccaatcgatcgagatgatgcgagcttttttgcactgtggaacccaagtgagaaacatcaatcattgacccgtgagaaaaataaaaagaaaactgtccgtaggcgctgctatgtctgatggatcgatcccgttcgatgcaatgtttgcaaaccatttgacgccggtggtgcgtccgtgcgagtggacagatgagatgaaaagctcacgtggacagagagaaagagaagagagagtagtagtagtaggtagtataagcagtgcagcttagcagtagacatttggaaatggttgcaccgttatatccctgtagatgctactagtgcactgcatagatcaatcacatcagctcccctccccggcccggccctccataattgcgaggcagcagcagccggccatgcatgacgctgctgctgcctcggcccagtactacgtgccatccatccgtccatacatccatcagctagctgctgccctgccttctctgcttgcccctgcctgccagtgccaccagtacgtagtacgtcaagcagagcagcagtgtgacgagtgtgacgaaaccgcccctagctcagctcgatccagcttacgccgcggtctctcccccggcctcccctcgcttgactggccggttcgatccatccctgcgctgcgcggccgccgcaggctttcgacgacagcccgcgcgcgcgcctgcgtggccgcagttctgatcgtcgctagcgctggatctaaggcgccgcggcacgctggaaacggcacagctgcgtgctactgctaagtagctgtgccgtgccgtgcagtgcagtaccgtgcccccggcagctcgcctcgcctgccattgcacgccgaacgatgcgtgtggtgtgcgtggcgctagctagctgcatgcacggagttgtatccatgcgccgagcgctgtctgtttgtcgtcgtggggggcatatgcgcgcacgtactttcctaccgatagagacccgtcaaacgccggttccgacccgcaggtgaatgaatggatcaacatgcatcttccatacttcttccatttcgccaaaaaaacgacctctagggacgtgactaacaccgaaaaaaagttgatccaactccaagtatacatttcaattttcccaagcaaaatttactttggtaattaaattaactgtagcaccaatatggaggcacggatctatgatatataaacgagtcttttacctccaattatttgacactccgtgtgtcttgctgtggccacggaagcatgcatacgtacgtacgtacgtggtatagtacgtgcctaggtagctaggctagtcggcgcgagcgaacagtcgcgttagcggacggatgcgtaaaggccagcttaatcttgggcccgtttgcaggcatgatcgaggtcgcgacaggccgggtcagagttgttgatcagggctagctgctgcatcactagtcatttcaatggacggagggcaatgtaccggaataacataccaagtccaataatacatcaatcacaattagtgggccctagaatcgatctcgcattgcagatcgtgccaaacaggatattcaatttgtctcgatttttttaaaaaattaagtttgccaggactgttcacaatgttcgtctatatcccaaaattattcaattagcagagatatctccttgggcttcattttattttcttttagttggctatactacatgaggcttagtcctgtacatgcatttaatactactcattacaatgtttgcgatttttattcgtaaaaagatcttgaaatgaaataacattcaactgaccacgtttcatcacatgtactgtactattacacttctaaaaactgtttccttttacatgccgtctaaatgtgcaaaactttatcttaaaacattataaatgtccatttaaaattgggttaggtccaattcaacccccccccccccctcagttgttttgaggcggtttggcggtacgtcaactcaaaagttaaaaaaatattgggttagagccagggttttaaattttgaaattgggttttatgccaggggttactgaaatttcggaaatttcaagccgaaattatttaaaaatttgaccaaattcacaaaaaaagcaaaaaaaacgaaaatttcgggtgagatttgagtatgctggtggggggcgaaatttcggaaattttgaaccaaaatttcaaaccctggttagagctttgcttataattacaattccgtagtttcgagaaataaaattgagaaccgtgcaaaaatatagttctattttcaaaatagacggaataattctttaatattacagacatatttttgacaaagaatatgctgctacgttgtcttattcgtgttgatatagtacgtatatattttttacataatagaaatattttatatctctagtctcacacaaccaaatgtgatgcgtgaactcgtcgtgtcataattcaaaacttttttttactgctggtccccacttatataaagagatcagtcattaaaatcaaatatatattatgctgccaatgggttcagttaaaccaagaatggtgaaaagggtttcaactccccacccctaaaagaatcagacgatttgatttcaaatgatcacctggtaattaaaccaaatcgatctagttatgtccataagatatataagaggcagcacgcacagctagcagcctctgtacaggcgaataggaataggaaaaattaaggggaaaatacatgaagaaactgagaaaactagaattacacatagataaggacttagatacgatcgatgcatgccaagatgccatgcatatggtgccatgatcgtccatatatagaggaacatttcagttaacaagcaaccggagatcatatctggagatcgagacatgcaggaccctaactacagggtgggacacaaagttttttttaagccagatcgtgcattgatctgaggcgttagaatggagtgacacccatgctagatgctgctgtggctgctgcagcggcggcggctgcagcgtagagaccgtccttgaagagcatgcattccccagctccgtcctataaaagcacaaaaaatactataattaagtctcggttttatattcatccattgacatcgattctccaccaatagaattagggtttagattttagggtccgtctttactctttacctggctttgtatgccggtcttcttcaggccctggtccggcatcaggccaaaatggatgtgtgggaaatgggcccactggtgcatgcacaaagatgagacagagtaaatacgaatttggtttatatatacagtggagtatgctgcacacatcacatgcatgttttttttatcaagaaattaaacggggagattttgtacgttcttggcagcagcgctgaaagcctccctgtgggtgatgtccggattgcttgccttgatgcgttgtatctcatctctgatattatacgtgtcataaacggagtgaagcacgagtagtttttgtcagatgatgtaattaaaagaggaaaccaaaattaaacgatgtgaaccattatcgatgattactcacttgatgaatcggttgtatgccgagggaaccctctgccgcttctctgaagctgcagaatcacaacaatgagccgaacataattacttggttaacagaataacagcgtactttgatgacactactgcagcactgctgcagttcaaagaccgaagcagcacggacgcaacaaggctagatcagttgaaagaccatatgtacattattagttcgcatgtgcaacctgaccattaatgttgctccctgtgagctcacagaacaaattagggactggttgccacgttacgttctgtctgtttgaagcagtattcgatctggagtttagaatagttttccatttgatctgtacgtgttctgttcccttttccttaacccctcttcctatttttttattgattttttgttttgtcaagactcaagtgatcttacctatctttgcactgtgcataattaacgtcgggatttgggaagaattcctccacggacaaaaggcactattgagctgatgtgaaaactattcgacccccttccacttgttcgaaaacttcattgaccatcgaaaagaactctcaaaaggagaagctcaaagaggagcatgctgtattcgtgccaccaagaacagtgtgtgctactgcagcgcacgcgcacgcagctatctatagccagcttctggagttctctcctagctatacacagcgttgccggaggatcgaggaggagaaggcgaaggaatgtgggagaagtgaggcacttactcctgttggctgacggcgcgttcttcggctgctgcggctctcgctgggtagccttgttggccgccgacgccatcgacgtcgccggcgcgttgttagcacagctgctgttgctgctcgtgatgctgctcacgttgggactcgcctgttcggtcattaggctcgccggcgcttggaatgacggcacctcatcctgcaagccgaaaatgattaagcatccggccggccggcgcagtgagcaaaaactaagtagaaatagatcgttgttacgtacaaggaggccgttcggtgaggtggggaagagcagagcctggccgaagggaagctggttggcggtgaaggcggcggccgggagcaggaggccgcggaggttgacggagagcaggttggcgcagtggccgcaccgcacggtgaccgtcttgaacaggctgctacacggcacgcccacctgcaaatgcaacggaacgaggctttattcaagggacgtaccggagtccggagctatagttagctattacggccggacagatcaacggcgcccggcgagggaac

SEQ ID NO: 81029 - DNA, 3412 bp, Oryza sativa
tatttttttaaatagtgaattatatatcattggaaagcttatgaatttagatgaatttaggttcaagtttcacttaaatcggagtaaaagtcgaatgcgaaagtcgattcctttttattacctttactatcagcgaactacggcaaacccaatttcgatttaaactattttgcgggtataaatattttgttgtcataagtttttaatttactcatcccgagcattatatccatataacaggttagaaatttctattacgagctaaatatcggacgaaatcttagaaatattatacaatttaatttagtctatgactaaacgattaaatataatacacggctaagattcctagtaattgaatccgaatttctaccatgaaccgatgacttatagagattatcaaaaataatctataataatctataagaattcatctaattgtttggttattaattatatctaaattactaccaattttaatctaatctgatcaagaaacatatatttataattaactcggaatttcgatcgaaataccattacgctcgaggaatttccaaaaataatctattattaaccccgaccatttttatttcctaaatcctcctaatttctcccccaatttcccttctattttctcctttccttctttttctctcttttctctccctctctttcttttcttttcttttctcttttcccttttcctttctttttctttctctccctttttcctttcttctctctttctctctctgtcggcctctcttttcctcttcctttctttctctcctctctcccggctctatctccctctctcggctctatctccctctctcggctctctcccacccgagcggcggcggcgatggacgcgagggagaaggagggcggctcaccggcggcagcagcggcgacgacggcggcggcgacggtggcgcacggcggcgcaagagcggcggcacggcggcacgggaacggcggcgcaggaacggcggcgcggtggcacgggaacggcaacgcggcagcacgggaacggcggcgcggcggcacgagaacggcggcgcggcggtggcgcacggcggcgcaggagcggcggcacggcggcacgggaacggcggcgcaggaacgtcggcgcggcggcacgggaacggcaacgcggcagcacgggaacggcggcgcggcggcacgagaacggcggcgcagtggagaggggagaggggagaggaagggttagatggggtgggggagaatggagagagggggggtatttgtagagaggggaggagcggcggggctcggggcggcttggtgtgacggcgatggcgacgcgacgatgacgcggcgcggcagcggcgcgggacgcgaggtggcgacgcgatgggcgagcggcgcgcgggtcgcggggcgcgagacggcgcgcggggcgcgaggcgacgggacggggcggcagcggcgacatgacgggcgcgcggcgatgggatgggcgggcggtagcggcgcggggcgcaaggtgcgatggcgacggacgagcggcgacgagacggtgcgcggcgcgatgggacggcgatgcggcggcgacgggcgacattggcgcgagacgacggcgacccgcggcgatggcgacagcgtggcagcggcggcgcgagcgaggcagcggcacggggctcgagacggcggcacggggcgcgaggccgacggcgacgatggcgacggcggcacgcgggcgagcggtgcaaggtggcgacgcgcggctcgggacggctagggcagaggtgggagagaaggggaaaggttagggaccaaatcgaacaccttgcgggcaatgaatagtgcactttcctattattcccgattttaggttattttcaatataaatttgatttcataatttctaaatcttgtataaatgaagtttatcccatatttgtgttatcctaactaaaattctccttaatttgatatcactcatattttgtttatataatttatttgagttttaattagggtaaattcttattctatcgcaattaaatttaattgatccaaatatggtcgcgataatattttatttattactacccatacctaatcttttatttttaatttatatttattttaccaatttatttttaaggtttattaaagattctataattttctaatgagaccgttattaacataatagcacattagctcaatttatctatatgttagtttattttatatggaggggtttaatatatcaaatttcaatccctaaatgcaattaggaacttggtgcaaaatcgatctacatatcgaattaaatactcctgtaattctattatatatacagagagctcagttcatttgaatgatcatcatttcatgtgtactcgtattatggcacccacctatattattcaaatattttaatatttgataaaataggttaataataacttttattttatttgattttaatatcttgcgcataattattcgtaggattaaatatattctcataaatcatatctattgcttaaatgtagttcttttctttaccttcttggtgatcatttatggtttggcaagcaataggaatcataacaaccagcatgatgcaaaagttttaaaaagttcgaaattttagtgattttttttattgtcttgaattttcaggatgttacacctagagatgctcccgccaccacgaattgaccccattctctcccggcgtgtcttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctagccggcccgcgtggctgccacgtaggcgccacgtcagtgccaactcggctagaccgagtcaaaccggccagcctggctagccccctccgtgcgcacggaccacggtgcgccatgcggcggcacgtgggcctgtcacgcctcggtccacccggcgcaccaatcgtgagccgcatccacccgaaaccctaaacgccgcccgcgtgctcccatccctctgtgaaccgtgtcgccgacatgcgggccccacccgggacctcgcatggtgggttcggtccacccggaccgccccctctcccattcgcgcgcccctaatgggccgcctccttgcgcccgcgccggcccaatggctcggccgagcctctttcaacccattgggccatgcctcacgctcggcctaaaagtccatatttcctccctccgtccaagtcagtgtccatctctcatgagctaaaagtccatatctgctccctcccaattt

SEQ ID NO: 81030 - DNA, 751 bp, Oryza sativa
tgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaacaaaatatatttgctgaggtcgaacctaaggttgctcatattattcgcgcttgctaatggactctaatcaagctaagagctagggtttcttagtctttctgttgtcatggtggtgcagtctagctaatggctaaggaaggattatggttacacatgcatctatctaaataggacggttatttactagaggttctgttgttagatggatttaggatcaatcaaatagttatagtgaatcatttgtattattattttattgatggaagctttactttaattatgaacatattttacttgtcacaataaattataaaaggttaataattatccatgctttgtatgttagagttgttcacgttaatcatattatgggtacagattatcccatcacataattttacaatgaataatcctaatttacagttgaactataattataattatatgaggtcaagatttataactagtatatatctaatatacatgcttgacatactctccctttaacttaatttatgccacacacaaattaatactataccgtaccactataatgggatgtataatatatgtgtaagcaacaatattttatcattggatcatat

SEQ ID NO: 81031 - DNA, 4032 bp, Oryza sativa
ggcataggataggttcccttaacagtgatagtatttagtttcctgtagtctatcaccaacctccaagtaccatctttcttcttaacaagtaaagcaggagaggaaaatggacttgagctgggttgaattacccctgactgcaacatttcagcaacctgtttttcaatttcattcttcaaggcagggttaaatctgtaaggcctctgactgacaggagctgctcctagaatgagtggaatggagtggtcacaatatctcttaggaggaagaccagtgggttcagagaagacatcttgaaaagagttaatgagttcctgaacatcagaaggtaaaggctccttagtcacaggatcagatgcagaaagctgtactatgtgcataattgacccctgtttcaccatgcccagatactgttctgttgatatgactgaacagtgagtggtctgtggtactatgccctgcaatctgacaacattaccatcaactgtaatttccatccatttgtctacccaattaacttgcatgggactgtattgttccaaccaatccataccaaggataatatcatagcttcccagatggagcagtctgaaattactgatgaaattaagtccttgcatccaccatctacagccagcaacttcatgagaacaagtcaaaaatccaccatcagccaatttaacagaaagttgttgttgcaggggttacactccagccattttcagtccaattccagcatccataaaagaatgtgtactaccagaatctaccagcatgagtagttcagagccttggaccaaacctctcagccgaatggatttagaagactcagttccccacaatgcttgctgagaaatagccatcagatcactgttactatctgaaggagtttcagggtctccatcaggggtctcatcctgtaatgcatccaataactcctgaacaacatgcaattgtacagctgaaccacacttgtgatccctactccatctctccccacaagtgaaacaaagccccttagatcgtctataagatttaagagcagctagtttctcttctctagctcgagcagactcagtacccctcttgtcttctgtatgttgtggagtaaattgcttctgtggtgtagcagtatgagcaagtgcaggagttttctgaaaactgcgaacaggaatagagctgtcaggtttcctgtattggttaaactttataccctccaaagcttcttcctggagtaaggctactgcacaagctgagtcaagatcttgaggtctctgaactaataccacaaccctgatgtcacttctaaggccttccacaaatttagtaacaaagtacacaggtaacagagaattgtcataagctaagagttggtgcattaaactgtcaaacttctcaacatactccgaaacaaaaccctcctgtctaatatgaatccactgacgtatgagagcctgctgtctatccttagaaaatctggtacacaccaactcacagagaccagtccaagaaattccacatatctgattcctcacagattgcaaccagaatgcagcattaccacagaaatttaatgtagcaattttcacccaataaactgactgtatgccataaacatcaaaatattgctcgcaattagccttccacatttgggggttatcaccactaaattgggggcaaatcataggtgggatggaattactcagattaaaactagcagatccactaccaggagatggggtttcaggttcagaaccaaaattaatgtggggaatggagaaattgtccttcataccaaacattggcgtcgcagttgcccccgacttatcagcagcttgatcctgcttggagttgcctggagctccacccgcggcggtgctgccgaacgcctccgacttgacttgccgcaacaggttgccctccaagtgatccaccttagcgttcaacgactgcaccgattctcccagtgtttccgccttcttctccacggccggtatccttgattccaccgttttcctcagctccaggtactctgctctggtacgctcctccccttccactctcttcttctcattgtcagaaatggttttgagcaggagatcgaacttagcttccaaatccatctcgagattccggatccaaacctcagcgctagctctccgaattcagccaaccagatcgagggagccgaaacttttgcggatcacacgccaccgaagtagcaggatcccacctctccccggaattttacagccaaatcaagaggattttgcagcgcgtgagggctctgataccagattgttaggggctctcaagaacacgcttcacaattcacgaatttagtggcaatatttgttacttctcagatccaacaggaccgagccgccgccgccaacgcctccagatgccaattcccgaattgttctagtgttgttcgtttgatttattacaaccaacccactctctctctctccggcgccagctcacaagcgagctgataccttacgccacccactctggaccgtggaccttcggattgggcctcctctcacggactggacgccgagttgcaacccaggcttgattgtcacctgaagtctggatcacctcctccttatcttctctgctaccagcttcatcagcaacttcaggacggcttccttcttcttcttctggttcttctgcagttgagccttgcgagatatctcctggatgatcttgagagtccctgacacatatgctcttctaaatttctgactctaatctcgagcagcacacgataatttaaaagtcgatttttccttccatggaagtttttatttcttccgactggagtagtattccatacacaatccgttagatccttgtaaacggccgtttgtgatatcaccacgatagaaaatagaccgttcacacatcacataattaaaccctggtggtcaaaattgatcccttctccgtacgactgaacgatccgttcgcgcaaaaaggaaataacattagcctgcgctgtcaattttcttcaagttgacttaacacgcgttgctttggtcgcatatggaaaaaaaatcaacagcaacgagataataaattactattcggaaactgagactgtgacggtggatcagttcgacttgggaaaaaatcacggtgctttgttttgacaggtgtgaccagccatgcaactcggggtgaagcgccggaaatctgggagagcctactcatcacgtacactgcaaagcttcacagaatatgcgccttattttatcgcgacatatagaaagttttgtcgatctagacgatgggtgaaactgtatcacgggacaaaatctgaagtgctgccagaaatttatccaacaacatcttgtgtgttgggcagacccagggacagaaagcacgcgagttgtggatcctgtcccagttgcacggagagttggaaacgctttgtcctgtacttgctccactccaaataagcacggcttcgtcgaaggcctccgagttcagagggtactaaacgacagcgagatttttgtttatttgatggattcaggcgacctcagatgtaccacaccactaatccactatcccactgagacacgtactcttatcaaaagaaaacaatactacacggcacctgagactcctgactactatagatgtcctggcacgggcttgcaccaagatacgcatgtgtgcatcaatccacgcctccgttcatcctggtagcctgcatccagctagcccttgcagtgcttgccgagccagccttcgcgtgacgcgtgccaaagccgccacctcggttcatgcctcctgggtgatccgagaacgatgaacctgctgccggctgcggatagcaggctcaggctgctgctttgtcgattgattgccggccatctgggcatctgacaccaaaaagatcaattagccgactgagacaactcaaattgaggacagacatgccaggacagcaagggggagcatgccatgtccgagatcatcgtgatatgaaccgcagcataccggcggtatggt

SEQ ID NO: 81032 - DNA, 1600 bp, Oryza sativa
ttcaattctaaagattgatgcattgcacatactccgaccggacgagacgcactgtctcatccgagtcatttgagaagcactcacctagtcgttttagaaaagagttcaaataaaataaattgcaaaaataacagtctttccttgaagcctgcaataaacacttatttcccctggcttgctgagtactcccgtactcacccttgctctatataaataatccccccccagttgctaaagaagctgaagcggatcctgctgatgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtactactctataataaagagacctctgatgttgtgatattctgtctccctgtgataccagcactgtttcctaggactggtatcgattaacaggttaaattggagcgtcacgggctagtcccggtcgggactagttcggggcgtgacaccaagagccttgctaatgaaggcaataggatgaccatcttgagatagaactgctccaatcccagtttcagatgcatcagtttcaacagtgaaaaccttttggaaatcaggaagtgcaagtacaggggcagaaaccagtgcttgcttaagatgttggaaggctgattctgtttcagagttccaatggaagggaactcctttcctaagcaagttagtaagaggtttgctgatcaccccaaatcccttgacaaactttctgtagtatcccgcaagacctaggaaccctcttaacttcttcaccgaaatgggaaccttccaatccaccacttcctgaattttgttcttatcagtgtgaaccccagctgcgctgatagtatgccccaagtaagtgagttgcctttgagcaaaggaacattttaagagtttgaccttccagtggtgtttgttaagcagtgacagtacttgagcaatatgatccaagtgcgatgaccaatcagggctatatataagaatatcatcgaaaaagaccagcacgaatttcctaagaaccgttttaagggtgtcattcatggccctttggaaagtggcaggtgcctcagtgagtccaaaggacatgaccgtgtactcatagtgacctgtatgggtttgaaaagctgttttatattcttcaccaggagccatacgaatttggtggtaaccagctcgcagatctaacttagtaaaccacttagcatgagaaagctcatccagtaactcatcaattactggcataggataggttcccttaacagtgatagtaccaaactatacttgcacttgagaaattagtgtataacgatacacatcctcatggccaaatgagtatagcttagcaataagccattttattggtttgcttgtcactgtgcgcacagtagcatgcatgcacacgtgaaacattagcgtgtgatgattaaatgccatagttgctgcagatggcgtgctcttctccaggcttggccatcggctccacggcagcccccggcaatgtgaattga

SEQ ID NO: 81033 - DNA, 4632 bp, Oryza sativa
gatttcaccgtgcaaatccatctcccccggtgacgcgacgacgcgcgccaaagcagggttgaaggtggagaggtcggtacaaagggacaaagtggcgacgcccgcgaggcaacaaccgagggaggcgcagccgtgagggccgcgtggtatggtgggatgcacggctttctcctacgaatgctcctactgtctactccctagcccgctcgcgaggcgaggccgttcgaaacgggcgagacactcacactcactggaccacggcgcgcagcgtcggcacgaggcagggcaaagcggtggggtggggccgtgtcgaccggtcagctgttgatacaggccgttcggcatacgcagcggacaaatcgacaggtggtactatctgtctgcttatcgtgagtacggagtactgggcttctaggtacgagtaatccgttagtacggaggagtagactagtagtactagggagtattatatactgtagtagtaaaaatttcgttggatgtcacaacatgtttgggaagagtcgtacaacggtactagtagtttagttatgaacaccgcagacaacgtagatgagcaggagatgcaaacctttttaaaaacaaaagggatagaacgcaccaaacatggggaaggttcgtcgtagatggccgggtaacctgggcacacgtgtgcagtagaattgtcttttctgtggaggacaccaagtcgttgtttcaagctgataaaggatcggtaaagatacatttcaaacttctgcctgagtaaaccaatatcagatttttttttcacatacatacaaggtagcctttgaccgatcagcctggtgacttggtgagtgttaacaatcttccaaaaagatgggccactcgataattcggatggaacggcttgtgtttgcataaataagggcctgtttagttggaaaaaaaaattttgggtgtcacattgaacgtttgaccggatgttggaaggggtttttgacacgaatgagaaaactaatttcataactcgtctggaaactgcgagacgaatcttttgatactaattaatccgccattagcacatgtgggttactgtagcacttatggctaatcataggctaattaggcttaaaaaattcgtctcgcgatttcctttctaactgtgtaattagtatttatttttatctatatttaatactccatgcatatattcaaatattcgatgtgatgtttttaggaaaaaaaatttgtgaactaaacagaccctaacttgagtatcagattactcagtcctctctgcttgtcccgtatactagaagcagccaatcctgtcactcccgtccagtatcacctacggcaccaaaagtccacatgagggcaattgtttggcgacgtgcacagaatatgactactaggtcctgtttagatttaaattttttttcttaaaactttcaactttttcgtcgtatcaaactttcctacacacaaacttctaacttttccatcacatcgtttcaatttctttaaaattttaaatttagcgtggaactaaatacaacctagagtactccttataaagatattctacgtgggttgtttgccttgttgcacggaaccgtacggtttcccatgcgtgggtgcctgaggtccaaagatcatccggatcctattccaagtcaacaaatattagtgtaattcctattccaagtcagctcgtttgtacgggaacaatcgttttctttgccttcacaatagtcagttcatgtagataactcaaaacaaaataccactacctctatttcaaaaataaagttatttctgatatagtagcttcgtccgaaaataaatatatttcgcctaacttcaaatctcaatccatcacaattattctctatttactctccctatcctaaaatataacaatttagttcaaattcgtagtactatgatatatctaatacggtcatatgttgttatattttaaaacatatatggtaaatgttgttcacttagtttctcttttgaaccaattacaacatttttcaatcatttctatttactttcttagtacacatgttcaacttaaaaatacttatattttagaaccgatgtgaggacatatccggtgaagacgagcaagtgttggaacttgtgaaaatcatacttaaaaattttataaattcatgaaaaaaaatagtagaaataggtgtagatatgaaatacattctcactgaatctcaagttcgaactcaacttcatttaggaggtgaatagtaacaagatactattcactctaaatttgtctttttttctccaaaacgaagttgattttggatttgagatttggtccgaatgtatttcatatctacacctatctctagtgttttttttatgaatttataaaacttttaagtatgcttttcatgagttttcaacacttaactcgttttcaccggatatgtcctctgatgtagcaggtggtacaagtatttgatcaaaacacttccaataaaattggagagcacaccaagtaccttgtactagaattcaattaacgtgctgttaatgccatggttgatttgatcatagaacgttcagactagagcactcaagtccttatggcataaccccacatgttactcagacaattagtactattgttgacagcggataaaaatgtgggctaccattcccatcgttagaaaaatgcgacttcgcactatagtcaatataagatcacaattaaaatattcaagtgcactccgagttcatcccgcatcgacagcaactgcaagcgcaagaggcttttactcgtcaaggagaacagagaaacgataacgcggtgccccaccgatcgcagcatcggattcctggggagccgtacactgaccgtactcacgtacgtgcaaggctcaaccatcaaacgatcgaacgatcgacggctcgacgcaagctgccgctgactttgaatgatccgtcgccccgccaatttgtctttagttttggtgtgaatggcgcgcggaaactaggggcttaatgataaactagaaagaaaaagacattaacctacgtggagagcacaaccaaccaaacaagaggttcttatcgttgcccagcctgattgattggctactatatctagtgcccgtcctactcattcattacatggagcttcaaagaaagtaaatttagggggaaactcatggatgcagaagctcatgtgtgttcagctgaggatatcctgacataagctacagatgcgcatatcctttggggaagatgtacgttatgtgtagccgcaagaatggcaatttggcacggaaggcctggttcatgagtcacgaatttttcattcttttatcaggctatgcaggcgtttgccacatatattcagtgatgtgagcagatttccttatatgcagggaaaactgtgtgaaattccttggtggccagttgcgtagtgtaacctttcctcccccacagagagaatacgacggacgttgaatgcgactcatctctccacgacgaacataatttggttctccctttttatttcctgtcacaccttacagatgcagtgcaatccaataatttaggacgttgaccagttatccgaccgctgtcataaacatctttggtcgttttgagtggtgtatgcatgcaggtgcgtgttaatgagtcttccctttcaatcggacatgattagtccatcatatcggctatccagtactactcctgttccaccaaaaaaccaacccaggcaacgatgagatataacctatgacgataaatctggacatgttcatgtccagattcattatcatacgttatatttctattcaagttcattgctatagattatgtcccaccgttgtctaggtttttttaaaaccaacggagtactacttcactgtacaccgcttgtagtcgagtaaaactgatgtgtactaggcatgcacgagtggacgtgaagggcagaagtacagttttactccttccgttccaaaataagctcggccatgaaattccatgtctaactttgaacgtccgtcttatttaaaatattttttattagtatttctattattattatattatgaaacatgaatattacttatgaatattactttatatgtgaacttatgttttttagttttttttaaaaaaataaataagacggatgattaaagttggatatggaaactcatgactgcgtttattttgggacggatggagtagtatatactcctttttttagttctttaatagaggcttgcatgtactccctccttttcatattataagtcatttgatttttttttcttagtttgatcaagtttatagcaaaatattccctccattccaaattgatctacatattttataggtacactaagaccaagaaaagctaataactctctcatactatatttactctagcaacaaactcaatgcatgcaacatccccactattgcatgtgggtaataaatacttctgtgcatggatgcatgtatcaatgtctatttagtacttcaatgcacaaataacgaatagacttaatgaatgaatacaaatatgtagatcatttaggaataacctaaaaaaactaactataaatttggaatggagggagtataagagtaacattt

SEQ ID NO: 81034 - DNA, 1108 bp, Oryza sativa
ttaggttataagattttctatcattggccacatttatatagatgttaataaatctagattcattatgtgtctagattcattaatatttatatgaatgtggacaatgctagaaagttttataacctgaaacggaggaagtaccatataaaaatcttaattttggtgggaatcgtcaatttccataacactttatccctattaatatacccattaatacatggatcgaacataaaagataccattttgatgaatgtgggaacaatggattttctgttgtctcccttccatagttccatggtatactcccctgtcacagaatataaacatttctagctattcctactagaagttattatatttttggacggaggtagtagtttttaggcatggatgaaaatccgttgttaagtacagttttatcccaagaacggttcataattagcttggatgcgacacgtgcgacacaaggtaagcatttggtaaaataaaaacacgtactccctccgtcccgaaaaggaggtcgttttagcgctgaagcaatatcccgcaaagagtgtcgctgggagcctgtcttcgtagttcagacctactctgccccagctcagctagtctgacgttctgccacatcactcaccgctctctcaccccaaaccaacagacatgaaggtgtagtactagtattagtaatgatagaagtataggcgccgtacaggttatttttacactgtcttgatactctcaccagaagttagaacgtcaagtttaaagagactgagggagtatatccgtgttcgaccgtgtcaatctcactcttggatttttgtgatccggagagcaatgattctgagaacgagaggcacaatatgcttccacagggtgtgtttagttcacatcaaaattggaagtttggttgaaattagaacgatgtgacgaaaaagttggaagttcgacccgagtttagttccaaactttttcttcaaactttcaactttttcatcatatcaaaactttcctacacacacaaacttctaacttttttgttacatcgttcccattttaactaaactttcaattttaacatgaattaaacacaccctcggccacaatc

SEQ ID NO: 81035 - DNA, 1932 bp, Oryza sativa
atcaggaagcggactagttagggggcacaggcccagcataaagggggagctttaaacctcgggtgggccgtgagcccgtcactgcctgggatggggaggctgagcaggctgcttttgcacggtttggttgcagaataagttcatttaaggtcccttaacttgtaaatgaatccgattttcgtcctccatccagaaaaccagatacaacgggtcgctatacttacaaaaccggtgcaaaattagtcctaaggcagtatgacgagtggttttgtctgatgtggcattttgacttgtcctacatggcattttgaccactgagttagcacaatcgttagggaataaatggggagcggtggattctcgcgcgttagtcgccattcctctcccctttccgaaaccctagcttaatccggggcgattcggagagcggaagcgcggcgatgggagctagaggagtgagggttcgtcgtcttcttcgcggcaatcgtacggctcacctattccctatcgggttgctccgttggattacaaacccgcagtgttgtgcagatgcagagtgaaggccgcgaggtgcaaagtgaagcacagcgcgtgacctcctgctcctctgccgccatgcggcattgagagcggtgctcggcgtcgccatcttcgcatcgaacagctgcagcacgctagcaattgtcccctcttcgtcgccctctctgtcgcctaggaggagcgcacctagagttagggtttgtggaccaaagaagagagaaggggcacacccttttttaaccctctggctgacttagcaagaagcgcccaacgggctgtgctgacttaaccgggcttaaccgcggccaacttccccctttggacaaaacaaccctcaatactgctttgggaccaatgtttgcaccggttttgatacttgaaggacccgtcctatctggttttctggtttaggaatgaaaatggattcgttgataagttaagggaccttagatgaacttattcctttggttgcagtccaggtgcatcaagaaggcccaacagggatgcacggtaatatggtatagcacacatcgtggtttgggctagttgccaggcttgaaaagatgaactttcgagtgattaccttaaggctgtgtttagttcctaaaattggggagaagtttgggaaaagttggtagtttggaaaaaatgttgagagtttatgtgtgtaggaaagttttggatgtgatgtgatgtgatggaaagttgggagttggggagaagtttggtgtgaactaaacagggcctaatactgggaacaatattttttagataatgggtaaaatccaatctttagtttaacagaagctactgccacttattacataattcttgactgaaaatcaagtataataatttctaacaaaggataaatagacaacccaataataaacgccaccatcaaagaagagagacacttattcaaagaacaattttattgttaaatctccattcaaagttgacaaaaaatttgcatagcggacgtctccaaattccaacatgcaacgtgaataatcaccatgtcctcttcacacttgtcccaaaaccgaacctaatatgttgctttgaagagtacctgcatataaaatttagttggtgttttgttaaaaactgtgtcatttatattcaaccatagagtctaacataaaacatatgttccaactaaaatatgttttctttggtctttgtgtcaatcccaatcagccaagtatcaaacatatgagtcaaattatgtggtgattgtaagtcaaaagagataaaaaatggttctccaaataaatttagggatggtttggtttgagacctaaattggccttaccaatttttgtcaatgataaattttggtaagttttggcatggctaattttggcaaggtaaatgatggactactgt

SEQ ID NO: 81036 - DNA, 5821 bp, Oryza sativa
  unsure (1)..(5821): unsure at all n locations
caaaatcagaactcaaaaaaagcaggaattcattcagatcgtaacctggtcaaattcttgtgagcaaaaatttaccttgggcacagaggagatcggcaaaggtggccaccggtgacgatgcggacgggagagatcaacgctagcggagcagatcggtgagcgaccgtcggtggcgatgcggacgggagagatcggctcgggcggaggcgcggaggaaatcgacgacgttggtgacgctggccgacgggagagggatgggcgttgttggcgtggcggcgtctcgatggcggatggcgctggatagggcgatggagcgatgcgagagagaagaggcgacgtcccgatggctgatggcgctggatagagcgatggcggcggcgtgagggtgcaccgtctgtggcgtgcgagagaaaggaggatgcgtgtgaagagcgtgatggggggatgcgcgtgaggaaaagggaaaggaggacncncgtgangaacgcgtgcggaagggagggtccgcaacgattttgaggcgttggatcagatgattcttgaccgtcggatttgatgaatggggtttgtaggagtgtagttggtgagttatagggtanatgtgtgtcgtgcatgctgcatattactctgtgctacagtacatatagagagcccttttacaacacacaagtttgattgagtcaatggttttatgggctcgtggcctgtgtgtgggcccaatttcatttttggtccccttatcatccacatccagttgaccagtccctcctagcccatacggcctatattgtgaaggccccagaccaaagtactgatgggccatgttcccaactctgtagactgtagtctggacttccacgtcacgtccacaattcccatttcacacatttcatttgggcctctaaagtagaaaggtctcaacttttgacgttccaccggtaaacagcagcagcagcagcaaggcacctactcctaatcgtctcatgtaacacgcgagttgatcgtgatcattcctccatcacgaaatatcatctcacgcaaaagcacgaagtccacctgccacggttctggagctccgctcctttttcccaaacacagcagagtttcagacttttcagcttcggtttcccttgtttctgatctttctttctccttcatcaaggcacggaacaatgcgatctccgcgcggtgttttgcattttgcaaccgaaatctcgcgaaaacccaaacccctcccgttcaccgtgccgggactgtacacgttctgcggccacaagccatgggatttccaaatcacgaagtacaataaatggaagaaaccacaagtttgttccacgcaatgcccccgcgtgatccacgcgaccacacttgcgaggagcgcgcgagcgaaagctgccgcgatggcgagacgacgtgccgcgggtcacgtgtcctcgtggcacgctaactcgggagtgtacttaaggccgcgtctcaccaactactcggagtagtttggctgcttgacctttgtactgtgcttgtgctgtggtcgcggacgacgatggctgcgcggtgctgggtatggggcttcgtcgtcgcgctcctggctgtggcggcggcggcggatggggaggaggaaggaggggaagtgggagccgctgattcggatgccgacggaggaaggggacgacgctgaggctgctgctcccgctcctgctcctgcggcggcggattacggggggacgaggtgggcggtgctcgtcgccggctcctccggctacgggaactaccggcaccaggtgagctcgcggtgatggagttgggtgtgttagggtctaggggcgggggcggcggtagagattagagactagtagaaaggaaaggaactgcctttgggggaaaattgaagcttttggcaaattcccctttcttgtgggcgtttttgcagcttgtttggattcgcttcccgattcggagaaaaatttactgttaacattcttgctgcaatgctgcttccaatttgtggtagattttactaattcctaaggcaacccttgctccaaggctgtatgttcttctaccaaagctcctgctatctgactactgaaatcggcctatggacatgttctatttgttcagaggcatggctatccaatccgtattgctacttgcttcgcttaaattttgaaagctccatacagttatgttttcgataagagaggaacaatctctaagtcaataattaggtgggaggcatattggttggcaacatcagttttgatcgggcgaagattttttaaattgctataaatatgacgactacgacactacaaataatttattgtccttcctgcatgatttatgtttgtttatcttctaatatattgacgtgcaatccttccgcgcgttcgagaaaaaaagatttatgtttgtttagtgtgtgattgatcaaatacgaacagttcttaagataactgaacaattatatgagtgcttgtttaatggacgttggtgtttcctggtgcattgcaggccgatgtgtgccatgcgtaccagattctgcagaagggaggagtgaaggaggagaacattgtggtgtttatgtatgatgacattgcccataacattctcaatccaaggcctgggaccatcatcaaccatcctaaaggtggagatgtttatgctggtgttccaaaggtagcattttcctttaattgtagtttcaagaaaaagagggtgcaagtagttctagtttcagtcttcaaattcgatttctttttctagtcatgttgtatggatctctaatgctagttttgtatataatttgaatgtgtctgtattcatgcaaggctgatcaacttaacatgcattacaggactacactggtcaccaggtcaccactgagaacttctttgctgttctcttgggcaataaaaccgcagttactggagggagtgggaaggttatagacagcaaaccagaggatcacatcttcatctattactcagatcatgggggtcctggagttcttggtgcatactccagcatatgatatttttcttagttaattttgtatggaacttagcttacaattaacatattttaggtatgcctaacctgccgtatctttatgctggtgattttattaaagtgttacaaaagaaacatgcttccaacagctactcgaaaatggtataagatcattttccccttttcccttccattttttataatccaaaatgatgtacttagactgaaattaaaccctaatttctgcaggttatatatgtcgaagcatgtgaaagtggcagtatcttcgagggcttaatgccagaaaatcttaatatttatgtcacaacagcatccaatgcagttgagaatagttggggaacatactgccctggggaggaaccatcacctcctcctgaatatattacatgtctaggtgacatgtacaatgtttgcttggatggaggacaggtaagcttcatttagtatctcttaggtgcgacatcttgtggatttctgttcttctatataatctttttcggtgtgtcacaggtatgccttaagggcttatgtaatttacttttcagtttgcaatacttacaatagtttataccagctacagtcatgactgaacattgttggtccactctatgatgtacatgctcagtttatctttttacgccctggaaatttgtttctgcgttctgatttgggaccactctcaaaagttgtctatttgtctttcaacatctgtacaaatacacagtacatgttttaatatctgtgtggtaagaagtactgccacaaggcataatgtatcaacatgtcttcctgtaatattagtcacctgactaaacataagtaatccacaagtcactgttcttcataatggcaacaaagaaaagcctgtaaaatataggtgaagaaaagtatcaattgatagaacaaccaggtgacaaataacaagtgcatgtattgctttgctgctttacacatacttttacactgtagcaattatgctgtgatgcttgattctgaaagtttttgtccttttgacagtgagactcataatctaaagaaggaaactatcgaggatcagtatgagctggtaagtcttgagtgcactttctcgatattgattcattgttttctactcactgctttcttgggcaggttaaaaaaagaacatcaaatgcaaataagttaaatgagggctctcatgtcatggaatatggtgacaagacattcaaggatgagaagctcttcctctatcaaggttttaatcctgcaaatggcaacatcacaaatgaattgatttggccagtaccaaaggctacagtcaatcaaagagatgccgatcttcttttcatgtggaagagggtaaattctagctgtcttcagtttattcatttccgtccttcctttctttagaagtccaaattgtatgtatataatactgagttgtcgtaaactagggttcttccactactataagttggtcggcgaatattaatataaaactagcatgttaactgaaacatgatcacacacaagttacatactttggatgaaacatatagattatgatttttattttcctttttcttgctgccgaatagaatggacagaggcatggccccttgatgcattgacatatattgcattctgacattatgttgttaggataatggtgttgaatttgctagagtagtttctttcatgttgatttggttgacatcgcctgtaagaattggcatcattatctctgcatcattatctcttttattgttaactggggctctcttgtttagttctgatctttattttctactagaacaaatgcccgtgtgttgcaacgggtgaaggctattttaatcttattattgtatacggtttaactaaggtgaaattgactgtgggaatttgattggatattttcttttttaagaaaatcatgagctgcaattaggagtctgcatgcaagattttttaaagagatttcttatacgactccttatgtatttctaaaagcaaacgaacttaaaatccaactcaaacacggatttgtatttccaaaagcgaacggactttgaaaaccgactcaaacacggatgacgtactaaaataccggcaaaaacatcttcaatttttataatagtagagattgctcatgaccttggatatttattctatggacacttcaccctttcttgcctctacttgtgtatggaaataatggaatacatttcatatttgaaagggtatagtgtgatatgcttcgtatttaaaaaggccatcacatggtgtacgtgtgacagctgatagcatgatactatgtgagctccatttccgagaacaggactaagttaagatgtctgaatttttaagccagaaatattttcagagcatatgacagtttcatgctaatgtctgtatttactttttcagtatgagcagttgaatggggtgtctgaagacaagctgagggctcttagggagatagaagacaccatagcacacaggaagcatcttgacagcagtatcgatttcatcgggaagcttgtgtttggttttgaaaatgggcctttagcccttgaggctgcaagaagctctggtcaaccattagtcgacaactgggattgtttgaagaagatggtgagtacaaggctcttttttttaactctgatataagccatctataaatatttcttgagttattgtcttcttgttgcctgttggccttaattgcacaatgctatccttggttcattgccaattgtcaggtgcgaatttttgaatctcaatgtggatcactcactcagtatggcat

SEQ ID NO: 81037 - DNA, 737 bp, Oryza sativa
ggggaagatgggccgagggaaaatcggcccatcgaacccgggggaggcaaaatagacttttgcggaggaatttgatttggagggaattggattcggaattgaactcgacgatagatcggggattgagatcttgagatggcacggacactagacaacaatcagagaaacaaatttcgcaattagggtttttaagagataattttttcccgctaggcgccacgacggaacgggcgctacacaagcgggtcccacccgggaccacgtgtggtgagcccagtccaccggctctctctctcctcccctcccgcgcgcgcacttgggccgccttgggccggccggcccatttaactcggccggtccgctccaattcccttgggccgcgccttagccgcccgaggaaaagtctataatccctccctcttttcttttcttttttttccaaaaaaggatttaattaaatccttttcctttagaccaaaaatccaataatcttagaaattcaatatcttcctaaccttcgatccatttgactccgttcaacttccaaaattcctcaaatctcgagatctatctaatggcacgcttagaggtcattattagggcttcattttcgccgtttgttgagttgtcccgtttcgcgtgtagtttcggagcccgaagacccgcagtgcgatgatttcgaggatcaagctccagatctcgagcaaggcaagccacctttgaacatcttgagccta

SEQ ID NO: 81038 - DNA, 743 bp, Oryza sativa
cccgttcaagaagagcagacggaatcggtgtaaaagtgaaagggaaaacgccaaaggtgcaaaacgaagtactagtatcgacatgttgcagagttagcagtgcattagattatcagtttagcacccaccacttcttgcaggtttaatcagtgtcggatggtccacttgggacagggccagtcggcagagccttatcgaaatggttgtgtgctttgggcctcacaaactgaccgaattaatgaaagcaatgcgacaacagcaaaaaacaccatgatcactgatcgagggggtgttgcgagaatcgaactcgcgacctctcgcacccgaagcgagaatcataccactagaccaaacacccagtttgattacttctttatcttgtattttcaaatcctaatacaatgtagcatgagtctgcagtgctcgcaggccgcagcttggtgtattcagagcccgggaatattttgagctccaatatatacagagtacagacgaagcagaagacggtacaaactactacaaaacagtgaacagcgacgtctttatgcatatcatgcgtcttctccggaacacgcatgcatacctccccgaacggaaaatgaaattgatgacacgagtaaaacctaaaaagagttgcatcacccacagcaaccactccgtgccgatgtgtcatgcagcacatacgcctcgcctcatggagtgacttcatcgctgatttgcttgggacctaccgatccaatcga

SEQ ID NO: 81039 - DNA, 797 bp, Oryza sativa
caaatcgcgcgcatcggcaagggaaaaaccgaccgacaataatgagcggctttcttcaagaccgctacattacttgagtagcgcgcgaattgggacgagccggttcgtttcgcctggagatgtgatgatgtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaagccgggctgccgcgccgattcatgccggaatctgccaccggccgggaggtggttgcgctgggtgagggacgcccggcgccacactacccggggcggtccgtattcttccttcccttcgcaatggcagggctggtcccgtcattctcttctttcttcatggatgttctggagctttatgatctccagatggcgcacctcacccccaacgcagtaatgacgttggccatcttcgcgcacctgtgcgagatgttcatcggggtgcgcccatctc

SEQ ID NO: 81040 - DNA, 9999 bp, Oryza sativa
ctccaaacttccaaaattctaaaaacaatgagtttttattgtacgtaaggtacatttaaaaggttaccagtcctgaaaactcaaaacctccagtgttatgtagcaccatccttgccactctcccattggatggctgagattcattctactgtttttgtccttttaccaatcctatgctcattatttactacattatgtggctctttatgcttgcattatcagattgtctttcacttgttaagattgttaccggtgaccagtattgttgtaactttgagaccactattatttttaattaattagattatgatgcaagaaattttaatagtatgcaatatacttcaataagatgacatctatttgtgtatttagatttttgaagaaaattgtgaatggttaaagattaactgtgaataccctgcaaaaaagtttaaatatgaatagtggttagtgataagtactaactctatcctaaaatatgagaaattttagagttgaacacgggtattaacaaagtaggtgaaattaaatgggggagttatgtgattgtatgagaagaggagtataagaagaatttgaagggtggaagattgttattggttgagaagagaatgtataggtggagaagttgttatattttgggataaatattaaatgttagaagttgttaaatattttaggatggagtgagtagtatacaaagcagtagtggaagtatatatatgatcataccgagaagaaaactaagctacacatagtgttttcttttttgagagggcacatagtgttttttctttaaaaaaaaactcattagatacacgtagttaacagcgacacaaaagagaaaaaaaataaatgtcactagccagatcgatcggtcggtcgtttccacacgtgcgcgcgtgcggcccggccacttgcgcgacgatgtgcgtgtgaacatggaaattaatcgctaatataaacgagtttctagctagccttcgcgctcgagccacactgtcgtgaagaaaaaacggttttaatttcgtagtaggttcatataaaaacttactctaacaataatatttctcacgtgaaaggtaaggaccacgtgccataattaaatcatgctaatgaataatttgtacacacgactgacttgtagtagtactgaactagctactactccagctaggaatagagtactggatagctactgcgtgaatatgtacgcgtcgatcgtcttgtgatgactaccaggtcgtctgttgactgatcgatctatagatagatagatacagtttgtttttgacggtcaatgtatacgtgcaaaacgccgaagaagctagtggactggtggttaaacttgaacaagcacgttgcttaattaattactccgtccgttcacatatggtatcctcatcatcccgtaatgtatgaaactactgcagaaaggatcttcacaaacggccaaagctagttttcatatcagggagctccactcagaatgtttttttttacttttttagacttttttatgttttagttttattattagaccactcccaaaagtattttcgaaaactgaatcttttgattaggcgtgccagcgatgtcctgccacgtcatcagtggtggcgtgacaagaggctggcgtggctggtatgatagagttatttggccacaccaaggggctggcgtggccaaattaatacttttggaaatggtctattaataaaattaaaatataaaagtctaaaaaataaaaaaaaattcctccactctcaagtaataggtgtgagttgtctacgaaaatcggtattttaacgtgcgagcatcacatccggatgtaacaaataattttcacagatggacatcctaaggaggtcattataaagacccgatttttccaagtagccaaataaggaagcaattatttttttcaaaaaataaaaaaaataaaagaattccaaaaccctagccaggtcatcgtgaggccaccgccgcagtccacacgcctcagctcctccgcctccattttaactacgctgcccttccgcctcctctccgtcgcgctagagcctgcgagcaatggatccgccctccccccctccccccgggttgggggggaggggagatcagccgctcttaagcctaccgacggtgctgtggtcgtggactcgtggtcactgctcttggtgccacggtcaccactaccgccccaagcccgaagtccgccatcgccattcagagaggcaaggaggctagtcgacccattgggagagagagaagagtagagaggaaaagtagcagtgagtgaggggagtgagagtgggagtgggagtgcgaaggaggaaataaaagagaggaagagagggaatgcaaaggggagaggaaaagaacaaagatattaggatgggggagcgtgcaacaggtaggaggagaagagaaacccccttgtgaaaatcaatttcgtagacatatctcttaatcaagagatctgtctatcaaaatagctattttctcaaaggagcctagtaagaaactcgtctgcgaaaatcggttttgacaaacaggccttgatcgaacatcatcaatgaatttttcatatggatcacctttcaaaataaagagaggtgtccgaaaaaatacctttatagttgttgcaacgtgtcaaacagaaagaaacaaggaacagagggagtatgaagaatcattctaagttaatacgaaagtataacaacatctccaccatcaaattagttttatattaaataaaatattaagtatatttttatgatatatttattttacgtcgaaaatatttctatattttcttcaaacctgattaaatttgaaaataaaaaattgaaaatgtcttataatatataaaacagatagagtatgagttacggagacgtctaaataacaaattctagagttctaacaaactcgatcggtggaacgtgacatgttctagagctcagactattcgtcgcgacatatattttaatcttttttaccgcattgctatttgccagcgagatcgatcggactatacatcttccgagccatagctagaggtgctggttcggcaagtatgtttacatgcatgcttatgatgaatgcgtcgtattatatataaacacgagcctatacgtacgtatgtatacacgttagtattcacactgcaagtgtggacatattttagtatttcactactagagaaaccatcgtccaaaatccataatagtcccgatttgaataggaaccgggactaaagatgatttttaatcccgattaaaaactttttgatctttcatcccggttggtaacactaatcgagattaaagatcatttttagtcctggtttaaaaagttgttgggatgagtcagggctccaattatctttaatcccggttggtataaacaactgggactaaaatatcttttgtcccggttgcttatacaaaccaagaagttcaccccgatctgcgcgcctcgttcttgatcagtcgccgtcaatcttatcccctccttcttcctctctcctcccctcccattaaataattaacaccctcttatctccatctcagtcatctcccctctcctctcaccttcttcctcccccttcccctctcctccccctccccgcctcctttccaggcggccgagcccggtggcggcagttggcgcgtcgggccgcgcgaagcacggcggaccgcgcggagggcggatggggcggcggcgtggccgcgctggcgagcggatgggagggcggctagagccggcggccggcagcgccctcccctctaccaaaggggaggcgggaggaagcagccggcagcggcaactcgattttgtttttttttttgaatttttgatacattggatctgagaatttttagaagttgtcatccattggatatgtgatgtatttcttttagaatttgtatgtattttttttgagaatttgtgatgtgaatctatgtttgtgatgatactttgattttgatttgaggatatgattggggatacagggagcaactcgatttgtgcggttacaacttgatttgggaaaaaataataaaaaaaatagtgactaaccgggattggcgttgccaccaaccgggactaaagatgaatttttaatcccgattattttacccggtactaaagatttcccggatactcccgattacaaaactgagagtataggggttatcaaccgagagaaaaaacgctttctccaatagtgattttacactttcgtgtaccgccgaaaggacgatccaggtttcagatttaattcctccaaattaactctgtacgtccttctaaacttgattttctcgagctataaaattctcttccataccataattattgcgacaatctttaagtatctccattagtatttttcagccgtagttcatgcaaatgagatgcgatggcatgcgaactaagcaactggttatgttcgtggatcagattatatttgtccgtgacaaatactaagactattttttaccaaactacaaatactagaattaattagtattatttatgtcgactaattatccatttaatgataggcagtatattggatacacaagctttaacggatagggtgcgtattattgcgagtagaaagtgcgagagagattgaatgaaaagagcgaattgagtcaatgcggtacattttatagatggggaagggatgacaaccgtagatgcgatggttgggaccatcgcgtccgttgccaaggagcgccgagtgtaagaggcgtggttgccttatacagatgagatcaccatgtagtttcttaacacgtatgtttacatgcgtaagtgtatatgcgcgtctcgttcatactgtggtatatcttttaaaaaaagaaacggagaaaacttgcgcccttaggcagcaaacttggtagctagccatttgaacacacccctaaaatcctcatgcaagttatttgattatgagacgctatgaaaattttggccattatttcaacacccgaaatgctgtccagcttttggatacttatgatgcccatatccaatttttctgtgccaaaatattttgcaccaagtcgtcaattaaacattgataatcgatcgattaggataatactaatcgccaacccgtaaattacacaggctactgttatttatgttataaagatttaaaattttaatttgtgtgaaatacatcggttattataattaactttcatgttcggaggacaaatataactgtttcataactcaatggctgtcatattatgatccatttaatcaatggctagatgtgtacatgagaactcataggaaatatccaattagtatttggtatatagtacgaaggctaatcggtgcagccgcgctagaagcacacactcattatattttgatttttttagacactcgtactatctaagagcagacactcgcttaagcctataagcacacacttcaaaagaaaatctttacatacatgtgtactatctaaaagcgcatactcgctagtaacaatttttaagcaatttttctataaagtgatttatattagattgaaatttatctaaatgaacattttagaaagttatttttgatatattttgattttttttgaagacttactcaaatggagtacaatttttctaatataccatttcaactgaaaggtcatttcaaatttaaaaaatcgagtaaaacttctactaaaaatttgataccttttaactcctatatcagaaaaccctaatttttaaactttcaaataaaaacttacaaactttcaactcaaattaaaaagttttaactcatgagctaaaaaaacccaaattttaaaactctcaactcaaaattcgaaacatttaatacaaaatttaaaacttttaactcatattttaatacttttaagtcaagccaccagtagctaagttagttgagtcaatcttgtccaagtgtttacattaaatttattattcatctttcattaaatttctttctacatatagcgaaactcgatgcaataacatttaagctcttgtcagcaattctatttgatggatctgtaaaaaagtgtcaatactatactccaagaagtatgtaattttggtaaagtccatagtgatgactcataatttataaaaaaaatcatattgatttggttaagcatgtacgtacaggggtagtttttacaacaaaactaacaaaaaaataatttatacagtgaaatgtcaaagtgacttctggggtgattttttaattttcatcctacataattcacataatatttcaatatatatctccatcattttttataatatcctatatacctacatagttcatcatcacttaattaatgctatttttctattcttttattaagccatatcacttcaattgtttatagcacttagatgattgatttatgatccaaatatcacccttcttttattgtctcataagccatatcacctcaattgtttctaactcttatatgattaatctatgatccaaattatatcccttcttttcttctcccataaaaccacatcatcttactttcatatttgaatcatcattctatatagtatttaaattatcataaaccaaatcaacttatataagattatgttgtctagatattttacacattatttctatttgttattatcatactaaactcacacaacaacttatgtagtttcacatggtatatacagatgtgctaacattgcttataatctgaagagaccgagggtatgttatttttttctattttcttttgcaattaaattgaaggtgacaccgggaaattataggatcgaacacaagtaaccaaacctactagaaatggtaaatggtagattacgttagtggaagtcaaataatcgaatcttgatagttcaaaacacaacccaatcttaaaaaccaatggaacacctgtccagtggtatatccgacctactagagtcggtgtgaccgaggcctggccagtctgaccgcatatcctctcgcggtctgaccgtcagcctaaaaaacagcacgacaaaacttatgtaaaaactcgatttctcttaagccaactgttggatcgagttacaaacttaaataaataaactagacaaaccaagaaacaacgccaccagagcgatttgcaaacttatatatggtttaagagaaaacaccctctcgaaagtcggctgtcttaaaatttcagcaaatctgaacaaaacctaaaacttaagcaaattcgaatttagcaagatccaatcaacaaagtattagaaagattttggatgaattaacttcaacaaaatcgtagaaaattgaagaataataattccaaaaccgtttacgaaaccacgtctctcgtgatcgtggcctgctagccatctaacaaagctaccatgcacacatgtacagcacacatacatcatacatgcacgtactgcatgatacagtaccttcgctacaccagtttttcttaaccaatttcctccgtgaacatagtatccaatttcgtcaccagcatccttgatcatctggactcaactcctccttgagtctagtcccgatctcaccgttgatcgaagttgacctccaagaaccttaactctagttaccttctcacatggtatcccaaccgtactagaactttgctcctccccgcgcataatcccggtcctcactattgataagtcacatgcacacaatcagacaaaataaccatttctgtgctcagatatcacaacatgatcgacgcacattacccacactcaccaacatccatgcacagtacattctcaaaacaatttcatcgaataaatcatttgtaaagccaattgttcatcacaaatattaatcatgataataatttttaaaaaaatgcataagatcattgtcatatcttgtctcatcttgaaataatatccgtggttaattaattagtctttgcccctcctcctgtaactaacagctaacgcacgtttccaatgtgtttccaagctctattgtattcacactcagctatctgctgcatatgtgttgagatatggagtagtccattagcctatacagtcattagcattagccattaagcttgactaaccttagatttttgttaaggcgctttcacacacttatatacgccctatcacactgtcactattccccttgtgcatatgcggatgaaatggataaaaatggccgaagacatttctaaactgcacctcatattctccttgattgattattactaaaatgatcaacgagtttcactttacccgactagtcatatgcatggatgcctgcgttgaaacggaacattaaaaccggttcaattttttctacccttcatcgggattttggggggacatggtttattttgttttctcgcttggttagtttttgatcgaggcatcgtttttttcctcggttagttctttagagcaagttcaatagtatagcccactactagctctaatttatctatagccaatctaatagccaattcatacaatagttgcttactatactattgatatatggtcccacctgtcatacacacattccgtcttggagtccgtactgcagctggctataaatctgtagcccgctgctcttctctcttatccactggtggagaaaccatctttgctcggtagcccaaaatccacaatagtcctggttcgaataaaaaccgggactaaaagatgatttttagtcctggttaaaaactttttgaccttaaccgggactaaagatcatttttagtcccggtttaaaaagttgtcgggtcgagttaggccccaactcatttttagtcttggttggtataaacaaccggttatttataccaaccgggatcaaaaatcaaccgaaccgcgcaccagtccaccgtcctctcctctctcattaattatcccttatcccttcgatcccaccgtcctccatcccttcgctagctaccttatccctctcagccttagcctcctccatccattctcctttccccttcctcccccttctcctctcttcatcctccttccacgtgaggccgggcggcggcggcagggaggcgggcggccgagcaggcggcgggcagccgggcaggcggtgggcggccaggcgggcgaggcccgtgaggcgccgggcgggcgaggccagcaaggcccgcgaggcgccgggcggccaggcgggcgaggccggcgaggcccacgaggcgccgggcaggcgaggccagcgaggcccgcgaggcggcgggcggccgggcaggcgccgacggggccggcgaggcggcgctccccaggtgggcggcggtgctcccggggcagcggcgcttccggggcggcggcggagcccgaggcggccgggcgggaggccggtgaggcggcggacggccggcgctgatctctgtgatgttttttttcttgatctgtgtgatatgtgcggccgatttgtgcgatgtcgatttttttttcgatctgtgtgatgtgtgatgtgtgaatgaatttgtggagatgtttttgtgattttgtgaatgatttgcgatgtatttggggataaaaatacagcttgatgtatttggagattttgtgaatgatctgtgatgtatttggggataaaaatgcagcttgatgtatttgggaattttgggaaggatccgtggtgttaaaatgatttgtggataatatgaatggtggtgctcgaaaacatgaaagcaggaaaaaaaagaaaaaagaacattagtcccggttgttaactctaaccgggactaaatctttagtcccggtttttaacactaaccgggactaaagatccatctttagtcccggttatttcaaccgggactaaaaataggtatctttagtcccggattcatagtcccggttgtataaccggtactatagggggttgcgaaccggtattaaaaagggtttgtccaccagtgatcgtttatctcattaaaaatatatttatagctgctcttatgca

SEQ ID NO: 81041 - DNA, 9794 bp, Oryza sativa
cccgtttttattttaatacttagaattggtgaggataggaaagaaggacgactgtgcttgtgctttaaaagtagtagatactacctccgttccattttaataatagttgtggtacccgtgcctaacgtttactgtttatcttatttaaaaaaatatgaaaaaaattaaaaaataagtcacgcataaagtactatttatgttttatcacctaataacaataaaaatacaaatcataaaaaaatttaaataagatggacggtcagacgttggatacaataaacccacaactgcatttaaaatgagatgatgttttttctttctggcatatagtattcggtatttcatgacagcagaaaaaaaatccatcttaacacagacagaaaaactgcatacatattgatgaattgtgcttagttttagaccacatatttccgttggaaacaaaaggatcatctacagattctgctgctccttcggaacacagaaatccacatattctttcttttttttaaaaaaaaatacaagtgtaattaatagtttttcccccaaaagattatcgcattaccaaaagaaaaatgctacgcataggatcattttcttatggttttgatacgatcaaatgaaacggcacagactgtaagggaacctaacgcgagttcacgcgcacggggcagtccaagagcattcatgggccctaaagctcaattcacctcttttcatctaactttacatctttctttgttgaaccctaaacctaatgttccctattccatggtttcatctaatatgcaagtctgcaactaattcagatagcatacgccatcctaagacgaaggtatgtcatcttatttgcttgatttccagcttgacaatcatcttctttggtgcactagtctctctcttttatgttcctaggcaatctccatggccataaaatgattgtatttttttattatagatttaatctgaaaatttgctttgcaagacatgccattattttcaatttaccagtttcagcaatgaagaccaacttgtctactaatgaagtacaagatgacattgccaaatctgatgtggatgatttgctgctgagggggtccaaaatgaatcagatgacacatgataaattcaatgttgagcaccaagtacaagtactatataagatatgattaggaagaagattgctttggttggttgtgcaatcaggacaacgagatagcagcccaaaacgtcgggagcttgtgtgacatcttggcccaattaggatgagacctgtgtagctcatgtgagttgtctgcgcatgtttagtaccaccttactagtttagcacgagtggaaccaacttataaggtcttttctctccaaccatgtcactcccaagttaacccttttacacgaagcgaggacgaaaatgtaagtggagttgtatgtgcaagtgggtccgcccatcggttgggctggctacgcggcgtgcgctatgcctgtgtgtcggttgggctggctggagggaaggctcttacagcttggactttttacacgaagtccatgtcaggttaacccttttacacgaagcgagtacgaaagtacaagtggagtggtatgtgtaagtgggcctaccaagcgaggacgaaagtataagtggagtggtatgtataagtgggcctgtccgtcggttggatgggtaagttggaccgacggggacgtcgggtcctttaaggaggggtgtatgtgacatcctggcccaattaggataaggcctgtgtggcccatgtgagctgtgtgcgcatgtttagtaccacattgctagtttagcatgagtggaatcaacttataaagcctcttccctccaaccatgccaggttaacccttttacacgaagcaaggacgaaagtataagtggagtggtatgtgtaagtgggcatgcccgtcgtttggtctggcaacgcggttctggttctggagggagggctgttacagcttggactttttacatgaagcgaggatgaaaatgtaagtggagtggtatatgtaagtgtgcctgtccgtcgggacttggactttttacatgaagcgaggacgaaagtgtaagtggagtggtatgtgtaagtgggcctgcccgactgttggactggctacgtggttctgggggggagggctgttacagcttggactttcgatatgggctcaacagtgaaaggcgatctgttttatcgaaaaaacattaggagagaaacgtttcatcatacaaccatcgtagaaaataatcatatgtacaacaatgctcttttctatgaaaataatcatacgtacaacaacgctcttttctatgggtacacatcatgtattagtgggactatttttgcccctaagctcaagtgccaactagatatggttgggctacacatttcagaaaaaaaaggggtatggttgcatttgggcttgttgggccttacggaggatcaaatcttttaccagcttgatacatgtagatagaaataacaaggttgattataaccgatataaaaagacgattaaaaccatgttggtacaatagaagataatgtatagggcaccacaagagatatgaacgtgtataagacattatctaccaataatgctcgacattattgaaacaccataaaagatatgaacgtgtatagggcactatctccaataccatggcaaatctacaagttggagtcaccagaaaaatcagtgatccaaacaccaaagctgttgccactgaccggacaatccgcaacctggtagacaaacattcctaagtcttcatcaatgatccaaatgcaaacatcaataaatagatagaaaaagaaagtaaaaaactctagacaatgctagcttcatagacatcataaaagaccaatcataatctaactaatatacctaaatcttctaaatactttatttggaagaaacctaaaaaccttactggagtaagtcgaaaaagggttccctccccttgtcattggccaaacactagagacaaaggagaaggggaacgaaggctaatggcagttgaggccaccctcagcgattacaagtaatgaaatcttgtggaaacattttttcttcaattgaaagtattgcacattttagttgaaaataatttgttttgaaggtgaatttagcatttatagttgaaggtggcatttgtttagtttgagttatgttgtattttttagttggaagtttcatgcagtttttgatatggaagatgaaattacattcctaacttctactccctctagtttttaatatttaacaccattcacttttgaacatccatgcaccattggtcttattcagaaaactagtgcaaatatgaaaaaaaatatgtcatgtttataatatgtttaataacaaaacaaatcacaataaaataagtaataattacacaaatttttaataagacaaattgccaaatgtatgtccacaagtcaacaacatcaaacattataaaaactggaagaactatattataagatgaactcaaccaaaagtttccttatgatatattaaattaactgttttggaggtatgtcatgaggaccttcgactaacctgccgaaaccacctaagccatcaaaaatatcggtcaagtcttttgggcgaaacccccgggcgaagccgtagggcgaagaccaaggggttcgtcactaagaatcgggcaaagcctggcgatgaagatcaatgggttcgccaccaagcttggtgaccggccgaaggcttaccaaggacgaaggccgtcaagcgaagcatgaagccgtcgtctggagtagaagatgccttcggctaaggtcccgagaggcctagtggcccatggaggcccttcaccacctaacggccagcccaggaagatcatctcggggcccataaagataaaagacacagtatacccattgtaatatccctatcataagggtaacaatataaaatcccctgtactaaccaaaccatagtgggtatgagcctgtactagaattataaatagccccatagggccatgtaatgggggaccccaaaaattttaaccaattaatatattgttttactattctaaccacccaacgggtttccacgtccttcgacatgacgcggttatcattcgacaacattaactaagaatggacataccctatcttagaaagaagagctaaaataaacaagcctccaaagcttccctcttgctacaaaatgtttcaaactataaaacctttattttattttgctacaaagccattgctacaaaaacatagcagtgtgaagtttcgtatcaagcatctctaacctttagcaataggtgatatctaataaaatgtatgttaatttatattcctataggatgtattttagtttttgaaaaatatttaaaactaaggctaagtttaaattaggtgtacaaacggttgaagacttgaaaaatgggataaatcactagcgtataactaaatgaatattaattataataaacttaaaagatggatttgttcgatttttttttaaaaaattatatatacaatttattttcataaaacacgctcttcgaaaaaagatgctaacgaataacaagagagttgctgaagccaatggaccaaacaaatggggcctaactcctacctcatgtttttgttatgaaaaccaaccccaacatctaatattgcctatatcagggtttacgattccgacgaaatctggttggatttcgcgaaatttcgacgtttcgatgaggctcaaaagtagaaaccatataagatttcgaagagtttcatccaaattcaaatttgaattgataaaaaagaaaaaaaagaaaaaaaatcttataaatactatgatattcatataacctattaggatataaattttttaaaaaatgatgtattatgtgtttactaaaacttagctcagaaaataaaagaataaagaatttaaaaaaaaaggaaaacacttacatgggccagaatacatgtactaggcccagttactgatcgaaatttcgatgatttcgatctgaatttcgccaaaaccgactggttttgagaacttatcggcaaactcagggaatttgtattcaaattttggtttatgaaatttgttcgaaatttaccggtttttcaccggatttcgcgaaatcccgaattccgccggtgcccgaaacggaagggcctgtcggaatcgtaaaccctggcctagatagcattttagaaaaacttgctataacttttatacactaaatgcaaaaagtcttgattcctagaattatgagaagcagctagttagtactttctctgttttatattatatatatctagattcattaacatatatatgaatatgagcaatgctagaaagtattctaatatgaaacggagggagtagctagttttgaaaaaccaggagagttcgtttattagattttattattatatcccacaaccatttcttttaaataaaaaacaagacaaaaccttaggttttggaaagtcttcacttaatattattacttactgtatactcccttcatctacttttgatagtcatatttcatcttggcacacagaccaacgataagtgattctacttatcatctatttaaacatgctactagtcattcctcgtgaacaagcgattcattaatattttcatttctcgatgcctatgtagccaatcttgtgtggaggaatagagaatcacgcattaaattcgagaaagacattaagatgataggttgttggattgaaatatacttatcaaaaatagattttttagatttggaaatatgactatcaaaagtagatggagggagtatataatagcaataacaacaacaacaataataataattaaacacaggtaaacaaagaaacaaaatcaaactccttccccccaaaatccttccaaaattcttgagaaaagctccaacctttcctcttcttcctcttcccctccctctcgctgcctgccgcctctgcttgctcagatcttctcctctccttcccggattccaccctcagttgttgtctcacagtctccgaatcgctgggcggtggagccattggtgctcacccacgggcacgggcgatgggcgccgatggcggcggcggcggaggccggaagagctcgtcgccggccgggaagccggcggaggcggcacgggcggggagcctgctcgccggactcccctcgcggggcaacttcgtcgccgacagcatcgcgtccagcatggtgcgttcgttcccccccacccctaaaatggaccagcctttttcttggcatgttagaagggttcttgtgaaaagccctctgatttttatgattttttattattattttttgcgcagggaggcctcccggtttatgtctgcctgcacgacaccgctcctccaggtttgtttgtgattttctaggataatcaagctttacttttattattgtgatgatgctaatttgttgttttaggaatgagggctgattgtagtgctagtggtgtgtactgtggagagacagatttgaagtagaaggatgatcctttctactagggttttatgtagaattttccttgtaagaacgcagtcatcttgcctaggttttgttctttcgattggcaatgctgttggcatcatgcttaatttgtggttactgaatttgttttgctgatgttaagagttggaatttctatgggtttactcagaatgtctcttgcaggaaagctaaagtctatatttgttctttggatttgtggtggcactgttgattgttgtcatgcttattttatggtttcctggagtagtttacaggttttcggagtgagaattgcaggtgtttgtgaaatattgtactgaaccattctttggtggttaaatagatttaaatcttctggatgtaaagtgtaggagtttagtagcttggcaatggggataaatggtttgctttccattcaatgaaatttagatttagtagtgtttgggagtgaattttactgcctttgagttttctagtgattacctaaagtgagctgtccctaaggaaaaaatgaagctacagagaagaatttctgatgttgctttttttttcttcggatcgagtgagacattgtgctgctgtcacaaaacttttgccatgtgtttcttgggagtcttatcttttgaatatcatttttggacgtatatgatttacattttatagtggcagttgttagtatatgatctattgtcagaccatgatcttttacatattttcattacttatgttcttatgataaagctgattactgatgacacaaacagatcattttaaggctgttttgttctgttcattgactgatcaccgtttttgtcattttagagggacaagttatagacacagacaccacaaacattttaatcagatctctccagttgagcaaacagaaaaatgaggcaaaagatgtaggatcaaggactccaggagaaagcagcaaggggaaaaggtacatcgctcttacgacatctttacaatattgaacctcatttttgcaatgtacaatgttcagttttagagtttcaattaacagcttcagattattttcttcatgacatggttacttgtgaactgagcatgtccctcctgaaacttttttgatcaaataatcctccctggaacttgcttcttaatctagcgttgtttgtcattttcctcacttgatattaagctattgacttactgtcatttttatcgatctgttgaacagaaattcatccatcatagttattgcctgagcagaatgtagtttagctctatttttttgagcaaaaaccatctgcagaaccttcgtcaaatatcaatggaaacattgttttgcatgaaggccatcaatttgatacaagctgttggatgattttggaaacttgtttccctttaaaaaaaaatctatgaactaagtaaaatccatatcgtagtctcttggatgatacaagtgctaggctacagttaaaactgtaagataggcaattatcagacgaactctgaaaacatgccttgacctgggattaacttggggaatgccctagtctatttaattgaagggcggtgtgctactgccatttgcattacaaaaaagttatgccagacaaacctattgttctcctatgttttttttttttttagattttgatttggtgccttttctgtcattggaatttttgtgccatttagattgcttgtgatgccagctagtaggacaaaaatcaactcttttcaattgctgacttgtagagaagttgtctcctaaaacttcttgcaattgtcagttaaattttatcctccatgtagcttatgttccttcttttttatcaggtctgcttccagacttttagatggcaagaatccatctaaaagagctaacactggcagcacggcagggtcatctgcccatggtaactatttgattcttctctgcaccctttcttatatgagtagtcatgcatagttttatgagtaatatgtgcattgaaggaaaaggcttatcagtaatttatttgttgctgttgtacgtttgcagtgttaggtaaataatgttagttccttggaaaagaaattgctgttttccctttgttttcttggtctttaaatttggagttgtcaaacttaggctgtgttcttttggaggggttgcgaacccctccccttcgcacggaaaacggagcgatagattaacacgtggttaattaagtattacctataaaaaacttgaaaaatggattaatatgattttttaaagcaactttcctatataaactttatgcaaaacacgtaccgtttagcagtttgaaaagcgtgcacgcggaaaacgagggagatgggttgggaacccatgggaaagaacacaccttaggccgtgttctttttatgggattgttttggctgattagctgcatgcaaaatgagaaacataattagcatatgaataattgagtattaattattaaaaacttgaaaaatggatttattttttttaaagcatcttctacatagatagtttccgcacgaaacataccattttttttttgagatgagagaaacataccatttagtagtttgaaaagtgtgttaacggaaatcgaggaatagctaagtttaatcagctctttagaacttgcccttaatttgggtgagaagttgaagttattataggacaaataaactggtactctactttgagtggtacttttctgtaaaaaaaatggcactgagggcatttatgaaactatagctgatgcagatagcaaaaattgcgtgattcattgtcgctttgctaacttttatgttgctattatatgacctatttcctgaattttcagaagcatttagacagttgtatacatattttgtttttataatacgatgcaacatttgtttctttttctgactacagtgatgcttctggccagcttagttatatgaagtaagaaatcaatacatcttaaattgaagtatccaagtataaattccaatatggctactacgtcatatatcaaaatcttaaaatataaataacattatgatagttttgttggtaaaattgattaatttgagaaaccaatgatgtggttttaatactgagtactggtagataattaaaggaacgcactgccaaataccacgcaaatgtcacataagctggagaataacatttgctgtgatattttccatccaaaggcctcaaatgaacaatcatgcaggccgaactattttcttatttccttcctttgatgtactccatgtaatgtgcccatcag

SEQ ID NO: 81042 - DNA, 7585 bp, Oryza sativa
tgcaattcacagattttgcaatggcatttaccagcccaagtttgcagtggtattttccaagttacccttctttgagatggcactagcaaatttattgtgtatatccctttgtatatgatctgaataaatagtgaaactcagataatttcagatgattaaagtctgctctaactgtgcaagcctagttttcttgtaccaaattagaattctgaataacaataagattccatatgtttttgaaaaaaaagattttgacctatattgtacatagattattcagttaacacctttttttaggtattttccctcatcatctgagcatcaatattatcttgagaacaacataatccacaaaattctgagcatcaatcattttagtactattgaatataatatcaactttgatcttgcaggggaattgggatctgttttttctgagcagacgctccaatcatttacggtggagaagttgcgtattcttctgaaagagagagggctctcaccaaaaggcaaaaaggtaagtacagaaaatgcttaattttgtaactccctctttcagttttaagaacttgcaaaatcttgtttatgcctgggagattgctagacgtttgacacccaagggtacattgttctgctgtctcatttaaatctagaaaattttaatagtactttagttttctagtcataaatttatgactagtgagtcccagtgtgaatatttctgttgtaaatatttttttcattatattaataaagcattaacagcaggggcctcccctgctgtgttgtctttttaaaaaaaaagggaatcatacatgtgtggaacacgctgcttaaataaaaaatcatatgtttggaattgttgataatcatatacctgaatttcaagaaatattcacatctttttgattgatcgactttagcaattggaatttcgatctctggtgactggtagcctagcggtgggtcatcaggtagagcagtttgttatatgcttgggtgagggtgtttggcttcatcagaagcatgcacaatgtactgttggcgactgttgctgtggtgctgaccattatggtgttggaattaaagggaaggaaccctcagattgtggtgggtaagagatggtggtagtggaatcatatcaaagtgtggtgctattgactagagaaaagttgatgcaggaaggaaaaaactggagattgtggcggagggttgggtttggtttggctttggccggggataataaatgatggagctgtagcctgtagaattaggccttgtttagttcccaaaacaaaaacttttcacccatcacatcaaatatttggacacatgcgtggagtattaattatggacaaaaagaaaaaccaattacacagtttacgtgtaaattgtgagatgaatcttttaagcctaattgcgccatgatttgacaatgtggtgctacagtaaacatttgctaatgacagattaattaggcttaataaatttgtctcgcagtttcctagcggaatctgtaatttgttttgttattagattacgtttaatacttcaaatgtatatccgtatatccgatgtgacaaccaaacccgaaaatattccccaactaaacaaggccttagatggacttgagaggggtggattttgcttagagggtatacagaagggtaatgattacttgaatagacatggtggagaggatgttggtttgggtgcgctgacgattgaggatatatactgaaggttttagatatgatgtgtgcaaaccatgcagaaggagacatgaccatattggacagctttggtgggcattcaaatttttaatgcaatatgatatctaattggcaaatggtaatttgtatggtgatgaaatcacaaacacacaagttacagaaatggaaatacaattgttttgatgtttttagggccacagttgtgttttcttgactaactatgattagtgaaccttgtaaacaaataaacaatagcatgagaaacagaaccctcaccccaaccatgatcagcactgtttgcacctacggacactggatttcacagggaaactggaatttgaaatggagtactttctttgatgagtagaaaggcatgtattgaaaggctaaacaccggctgatagaagttgtcaatatatggagacaatagtcttatattcgctgcccattaaacaaaataatactccctccatcccaaaatgtttgatgccgttgacttttttgaaaatgtttaaccgttcatcttattcaaaagatttaagtaattattaatttttttcctatcatttgatttattgttaaatatacttttatgtatacatatagtttacatatttaacaaatttttttgaataaaacgaacggtcaaacatgtttaaaaaagtcaacggcgtcaaacattttaggaaggaggtagtatgaaggatatcacacgttcgaagggttgttcactttactgtctatcttttgaacatttagttatgaaccaaaaaagaatagcactcatttattttgagatcactcatctaattccttttcttgctaaatcaaacttttgtcccttgttgcaggatgaactgatcgcccgcttaattgagtcctcggagtgatctgaactgcgatcggaacctcattttgttggatgttgtaccgtagtgacgatcatacaccatgcaagtgaacttctatcgcagacctcatgtaagcatatatttcatacagtgccgaaatgaaagatctggctgatagtttccacattgcaccttgttcgatggagctccttcaacgtttgcacgacgtgttgtgtttaacactagtgttacccagggcaccaagtctgtctacgtccgattccctcttggtgaatctgaatctcctattctgacacttcgtttcgcatcgtgtcggtgcctgggtacacctgtgcaccctcacctcgtttgtactccgtagctttctgggtgagaaaggctatttagaccattcccaacccaagacactagacatagtttttataaactccgcgtcattatcatcaagaaactagtactaggcactattcttccaatgcaaacacaactattccatacatacttatcccacacgatgtcttggatgttgtgtagaaattatgtctcatgcaagatatggttttcttctctttcttcatttattcgccacatcatttttcgtcctaggtggcagcttatttaatgctatggacatcatcctagttattgggttgggaatagccttatgttcctacggaagcgtctttgaccgctgcgcgacgaggcctctttggatgaggtgcttgcggaatttgtgggccgctacccccgcaaatcatcgcggcgcggacgacaatcttcgaccttgacgcggtggtgggcgacggaatcatcgacctcgtcgacgtgcaacaaggagcaagctagcttcgcatgcttgcgtgtatcctcattctactcttttatgttgtcaactatgctatgctgcagaattacttcttactactatgtcccagaaaaaatcaaaccctgggtttgtgtgtctagatttagacctagagttcgatttttttttttgggacggatgggtacttttgttgctccaaaaggactcatcgacaccgaacggctgcgtccatcgggtcacagagcatacagctcatgtaccgcgctacactttgcatatatttcatcagctcatgtacaactcaagtagcgcgcgtggtacatgagctgatgacggaaacgacatgcgacctagcttgtttccatggaaacaatgctgcgaggtgactgccagcgatagatgacggtcaggcaaaatatctcggaggatacaagtggacagccacacaatgcatggaaccagctagggggccacatcctgcttctttggagctctggtgtgatcgaagttcgcgacatcagactaagacttctcaatcacgaccagaatcacactactgaacagctcggataaagcttcctcctgtaggcggtttataggcccacgagccatagaggaaaggaatacttccttcaaggaattaggaggctaaggctgtgttcgttgctcctagttcccaacccctctcgctcgtattccgcgtgcacgcttttcaaactgctaaaggtgtgtttttaataaaaagtttctatacgaaagttgcttaaaaaatcatattgatccattttttttaaaaaatagcaaatacttaattaatcacacgctaatagaccgctccgttttccgtacgtattgttccttttgggaactggctagacgaacacagccaaagccggaggatgacgagctgtggctattaattggtttcaacatgatttataaggcaaacgataaaaaataacacgaacctcaacttgaggtgaatgagccggttccgtgctgctcttaaccactgtgagctcaaagagatccaccttcaaaataggaaaatcacttggagaaatgagagagtttagctgacacttgttaagatggacagattcttctgcaacgaggaatgggacctcacctttgggcatcacatcctccatgcgttgtcttttggaatatctgatcactaccccttgcttatctccaacccgggcaggccacggagccgagaaccttcaaatttgagaacttctgggtaagactatcatgattcaaggaggtggtcctgcatgcttggactcaacaaacgacacaccacgaacctctacaccgcctagctagcaaacaaaatgagacgtcctatgattgctttaaaaagatgtgtaaagggcgtttgctcaaatatcacatggcattggacgtaatccaccgatttgacgtggcccaagagggccgacacctaattaacacaggcagaacacaggctccgcgcggccctgaaaagaaggctcctaggttttgcggtcattgaaagagcaagggaaaaacaggctgcaggtaacaaacattacagagggagatgcaaacatgaagtacttccacggcaaaatcaatgcacgcaaaagaaaaaaccacatctatcgtttgcgcaagcagagtggttgggccgtcacacataaagaaaaggagctctccatcgctgagcacatccaacacgtaatgggccggcctgaggctagaacacacgatctcaactgacctttcctaggaatcaccccgctagacattagcagcctagaagaaccattcacggagggcgaaatccagaaggcgactgtacgacgtaagaaacgtgcatctaaatcttctcaactctacaaatgtggtccttattccaaataaagatggagcggaggaaattggagactatagaccaataagccttcgtcaaaatcttatccaaagtgttggccatcagattgcagccgctcatgcattcgatgatctcgacaaaccaaagcgctttcatctgaggccgaagtatacatgacaatttcatgtacgtcatgaacatggtgagaaagcaccatagaaaaagaagatcgattctgctcttcaaacttgacatctccaaggctttcgactcggtgcaatgagattacctcctaaccttagtgcataatagggggttcccatagagatggaaaaataggataacgggcattctatccatttccatatcaaatatccttctcaatggaattccgggccaaatgattcggcatggaaaggggttgcagtagggtgatcctctatccccgcttatgttcatcttggcaatggatcccctataacgaatgctcaaaaagccactcaaatagggctgatcagtaagctacgaggcagagcagtacgcttttgcacgtccatgtacgccgataacgcgactgtcttcacaaacccaagcaaagaggatgttcaggccttctccgacctactccaccactttggacaagcaacgggattatgtacagacctgcaaaagtcacaggtggcaccgattcgatgtgatagcttagacctggacggcatccttgatggcacgccagctacgcgggcctccttcccgatgaagtacctagggctccttcttaccacaactaggctatgaagaagggacctccaaccgctctatgacaaaatcaatgagccggattgcaggatggcgaggaaggcatgtgggttaacccttattggaaatcaagaagcgggttagagattatggttctaatcatgacttagtagataaaaattaactgatgcagcactaagtatgaaaaaaaacataatatctagacaatcaaggatttgactgattttcagggtggtagataccttagttaatctaacctggtaaagcgatttagccgataccgacataaaccctaaaacgaatctcaaccgatataagtaaatcgagctatcaaactagttaactaagatatatgacaaacaggtgcttacatttacaagattagagtgttgaagccctagccgtgccgatgcaaacagccatgacaagtataaactcgtcgaaaaactagaaaagttaaaagggtggcaaatttgtattgatcgtggagatagtttacaatgaccccgggtgtacatatttatacccatgggtagatacgagtctttcttgggcaataaagaaactttcctaaagataaaaggaaaacataaagtccttataagacattaaacacactttcctaaagataaaaggaaactagcagactcttactaattaatagataaactgacatatcacatcctgcttgaatttggtctcttctagataagcttcctttaattgattaatttccttaaccgaatatagtaagaatacgactattggcgacttgataattctcatcagccgattctaggactttgaagttgatattgactctaggcagatgatgacttcagggcttactaaatttcactgttaacacatatagtattagatagtatctaattgctatattttgaatcgaagggaataaaatttagttgacaacgctgtcgacaggggatacccgtagactggatatagagggtattggggtacgctggtacgaggatctacgtagtacgacatcaagcaaacaggaaacagggattatactggttcaggcctcttgataggtaatagccctaatccagttgatatgggattatatgatggaaaccacagattacaaagggaataacagaactcgatgatgccgacgagaccatagtcgagttggttcgactagatcacccggcgatttggctcctgtaggctccgacttcgtaggctgtggtggatgtgttggcggtgagattcgatgccttaggtcctcccggggggtcccttttataccgcggatcaattgatctctaagtcgaactcggagatatcggaccccacacgatatggtaacgacccagtcttgtccgcgtaggagttctcccatgtatggattctatttctgccacgcgatagatttccttaacgtatacagaaactgcccgtatatgcacaggtataccatattggtatacaacatacatccaagggtagagggtataccttattcgtaaccctgaca

SEQ ID NO: 81043 - DNA, 19825 bp, Oryza sativa
atgtagacacgaatacggatatttttttcccgaatacgaatatggtatcggggtttctgtcggatacggatatccgatgaatagtgctattcggatatccgcagaagccatgagacataccatattttttttatagttcaatgacgttcaatataccttttgaaattttaaaagtagtctatcttttaacattagtccctgctactaatattatttaattttttaaaaaatataaataatactatatttttataaaaaatgagctaattatatatgatgatatttgtttctactagaagttgagttggttttcgtgttctaagataaaattgtttccgtattcgtgtccgatcatattcgatttttattcatattcgagataatccgtatttgtttccgtatccaagctattcgtgttcgtttctatatccggtaaaaaaaatgaaaatgaatatggtatgagtattatccgtccgtatccgatccgttttcatctctaattcatatcaatgatgagcaaattatatctattcaatactcttttgcaaaatccaaatgctagctgctaatgctataggattttaagaacttaactatatagttcagttctattgtgcagtgaagaaacactattttacaaacaattaaacacacgggcattaattttttctccagagaatatgaaatgaattcagggacatttctgaggctaatttacgcattattaactgctgcttcgcaaaaccactgtttttggcgcaggaggcaaaggatcaaaaactaggggcgcaactcactgggcgatatgtgcaaagagtctagaactaagcataatctatagcgtatcacaacaacgaaaggccgatcctgatctggacaaacgatgggaactgcgtttgttttgttctttcctgagacataataatttaataatggccacacgcccacctgctacctaccttgtcatgtttgctctggattgtttgtcagtacgagcatgcagttctttgctgtgttggtgactactagaaggctagtgtgtagtgtgtgtctatgtatacatgcacaagaacgaaggccgtggcgactacgagagatattatgttaatttattataccatttcagtcttgtctagctttgttaaacttgggaagcttgaacgaagaataggaggggctattatgctattttgtgtaacagtacttcaactcaatatagtgacttatggacaacataatttttcaaaaacttagagtcggggacatgacaatattgacctcgatgagctttgccacttactcgacaacccaggctgccttacttctcccattctattttccgactgctcctaccatgagtccgcgtgtatccaagagcgtcaccgacatcctccaagcttgtcttcaccgcccactttgaacgggcattagtgttcctgatggatggaggttgacaaaaatcatgaccgagaggcatggttggaattttttaaaatttcaatggcacgtagtaggtttcgtgaatggtaatagtatttttttaatatgatatatttactatggcacgatctaattaactatttaaataatttaaatgggttgtttatcaatattttcgtagctagcgaagctataaagctgggtgcaacagaagatccagatgaagttagtcagtacagtgaacggcatcgggaaatgcaggcagatgatgtctgtgatgacttcatggagcactttacaagtcacacttgacttaaaaaaaaaactctcaatatgcaaatgcaagcacacgcttctatatacttatgttagtatgtcgtgcaaaactcttgcaacttggaattcaatgataattagaaacataattccaattgttagctaggatcaactaattataacacatgctggaaaaggaattccatgatacagaggcacatttgcatttaccaaatacattcagggttgagagagatgtatggtcagctaatacaaggcaaacttgactaggcttttatagagtacctgtagaacggcacaaatgcaaggcacaagtcaaacaaacttcaaaactgttgaagatgattggatgaacatatatgtgcaaatttgcaaaaatacagtggaaaatgaacgatggcctaagtcagtattttgactatttttaaataaatcaaataaaatactctctccgttgtatattataagtcgttttcacttttccctagtcaaactaatttaagtttgatcaaatttatagaaaaatataactattttcaacatgaatcaagcatacttttaaaatgtgttaaatgttagttttgatgaaactagtttggtgctatagtaattactaattttttctatatatggtgggtcaagtttgactatgaaaaaaaattaaaacgacttataattttaaacgaaggaagtacatcttaaggagtttaacatgtaccagacctatacatttattaaaataatatcctagttataactttccaacctatacacacatatcctaataagaacatttataaagtctgttagttacgcaactacactacaatagaagcaggagaccactctgttttggaggatgtaaaaaattccaactaatgcactaatacttgacaaataaacttcttccacataccagacataaaaggaacgagtatcataatgaacattaggtgtgataatgctatctactccctctatcccaaaatataataatttttaagtggatgtgacatattttagtacattgaatttggacattcctacctcatccccgcagaaaaacaaaatcaaaactttgtactttaaagttaccaagaaaatttctttttatttttttttgtctcctcacaaaaaaaaagaagaaacaaagtcttcttgttaagtttgtactaccatcgcaccagagagagagagagctggaaatggatcccctttaaaagccgttgcgttggctctgccgccttggcaacaacatccaatttccaaaccaagagagaagcagcagcgatggcgatgcggcagggagcgctgcgaggcccctccgattactcccaggagcccacccgccacccctccctgcgcatcaacgccaaggtgccggccgtgatcgcagcagcaagaatcgcatcttcttccttgagtttctactcgtacgtactcgcgttgagttcttttgtcgcgcaagtaaaatgtgttttttggggggcgatggatgcgtgcaggagccgttcaatgcggaggcgacgaggcgggacctcgtggcgtcctacatcacccccgtggatctcttcctcaagaggaaccatggccccatccccatcctccacgacatcgacaggtacggttcttgatttgtatttcctctctttgcctgatttatttttgtcaccttcttagtttcaacttaaaatggtttcagtcttttgttttgtggatttgcagctactatgtgacggttgccggtctgatagagaggccagcgaagctttatctgaatgacatcaagtgagtcgtgtgtcagtcatcgtggctgtgctatgcatgccttctgtttgatgatatgcctgagaggtgatcgagttttttcgtgctttctttgtgtgcaggaagctgcccaagtacaatgtcactgccactctgcaggtggattttggtgtcctggtggactggtggtgtgtgtgtggattcttagggccgaattttgtgtgacatggtttcgattggttcagtgtgcagggaacaggaggaccgaaatgagcaagagcaggaaggtgagaggcgtcggatgggatgtctgcgctctcgggaatggttagtgtgcttcacttctcaatcttctttgtgtcttactattagcgtggtggaatacggcaaaaggaagaaagaaagaaaaaagatgcatggacattctccagttaagtgtgtataggaagttgtcatcactcaccaatgtaataaggaaacctgtcttatatgatcttagctgcaattttgaatagaagtgagttccatgagattgataaaggatgtgctgtaaatgtttaacttaattcttctgcacttttttactgtcttcgatgcataatcatcatattcactgtcactgaatttatgtgcttcattttagcgacatggggaggagctaagttatctgatgtccttcagctcattggtgtgccatatcatactgaaattactccatcaggaggaaagcatgttgagttcactagtgtagatcagtgccctgtgagtttcttgagacttcatttatgaaaaaaaaaaatatatatatgacagctttagttattttttctataacatctttttcaaaatattattaggaggaaaaaggtggcccttacaaagcatcgatttctttaggccatgcaacaaatcctgcagcagatgtactggttgcatatgaaatgaatggtgaggtaggaccataggagataataataggttatatcttatataccatccttacatccatctatcaggatatttggttatttcatatatctgtgcatttttctaatcatatccctattatgtgtttttgttacaaaggtgctcaagcgtgatcatggataccctctccgtgtcgtagttccaggtgtgattggtgctcgttcagtcaaatggttggacagaattgacataattgaggaagagtgtcaggtatgcattatctaacttcttgtcaatatgtaaatatattttcagtttgccaaaaagatttttgaaactcgttcattttcagggtttctttatgcaaaaggattacaaaatgttccctccatctgttgattgggacaatattgtgtggtcaaccaggaagccccaaatggactacccagttcaggtgttaattcttaaccgtcttgtttccacacagtaagagcaagagcaactatagcaaattgagcaattcagaaacaaaaaacatcatgttcctaaccatgaaaagtctgagtatacaaggaatttccagtatacatcatttcgatacaacagcatattggaatgaggatggcatccgtattttgtgctgcttatctaaatatcacacagtaaactacatgaagttctgtttccaatttacattgtcatatattctattttgccatgcaaaaccttactgtaacagtaatttcctctagtaatttactgtattgcataatattgaaaaattgtgtgcactaattaccttttggaccgactctgatatttcagtctgccatatgctctttggaagacacaaatgccatcattccaggagaagtgagttcagcttcttaactgggcttttttatttccattttgcttcatgacttacccctaacgctttgccttattgtgctcttcaggtgactgtcactggatatgcgttgtcaggaggcggccgaggtattgagagggtggatatatccactgacggtggcaagacttggttcggtgctgtccggtaccaaaaggaaggtgtaccatacgtcgcaggtgacataagtagtgacaagtgggcttgggttctcttcaagactgttatcgatgtgaaaggtgacacggaggttatcgtaaaagcggtatgctatcttgctagttcgtcctacttgcaattcaatgttgttttttctgttccattttacatattggctgcaggattgttcattctaatataaatgtactgaatcttgtggcacaaactatgcaggttgattccagtgcaaatgtgcaacctgagagcgtggagaccatatggaaccttagagggatcctgaacacctgctggcaccgtgttcgccttctgacaatacacaaccttagaagccttttgtgatgatcctacacatacacctaactagtattatctctttaaatttaccgctctatgttgcactgtcgttccgctttcggatctgcattggagaaaaagagtcaagagggaccaataatataatgctggctgacttgcttggatgctggaataaaatcccgtgccaccttgttatcctattctttttgagtaagaaatatgtgtgtatgaaataatgggcacaggctagatcaacctcatttaagagtgcaaaacagtttgcctctttgttttatttggatgcaacaattggtcaacatacatggaatggtttcagatttgtgtaaccatgtagagaaatagtgatctgaagatttttcatatgctcgtttggtactgaatcatcataatttcaatcttttagtattattactcctacattttagacaaaagctggctgaagccgtttaagttacttttcttctttttttttttgaagcggaaaggagttctgtcgttttatattggtagagggacagaaaaacagttatgttactcatacttagattaattaatctatctatttgggcttctgatccatgaaaatttgcattccgtctctgtttattcaatctgtaatctcaaacatttccaagaatgtgtgattgaattgcagaatgagcttggtatgcttactaagtacaccctccaactaaaaagaattaaacttctaactgtgaatatggacataaaaaaagatggagtgggtaaggatttgtaccaagataagagggcaaagtgtttatttatcctcttttctccttgtcagcatttatcaaaactgaatcaacattacaagcggtgacaggatcaaaagagcaatatttatgcaagtttggatgtattttttgattgcatgtaagatagaagcatatgaggtgatcatgtttaaaggcctagcttgtgatcgttgaattgtggtgggttgatggcccccccccccccccccccgaaaggccttgttgggtcaattccatgagggagggatttgaggggatttattccagatctattgtggtgtgaaattattcctcctcaatcccctccaaaccgaacaaagcctaagtgtttatgaaaataaattggtatagcccttatatatatgtttagatgtcctatacgttcagcacaaaataatattatcgttcaatatatatagactaaaagaaaataaaatttattaaacgcaacaatatgtagaagcaatcacaacaaacgggattttcataatccatggcaacgccattagcattcaaaagctcttttttttttactgacaaaatcagatggtctaaggcagtttaattatgactttttttttggcaccttctgtttctgaatttcagatgcccaattccactttcccaaacttttctgcatatattctggctgtattgctgataataaatattagaccaaagaatcaacaaccgtagagttatatagaattgaaggtacatggcactctccttgagcacatttgcagatatatatgggcattgaaaattttgctggactctaggagtgacgatttaggtatggaaggcaccaggacggatcagtgggcaagtgaggtggtttatgcaaccacaaggccaccagtgattttgatcagtgagctgtagtgtactaccgtttataatttttatcctaatttgcaatcaacacctaatagtacttctaatatgtttgaaaggtggctatatggatcaaattttggtttgggacaacagctatttcttgggctacatggctaagttgcaatgacatggtgttgataatgcaaaagcgtgttatcctatatgcaggtaatttcaggtccacacgctatgttcggcattagattttgttgcaaaaagaggagaaacgggattatgcaagaacatctaaaaacctacagctatgtaaatatgtaataagacatggctatgtgcatctgtcggtgtggaggctggggtatatttatattccattatctagaaaggatgtgcatgtgtaggccgcagttgataggaataacataaacaaacactatagttgttgatcatgtattagtcaatgttataaaaccagccccgaaatcacatcggaaaccaaacgcggaagaaaatgccatagaagatccaaacacaatgacgacaccgaggtacgatatttaataacggagttcagttgaggcctacatctccggggtactgattacgggcgctccttccctatccagcatatacagcgtatcagagttacaacgactcacggccggtcaccgccgccagctgctccctctcgctatgctaagtcgccatgcggtaacaacaggcacgcgccctctatttatgagagattctagaatagagtctgactcatactctggtcctaatacctattacaactttgagtcctaaactgtaaccgactacgtacacatattcgacacaaactctatcaaactccattttggcaaatatgccacagcaacctgaatttgttccttgctcgaacctccatgtaccaggacttgagttggttccttttcgctgctcacaccgagccgccccgataagccttcatcaggctcaccgtaaacaagagactccgctatccctgtaatttcttcttcttgactccacctgcaacagtgcttcaccctatctcatatcaccacagtcgtcttgccaagccaaattggatccttcctagctgtcacatcatacacttcccgaagactatgttcaactccatctaccgtcttaaatttgacttgatctaatccatggtcagataacccgcgttatcaccaaatagataaatcaaactcacctacaagtctaaacttgctttaaatctagtactctattaattgttgaaacttgtctgaaattgggctgaacttgttaactgtggtctggaatgaacatggtctgaatttgctgttgagattggtctgaacttggtgtcaaattggactgagcttatattgcatttgctgttgaaattggtctgcatttggtctcaatggtcagaaattggatctcgtacgtcaccattagtctgaactttaatttcttgaattgaaaaactcggaacatcatgtaaaatttatcactttttccacgattgcacaaaatcaaaattactgattgtaccataatgattgcacagattaaacaacactggataactggctaactgcagttcattgcatgcattacaggaaaacacattatgctgctagattactactagtacattatagttccctaagatattggcaaatgctataatattacaaacggagttgttccgttgttgacacaaaattaccctaaaatacagtgtagataggacgaaacaattggagtttcaaccggatccaatcgactgaaaccttaccattacatcccaatccaaattaagccagagttttcgcgggaggggactggggtctggtgtgtgtgccggggggtgggggtgagggggctcacctggagggcgtgcctgttctgcttgaacttgaggaacctgcggacgcagaagaggacctgctcctccgagagcgggcacctctcgcggagccatcggccgagctcctccaccattccacccgacggcagctgcgccgacagcctcgcgtagagcgcccacctcgcaccatccagcggtcgccgctccgggctcgcgtactggagaccgcgcgcctgactccccggggcctgtgagaggcgccactacatcagagacctgacaacatggtgttctgcttcttctcgtctcataattatgttggaattaatagatgggctaaggcctattcgaatattaattctttggaaaatcacaaaagcccacctcatgggatggcatacatgtggagtttagtaccactttgcttattctaggagaggggacctccttaaaagggaggatgccctcctagccacttgaagcatgtgtggtggagagaagagggggaacacgcgcttgcttgctcgccttgcctagcagggcagaattgactcctcacccttacacagatgcagccttcttttgcagttttgttttgctgcaggaaaattcggatttgttttgttgttggaaacattccggaaaatccggtgcatgaaaacggcgtggagtccggatcagttacgcacgacttatccggtttggttacgcggagtggagatcgtgcgggcgccctgatcaagcgacctatctctatataaaccgagccgctgccttcacgcaacacacgtgaaatcaatctagggtttgcctcctcctctgtgctgcgccgtcgctcgtagactactccagttttgttttgctgcaggaaaattcggatttgttttgttgttggaaacattccggaaaatccggtgcgtgaaaacggcatggagtccggattagttacgcacgacttatccggttcggttacgcggagcggagatcgtgcgggcgccttgatcaagcgacctatctctatgtaaaccgagccgctgccttcacgcaacacacgcgaaatcaatctagggtttgcctcctcctctatgctgcgcgtcgctcgtagactactccatcccgctggcagggcagaattgactcctcacccttacgcagatgcagccttcttttgcagttttgttttgctgcaggaaaatttggatttgtttcgttgttggaaacattccgaaaaatccggtgcgtgaaaacggcgtggagtccggatcagttacgcacgacttatccggttcggttacgcggagtggagattgtgcgggcgccctgatcaagcgacctatctctatataaaccgagccgctgccttcacgcaacacacgcgaaatcaatctagggtttgcctcctcctctgtgctgcgccgtcgctcataggctactccatcccgcttgcaggcgtgcacctgcgatcggaagagcaggtttccggaacctctgccttcgacgtcctgcaccgggagaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttactatggctggttttgccgatgcactgaggccggataaatttaccggtgtgcactttaagagatggcagatcagggtcactctgtggctgacagctatgaaatgcttctgggtgagtactggcaagcctatgggcgttcttaatgctgaccaggagaaagaattcgatgaggccactactctctttgtgggatgcattcttagcgtgcttggcgatcgtctggtcgaggtgtatatgcatatgaccgacgctaaagagttgtgggatgcactgaatactaaattcggtgctactgatgctagcaatgtgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctcctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctctctctctccctcggattggtttggaaactcctcccctaacctcgccggcgccattaatggcggccgggactcccgcgcccgtttccccctcctccggccacccctctcactcccaaccctatataaaccctccccgtgcctccctccaccgtttccgccactcgccgccctcattccctgtcggaatcgagctcgcgccgtcgctctctctccgccgtcgccgccgagctccggtccgccgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccatcgacccggggtgagccgtggaccgccgcttcttttccccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgttttccggtggggtttgggtgcatgccagtcgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcggaggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatatttttaccccttgtacccccttgcattaatcatgcatctgccggtgtggcttgctgagtgctgtggttgtactcattcttgctcaatcttttccccccccttcagtaagagaagcttaggagaagaagtcttaggtggagtcctggcttataccccagttgagcgcctgtgaagatggagccgtaggcccgcaagtccgctgctgtttatgttgtttgtcaggcctaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgtgacaagctggtatcagagccatctcgactgtaggataagccaagtggataaaacctaaggacatattttataaataaaactatttgcgaaagttccttttttctccttcccctaatgctatttgcaaaaggtttactcccttcttcctttttcggatttccactagtacttgatggttagttttgcaaagaagaagatgtcgtcaattgtctgccgaagctccagaaggctgcaggatccgctagtgaagtgagggaagcagtgaagccagcggtgaagcaggagtgaagatcttggagaacccgtcacagaacctaagccaccctctagggtagagtcgttagtcgtgtgtttccttgcttgtgtgtgtagcgcgtggtttgcatcagtgggttgtgatgtaaccatgctaggttgtttgcttaatcaacttgcagaataagtgaaacaaacaacacatcagcaagaagagttagttcctttaaggtcctgtccctagttctggtctattctttcctggcttgtttcctctctcacctcaatccctatcacagatgtttaacagagaaaaaggaaagaatgtcagcgggtatgcctctagtaacttaagtttccaactcaatccaccactggcctcaagagagttaacaagggcacacccttggtccattccaagcatgctgcttagttcacagctaccattggttggaagtcaagaccaaaatcggtatgtgtttgatcgagcatttgccacccaggtcaatgagcttccaatgccagaagagcatgtccccttttgtcatgattgtagagaacaaggacactatgccctgaattgtccatgggtatatgccaaagaagccccttcctttggtttagcagggcagacatcgctaaaccagcctcctcacaccaagtcaagcttgcagcctagtgtgcaaagtagagagcccaatggagagaatccattgaataccgggaaatgctttcctcctagcctttcgcaccacgtggggtcacgtactaagcaagccaaaggcaagaagagtaagaatcagaagagaaaagcaccgatgcgaactgaagaagaagtacgtaagatgactattaccaacaccgaatggcctccagcagggataactattcctagacgtcaaagaggaaataccttccgaggtgcacgacagttgacccagcacctcttaagccatggcggcagagtatctgatagtgaagggtcagatcaagtctccttggattatgaagatgagtctccccgacatgtcggcagggatgagatggaatcaaaagcatgcccccattgtggagaaattggacatgttgctagcatgtgtctcacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacgattgtctcatcagctagtcagctccaacaacaacatcgacgatatcatccacagcaccaatgctcctcctgctgcacctgactctgcaataaatcatagcaataataccttcagcaccaaccattctctgcaccgacggcctcagcaaagaattgtcgtcgatggaagaagttgtgtctctccccgacctactccaggccgagcaaagggcaatcaacctcaggagggcgataccaagcagaagaccgttatctgcttcgaatagcaatcagaaggaagcttctcctgtgaatgatagcaatatacagtcctatcacatcatcacagaaccaatcaaggatgcagtcactagaacaatgccagctatatctctccagaatcagaatgagtatccatgtttgtgatttttagttcgctacttatcacgtgttgtcgaaagtttgcagcaatcatgtaataaataaatatattcatgtctataaacagtgagcttgctatgtttatggatgattcctgttgaggatacaatgtaccgatgttaagcaccttccctttttgtttaaggcagggccttgtattcgtgtaataagggagaaatgtgtaatacagacaagttctaagaggattcttttggaagatgcagatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacttcaaggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtagaacgaaaggtgattgataaaggataacgagaaccatgatttgtgtcactcgaggaagactcccgatagcgatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgataacaacataaagagaatagtgggaagtaaactaaatgtaaggaaagtgaatccgagctgcttgttcgtgagagccattcccagttatggaacaagtgatatgtttgaagataatctatagaggtcagatcaaaatcacatctaacaacgaagcttcagatctggcaggatcacgatcagacaataacaagtccagcagcaaagtcattcgggaagacgtcaaagcatgtcaagtgggataaattggttctcttgggaagcataacttatagtaagagtggttgacccttgcatcgaatagcagaagtacctagcaccggagaccaggaaagctaatatgagacagttaatggcaagttgtcaatcatggtatccttagtaagcgggatatcatagtctaaagcatatggtggtaagctggaaggaaacgccaagcatggtattctcatgatgacaagcatggtatcctagtaatgacaagcaggttacgacacatgacatgaagttgataacttgtgtgaggttgacgccgaagatatgaatcgtgagaagttctggaacggaagcatcattaaactaccgcaacctagtctgcgtcagctaaaaggtgcaccctggttcgagtcaggtgaaaagaagattccacctgcaacaggagatcgagccaagcagtccagagtggagaagttttgttaggcaagtttgttatagaagacggagcggaagaagtcagacaagaagagaagaccgcccaacctatcttcttgctaacctcctcgaatctcggagacgagattcttgtaagcggggtggatttgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttagtctaaaaagagccctcaaattttagtggaattttcagagcacaaataataattattaagaaattaacaaagttaaaatgattttataaaaagaaaaatcctaaaaagtccttttttccccctccccctcttgggccggctcggcccatccctccccctctctctcctcttccccgtggcccattcggcctcctccccgcgagcgtgccgctgacgggcgggtccgcccgccaccctcgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattcccttcctctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgggctgcagga

SEQ ID NO: 81044 - DNA, 7027 bp, Oryza sativa
atgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggacctcatcgtccccagaagcgtccgcaatccacattaaagaataccacctgttagagataagctgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaagaacacatcaaggttaaaggtgtaaaggaatacgttgaatgctaactgaggacaacctgaagataatagtgggaaataaactgaatgtaaagaaagtgaatccgagctgcttgttcgtgggagctattcccagttatgaaccaagtgatatgttcgaagatagtctacagaggtcagacaacgaagcttcagatttggcaggataacgatcaaacaataagaagtccagcagtaaagccatttgggaagacgtcaaagcatgtcaagtgggagaagttggttcggttgagaaacataattcaaaggcaaagttatcgacccttgcatcgaatagcagaagtagctagcacccggagagcaggaaagttaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaaacggaagcatcattaaactaccgcaacctagtctgagtcagctaaaaggtgcaccctggttcaagtcaggtgaaaagaagattccatctgcaagaggagatcaagccaagcagttcagagtggggaagttttgctgggcaagcccgttcaagaagatgcaacggaagaagtcagacaagaagagaagaccacccaacctatcttcttgctagcctcctcgaatctcggggacgagattcctgtaggggggtggatttgtcacgtcctgataaattcatcccgaaataaaaatcattctctaaaaggaataatagaattaattaaaattcgaaaagaaattggcaaacactaaaatacgtgccagaagaattcgaatgtggtccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctccctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgcccttaggtgcggctgacgcgtgggacccccggcgccggccggtgtgagcccgggtgcgcccggtccaccatggaccgtggggctgccgcgtgggccccacccccgtggacccggtccgcgcgcccctcccctcggctgaagcaataaatccattttttttaaattaaaatttaaatgaagaaattcgcaaatattcatttaaagagcatataaacttcaaatggccataacttggccatttgaacttggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttcaacatattgaatcccagcttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatggctttaggtagatgcttcgctggttaataggacaacattaggtggttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccactataaggactaagctcgggcctctgttgcaaagcactaccgtactaccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctgggggcttagtcctgcctacctgtcccgggggttccggccgtaggtggggttgggtcggtactcttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgctagttcggtctgaatcatcgtaggccttgggctaaggcaggctcgtgtgggttcacgaccttgattaataatactgtgtagctctaggatcgtctttataaaatggctttgggcaactaagtgacttttaaatgctattttctgcaaaacttaacccctatatcattaccccttgtacccccttgcattaatcatgcatccgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgttgtttatttttgattgtcaggccttaagtgcctttgtaataatgtaaatattatcgatataataaagatgtgccttttgtatcatgtttgtgtggtgtaccctggcttttcctgggacggggattaatacactagcgttcgggaaaatgcaaaattttctcggtcgcgataggtattcaggtagcagatccaagcagctattgaaggaggcaaaatcaagtttgacgactctaagaggccgatgaatgttgatggcaatccttttcctgttaatatggtgcatacaactggccgaacagccgatgggggccgtgcaatgggttttcaggtcaattcgactaagattatcaattaatatcagaggaagtatgacaagcaacaggagaagcattacgaagaagatgacgatggctttgatcctcattggggttgtgagttctttagattctgttggaatgaaggtatgaggctgccatctattgaagactgtcctgggtgcagtgatattgccgagagttcaagccaatcatatataaggggcaatcggctaaggctgatgagagttcctgttcatcaaagattgggtccagtgagtcaagatcgtggccagaaggacagcgaaaatagaaaaaatcaatggtgtccatctggtatctctacgaagaatcaaaagagaagggttcaaagattgaggaacagggagcgctttcaggaggtcgagcaggaaattaaccatcggctaaagaaaacaaagccgacgcaggagtggcgtgttaagaatcaagttcctgtagccgatgaagccacggccgatgagccaaaaaggttggctaaaggaaaaatcgttgtagctgcttcggtcaacatggttttcacattgcctgccgagtttgggatcaagcaagccgatatcgatgaagttgaagaagaatcggctaaattaattttgtcgccagagcaggcagtttttgataagccagaggggacagagaatcggtatcttaagccattgtatataaatggttatgtcaatgggaagccgatgtccaagatgatggtcgatggtggggctgtggtaaacttgatgccttacgctacattaagaaagctgggcagaaacgatgaagatctcatcaagacaaacatggtgcttaaagactttggcggcatccatcagaaaccaaaggagttttgaatgtggagctgacagtcggcaacaaaaccatccctacaacattctttgtcatcgatgggaagggttcttacagcttgttgcttggaagggattggattcatgctaattgttgttttccttcaaccatgcatcaatgcttgattcagtggcaaggcgacaagattgaaattgtgccagccgacaggtcagtcaatgttgccagtgccgatttagctctttgggagatggatggtcttgattgtttatctggaaaagtttgggatggagattttctaaaagtgttcgattctaatatacgccaattgaagatggaaaacacaagctattattttgagggcatcgtggagggttcagatgtctacaacaaggacacagtagatgatctcaatgacagacaaggacagggttttatgttggccgatgatttagaagaaattgatataggtccaggtgatcgaccaaggccgacatttattagtaagaatttatctgcagagtttagaaccaagttgatagagctgttaaaagaattcagagattgcttcgtttgggagtattatgagatgcctggactcacccgatcaattgttgaacatcggctacctatcaaaccaggggttaggccacgtcaataatctctgaggagatgcaaagccgacatgcttgaacctatcaaggctgagattaaagggttatatgacgctggttttattcgtccttgccgatatgctgagtgggtttctagtatagttcatgttattaagaaaaatggcaaggtcagggtgtgcattgatttccaagacctgaataaagctaccccaaaggatgaatatccaatgccagtagccgatcagttggttgatgctgcgtcagggaacaagattttgagttttatggatggaaacgtgggatataatcaaatctttatggctgaagaagatatccataagatacttttagttgtcttggtgcaatcggcttatttgaatgggttgtgatgactttcggcctgaagagtgctggagctatatatcaaagtgccatgaattacatataccatgatctaatcggctggttggttcaggtttacattgatgatgtggttgttaagtctaaagaaata

SEQ ID NO: 81045 - DNA, 12081 bp, Oryza sativa
ttaattccgttttggtaccacgtaccgttctgtcactaaaaaatatacacaccaggtggcatactgttatgttttttatgatatcatagttattaagtccggattgatgaataaactaaacaagctctctgttagctggtcaagtggttagatagtcggtaataaaatatttgctaccaacagaagcgatgagacggtgggttagctagcgcgcatctctcagcccctgcgacctgacgatgaatcccaatggttaggcatatgcgccttgagaattgaattggggcctcgaccagccagaccaacaaagaggctccggttattgttgaccgttggtccagtccaatccccttcaggtcttgaagtgagtagcctagaacagagcgatgcttttctaacacatctttgaggttggaggtctcgtcagtagacagcttgtcgctgatggtgacgggcgactccgtatcaccatgcaagaaggtataaggaaagcctgaaagaagagatttgagctcatctggaggtcatgaatgtggatcagttttgggtaactcgatcatctctctatgatcgtcctagctcctcgacgaatgcattggcatcattttcgaggagggattcgggggcctcaaaaggagagatagccatcacttcctcaattggctcggaatcaggaatgggttccatcatagaatttttcaatcgcaagatcaaaatgaaaaacaccattttcccgagtttaatgtcaaggactccggtatgcggcacatcaaggagaagtttctctatgggatggccaacgaaaagatcgaaataagagactttcaaaacattgaagtcgaggatagcttcgacatcattgtgctggatcgacactctacgaagaatcccataaccttcgatgatgggactagaggggctccagaagtttttgtttgttggcgcaaatagttcgcccccgaagcaatttaatgcaaaggttgtagacataatgtttgcaccaacagtgggattatatagagtttgcaccatggcctctctcatcagatatggaatagttaaggactgggagctaatatgaattacttcagaagaaacctccatctccattaaccactcatcactcatgatggtagttaatttctgcaccgtctctttgaagagattctcatcgagtggtgcgggagaattacacgggaccggtggtctcttttggtaggaataatttgaggtgtttccataatgttcaaaaagatcatcatcaaactggaatgggaatttcaaaggttgaatttcttctaccttcagttctcgaggtttgggtgagaattcaacggtcgaatccaatatcggtcgtcgatggttcctcacgtgtattctttattttcaagacggtttcacaacgaacgaaggaggtgttctctaggatacaatccaagagctccctactttctaacgtcgttttgtgtgcgaacgaacctccggtggaagtattgagatacatggcagactccttatctaaacccgagtgaaagtgttataacaacgcatgatcgggtgcagacaaatctaggctgtcttgagttaacaagaacaaaagagcccatactgcaccattggatttttttctcattctgtcaaaagttgagaacctccttatgtatagagactacacgggttaacaggaagaaatcaaggtagaacctaccttttgattcctcccattcaccatgcagttttcttccggtatgggtgtaccattgctttaccccctctataagagagaagggaaacaatttccaatttaagcttgtttgtgtcatgcccgcgattgtcaagcatgagtacaattgctcaaactaacgcagatgatggtagggattttcgatttcacgtcctaagaaggattgttcccgaaccatggctataaaatcagtatggaatttatagctagatgaatggataggttttgaagaaaaaggtgactcacataacttggcccttggaatagaaagattttgaaaagaaaggtgctccatggtaggtaagaagagaaatgaaaagatacgaggatgaatcaggttcgaatatgatatagcaaccgttccttggcaacggtgctagaaatgtttgttggtatttgatacggcacaggtcaatccgcaagcatatggagaccgctgtagcacttgacctcagagtattttaagggtattgaatcacagggaacgtgtgtgtatatgtaagagtagaattctattcaaggacaacaactaatgatgggctaaggctaaagaggattcctatgggttaatttactagactggagttaaaggtaaaaccctatcgattgctttgggcactggctctcccctagtctgtcaatctgagttcggcctatgactctatgatgtaactgaacatggagggatgtaaaggacggacaaagctgtcaccacctagcacctacctcactttccgtggaccacacaacaaatgaatgtaaccgctaacctagacaccatgcctaagttattgattactactctagcctcgcataggaagttaggaacttccttctttatccagagtcctagtactagagcacttaataattcaactaagcgaggaacccataacgatgtgaatatgtctcactcaagcaaataaattagataccataaggagatctcgaatacttattttattaaaagaagcatccgtcgaggaacaagcttgacaagaaggccaacaacacatgcgcttctctagaattccagtggaacaatgtcaacgaacccggcactcctccggacttcccagagagaacgtcgatatttgggacactccttctagagcttccccttactatctacctaattccacatactaaagtgatgcctaaaatatgaaattgagttgtacttcacttgagttgtgtgttttggatgtgagttgagcctctccttttatagcctccatataacggttggaatgacagttgtggaggttggtgcacccacaaccaccatcaacaaccaatagtgggtcgccaagtgcaaggaggtggcggggagaggggaggagggtggtgccaaccttggtttggtcgaacccctcgttcgatcgaaccaggcacaccgcatctagccacccacattctctagtgtatgccaggtgagtgattatggcggttggcaatggattagctcaaatttagtcgattttgactgacatgtgggctctccgatccttgtgcttacgtatgattggtcagaggtacatttaatcgcatgacgagtgtgttttccttcagaaatcaactacataccactatttaccaagactagaggaaatagttagtaataaacccctaccaataagtttgatattatatttggtattcttttatgtaggagttgatagtgaaagttcgcacttaatgaccatcaacaataatcacagatatccaattaaacaacccaaaaccgattccagtcagaaaccagccagttagatcgtcaggctggtcggtttgaccgcacaacacacgccggtctgaccggcctagtctatccggcctgaccagagcacataattagcaccaaaccacttcgccaataatctccaaatatcaaaaccaataacctaccatgccaattgttcatcatcaaaatataatcaaaacacacattgattttacaatagaatcatgtcagatgatacaaattgatcgatatagtgagatgatagtgtgcacatgtaggtaaaaattaactatactacgcaattaggttaagaaaccacaataataaaaatcataaacttgttgtgaaaagatactaatgaagctaagatcataggggttcactaatatgatcctcattcaggcagtgtgctgaacatatgacatgcacatctgaaaatatttccatggaacaaatgtaacagaaaattgaatcatccgacaacatatggttggatctacaaagcaaagaagaaacaactaactttaaacaatcaaatggtcaaatcgaacagtgtaaacaaaagaagcacacatgagcactgcaaattaaggaggaaaaggtcattggaggtggtggtatccgaagcttagcgtcaacatatatggctactgtctgttagcaataaggtaatgcatgttgttttttcatcaggccagtgccacaccacgtgcgaggcacgccagggcaccacttgccatcaatggagaaaaccagctgcctctagcaccacaactccacaaggagaccctactaatcaaagaagaaaccctaagtacttcacgtggtacatgggcctcatgtggtggctattgcgttttgttcatccaacgcctaaaatgtaatctaatctagtgatccaacggctgagaattgatgatgacgtggaacattgaggtttgagatttagggtcttaattgcatttagtgtgtcataactttataaagaagggatttagtcattggaatattatatgcacacaattgaatgtaataatgataaatgtctgttattttattaaactctgaaatggcacatcgatatcggtttgtctcagaaagttccatccctagaaataaatcagaatagcctccgaaatgggaatgataaatgttgacagtcaaaaaatggaagttcttgctagaacctttggctgcacaagtggggagatgcccttcacttatctaggtttactaatggggaccacaaaaccaaagattattgactttgcccctctggttgacagagtggagagatggctcccatctatagctgcttttctcaatcatggtcagagactaacaatggtaaattttgttctatatgctccccctaatttctacatgtgcactcttaagcttcaaaaaaagtgattcaacacatagacagagcaagaagacactgtctttggaggaagtcaaatgatccaaacactaagatccactccttggctacatgggacctagtatgccagccaaagaagaaaggtggtttgggcattataaacctggaactgtaaaacattgcccttctgaccaaacatctggacaagttcttcaacaaaaaagacctgccctaggtaaaactaatatggaacaagtaatactctttgtctgactctcctcatgctcacacataaaaaggatccttttggtgtaaggacatttttagattgattcccatcttcagagcagtctcaaagatcactattggcaatggggacacggcccttttctggaaagataactggtctggcaagtttttacaagatgaaatgaactccctattctcttttgctaagaataaggacatctcctgtcaaagctttttagagctcgagagtttagaacaggcttttcacattcctctctctgttcaagctttacagcaatggcatctcttgtccaacctcattcaggaattgcgcaacacacaatgtttggatcaatggtcatatcagtggaattcgcagcatttcctctccaggaaattctataatttgttctttgctcaaatccagcatgctgcacccatctcttggatatggaaaacaaatgcaccctaaagctgaaagtattcctctggttacttttgatggatagattaaacagcaaggacctcctacaaagaaaacatttcaatacccaaggaaatgatagatgtgtaacttgcaactccttgaccacagaagactcattccatctgtttttcacctgcagctttgctcagcaatgctggcacaacattggcattaatgggaattttcacacaaccttcatggacatgataatagaagcaaaagagaattttcaatttcctttcttcatggagacttttgcaatctgctgttggaacatttgaagcagaagaaatgattttatttttaataatgttccagtcaattttcaaaggtggagatctgatttcaaggaagagtttactctacatatgcatagagtaaagaaatctgaacaaaccctctggcaatcatggattcagccttttgattaattatttcccttccctctgtaattctcttctgtttttttctccttttgtaaattgttcccttggtttcttaacaaagcacagtaagagcctctcctgttgttttacccgtaaaaaatgggagtgataagtttgatcactcgacaagtgctatatgctcaacggctcttaattacagttttacttctgtttaaaacaaaatttagatccataaaaactcatgcaatttctagatataacagtattttaaacagtcatttttagacaagaaaaaaaattgaactttctttaatgtgcatgcttggatgggggaggagtggcagcgggggagaaggagggaggacggtcgagggggtggaaaagcggtggcggagtggatgttgtgcgctcggtcaaaaagataaagaggaggaggggcaagatgcctaccggtttttttaaaaaaccgacacctatgcatactttataggtgtcgattctattaaaaaacaataactatagtattggtatcagttttttctctataactgacacctataatataagtataagcgacgattcttttaaaaaaccaacacctataatattgttattaattttttctgtagaaccgatacttatagtatttaaaggtgtcagttctatatttttttcaacatgtgaaagtggaaataggttcataggtgtcagctttaaactgacacctacgaaggattagtagtgattggctggtgtggctgatgcgttatacatcaaaagatgtatacgcgcgattaatttaactggtcaagcccatgacagctaaaaacaaaacctttcttggacaatagaaaacgaaaacatccgcctctgccatataaaaacttgaccaaagtcaggcatgattatgaagcactaattagtgcacatgatctaggtgtttggtctccctaatctcacaaaacaaagacatccacgaccatgaacacgcaaaacagctcatgcgacattctgtccaaacaacattatacacgcagacagcctatgtaccacatacacacatacaggaaagcaaatcatattaattagtcacggatgaacaatcacaacatcgacccctgctgatggtgatattttacatgatggccatctttcagtaacttcatctacaggaaattattatttttatataatttcatgaatggaatatatgcccccagtccccagatatatatatatatatatacacacacacacacaatgaaaattgttttttataagattgacaaacatggtacaatattaatttgacatccctataaaattttcaagtctaatataaacacacttctactcacaactgaattagtcttgtttgtgtggtgatagattccccacatagatcagaatccattttccatgaagcacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccattgctgacgtgctgcctcttcttgctctactccataacctgctatgccttggcggcggcggccggcggcggcggttcttgcggcggctccgacgatcacgccgctccccggagctacccgctggtcggctgcctgctcgacttctaccgcaaccgccggcggcttctggcgtggtacacgggcctcctcgcggcgtcgccgtcgcagaccatcgtcgtcgaccgcctcggcgcgcgccgcaccgtggtcacggcgaacccggtgaacgtcgagcacgtcctcagggcgaacttcgggaactaccccaaggggaaggcgttcacggacgtgctcggcgatctgctcggcggcggcatcttcaacgccgacggcgagcggtggttcgcgcagcggaagctggtgagccacgagttcagcgcccgcgtgatgagggaggcggtgggcgtcgcgctggagcgggaggcgcgcgcgaggctcctgccggcgctcgacgcggcggcggagggtggcggcggcgtggtcgtcgtcgacgtgcaggagctgctcaggcagttcgcgttcaacgtgatctgcagggtggcgctcggcggcggcggcggcgaggtggcattggcattgccgctgtcgaggctggccgcggcgttcgacgccgccgcggcgatcagcgccaggcgtggcgcggcgccggtggccgccgcgtggaaggtgaagcgcgcgctgggcgtcggctcggagcggcggctcagggaggaggtgaaggtgatacgcgacgcgatcatggagttcgtccgtgacagcagcagccgccggcggcgggagcagctgctggcggcggcgcgcggccgcgacgacctggtgtcgcggatggccgcggcggggtaccccgacgaggcgatctgcgacatggtggtgagcttcatcatggccggccgcgacacgacgtcgtcggcgctgacgtggttcttctggctcatgacgcgccaccgcgacgtggagcgggaggtcctggacgaggtcgacgcgtgcatgggcgacggcggcgatggcggtggcctcgccggcgtggacctcgagggctcgcgcagggcgcgggtgctccacgccgcgctctgcgagacgatgcggctgtacccgccggtggcgtgggactcgaagcacgcggcggaggacgacgtgctcccggacggcacgcgcgtggggcgcggcgaccgcgtcacctacttcccctacgggatgggcaggatggaggccatctggggcgccgacgccggcgagttcaggccggggaggtggcttgcggcggcggcggcgggcggcggcgtgtcgccgttcaagtacccggtgttccagggcgggccgcggacgtgcctcggcaaggacatggcgttcgtgcagatgaagttcgtggccagcgccgtgctccggcggttcgagctccgccccgtggcgccggagggctcgccggagttcgtgccgctgctcaccgcgcacatggccggcggcctcaaggtgacggtgaggaggaggcagcggcaaaatggcacgtgcgagacatgaagccaattttagtatttttcttaataggttcttaatagatgacgctgttaacattcgaatatacgtttgactaattatctttttaaaaattttttaatgtaagtgtataagatatgaatcatgcttaaagtatttgtgaaatatattgtatatggtagttagatattaatatttgagtcataatatcttatactgcgaatatttgactcattgtggattccttcagttcttccatatctgtaatttttctttatcttcttcccatgtactcctatatgtacctgcctccgcaggcttaatacaataagtcaaatattcacagtattcctttcttcctataatattcaatatggtatcagagtgggcgatctagcgccgctcgaacgcttccgccactgctgcccctcctccccggcgaggagtagcgatctccaagggcggccatcatttttcctttattttttccatcgtctgcaccgttgcctggaggaattgattagagtcataatagaatatgattgatttgtgtgtggactccttcatatatgtaatcttttcttatcttctcccaacatacttctatatataccggccctataaaggcttaataaaatgggtcaaatattcgtggtatttctctcttcctatactattcaacaggataaaataactcacaataaaatagataataattaagtaactttttaataagatgaatgatcaaaagtgtgttaaaaaatcaacagtgccatctatatttaaaaattgagggagtacttattgtatatctatacaaatattctccattgttttgatttgaatagatatatgtacctatggtgactttaagttgaatagatatatgcattattttgattaaatttaacgaaatttctactttttattttctgaagtgccgagtatttctagtaaaatcattgggttaagtattacgatctttttaaaatagagtaaattacacctatggtacaataagtagacaggtgggtgcgatttagtacaagaatttgagaatgggacgtttaagtgcaataacttggcaagggtgcgctttaataaaagaatttggtactttagtattttagtacaataacttggctagatatatgctattttggttaattggtgctatgtatgttttttcacgatgttaatttgtcatcacgtagcaatcccgaagtattatcttataatgtttgatgtaatctataagaatatattgctcaactaatttgcaccatcgatttagattattttttttcaccgtctcaaataccaaatagaaaatttctacgcagtatgacaaaaaaaaaagtatgcctatacaaatctacataagtatgtcaataactgaataactgtgtgtacgtaaaaactgagttcatatagttaaaaattctcaaaataattaaatttttacaccacttctcaagtagttgtacccatacgctcatttattaaattcttatactatgttgcacccacttatcaagttgttgtactaccatactcatttatcaagttcctacactaaattgtatttacttgtcaacttgatgtaccatgaatatatataactaaactattcttttaagtatgtgtattatttcactaaggagaaaacgatggggagtggcttaaatgacgccaaagaaaaacaacagacagaaagtagaagataatgttggatagtataggagaggagataacaccatagctaagcattattaacacttacgttatgacaccaatatctcaattttgtagattttccattgacaagatcgtcatgcaaaagccagtggcggactgatggatgttattgtgtaattttcgctatgttttgccctagtacatatgttaaatgcttttgtgtacattttttttctaagtttgaaaatctttatctttatttgtaaatattcctcaaatcaaaatttattcatttctcgtccattttctaggaaaagagagttaagtttggtctataatgtaggatatataagaggagcgtgatgaggttaaatcatcactggaagggtgagaaaagcgatcgaccaacgtaacctttttttcaagtaccggaataattagacatacgtagttcaaacagtattttcaaagctttaaaaattaaaactctatatgtttaaaaacgtggtatccactttatgacccatattcacttcaatgtccttcccacgtactccctccatactcgtaaaggaaatcgtttaggacagcgacacggtctctaaaacataactttgacttcttattgctataaaaatatttattgaaaagtgatatatgtatacttttatgaaagtatttttcaagacaaatctatacatataatttttacattttcaaactcaacaacttgagagttattcatgatttatattcgtaaggtttgacttaaacattgtcctaaacgacttcctttataagtatggagtagtatggcggtagctccacatggccaacatttgccctctccattatgaaaatactccccctggtttgtatgtcaacttaaacacagttaaccacagtgacggttcgctaggatgtacataaagaaagggcttaagagtcgagtcttgggggagcctaatacactattacttagtttaactatttaattagttacataattatatgtgttat

SEQ ID NO: 81046 - DNA, 855 bp, Oryza sativa
ttgcctaaccccgactccgaacagttgaacacttgacctcacatatgtcccctgattaacgatttcattcattttcactacccaagcccccgtctcacctcattagcaatgctacacagtgccagataccgctcctaaacctagaggcttaacctcaccgggacactaagattgccctcgaagtctcgaactgctagggtaaatcgttcatcaatcatcttgtctgtgtatccataatatccataaaagggccaattcaacaagagaagaaccgatgaaattataagcacaaatggataaggcactggttactaacccatatgttgcagttgcacagactactgttattgattttataaatattgaaattttccagtaaactaattttctagtaaattatagcgcataaattaaaataagaatatactttacttcaattacagctttctagtaaactaatttcgaatttggaatacactaataaaatgctaaattccaagtccaacccggtataattaattttaaaattgttatgttttggaaaagactaatctaaacggtccatgctatcttggcgagaatacacttcctccatcccaaaatataagcaatattagcatagtgtcaagtgatacttttttactttaactatttatagaaaaaaaagatcaatcatataaaattgatgttattagatttatcttaaacaaactattataatatgaaaactctttttatttaaaatatcttatttttatatatattattgatcaaaatagcatatcgaagactgtatcgaagttaaaaatacttatattttaagacggagagagtagagcagacgtcctcatcata

SEQ ID NO: 81047 - DNA, 32971 bp, Oryza sativa
  unsure (1)..(32971): unsure at all n locations
aatcaatgcacacagcaataaaattgaacagatatcacctaacttatcgagttgcctgcgttgcttttgctaaatgaaaacacatgtcaataattgagaaaaaccattttggagtcatatcacctaacagaaagcacttgtctctatcacatgattcacgccttgtgcatatttttatgttgtgtctatgcaagcgtgtgaattactgttgggtaggccatgggagtatgatagagatgctttacattgtggtaaaactaattcatgcactttcacatataatggtaacgagttagagttgctaccaatgagccctgctgatattttgaaagatgattatgagagagtaaagattaaaaacaatgagccctaccacctgcaagtctaaaattatatgtataaaacctatgctggaaaacatctcattgcaagtattctctgatttagcaaaagcattggtttcccctcatccctcacttccaattggacctcacaggccccatggctcatttggcatccacccagcaccccctagacccatatggcagtcacaccaccgccctcgacacgtgctggcgttagaacgcgctagcacaccctgggcttggccacctccaccttgacccgatgacttcgagaacatcctcagaccatcactccacaccgtgtctccatcatccctggttgcgttctagccattcccgctgggagataaagctcttagcaatcatttccacctcgagatcttcttcgggcataaaaaagatgacgtcctcccttacaaatgagtcaagattttccctatctctttgttccctcttctcctcaccacacctaacaacttttgtttttgccttagttacttttgacttgtgggtcaatggcaacgcaacatgcgttccagcacacatgaagagtgtggccgtgggcgtcaaccctccgctgtgatcacatcgggcctcccctggacaagccacaagtcctcagagaatatccctcggttatgctgagtgaggagaacgccctttgtattccttggctcggccatccagattagccttccgtttctccgcaattgttgagcaatagatcgatttgttgcatgtgtaacttcctagtattcctgctaacactatgcatgcaccttcttgctagcctgatggccctaacttgccaacgctgtccgtgcaaacccatcgccgcggccaagccctgcccggtatgtagacatcgttgtccaagtttcaccaagccccgtgtaaccctaggtgagtctactagtacaacccagtcaccaatgcatgcactggtttgactcgatttgagccagagcatgaaatgcataagcatgccgaaacaaccaccgccacctcattgcacaaaaccacaaccccacagttttgtacattttaccttttggtcttgaccctatctaaggtatcgttcaccaccggtgagggctacaaatattggacatttgtattgagccttggaggtcagtatacaaggaaggtgctagagataaggaaagactctaatcaaatcaatcatatcctgaataatggtgcagaacaaaattattagtggttggatctatttcttgcatggggacgattgtgtcggtctaaccggcagtcagaggtgcggtcggaccggccagatggccggtcagattggtagtctatgtggtcagaccggtctgatggttggtcggaccattggtctgtgcggtcagaccggcatgatgaccagccatatcgacgataggagagccggtctgaccagtaaaaggcacggtcggaccgcccgcagaactatggttatcttcgctcccggcatattgtgttgccgctccatcagttgtgctatagatgtgattaacatagacttggctagtacctgcaaccgaattaggttacaaattgcctgtgagagccgaattcggaactcataaattattcaattcttttataaaaataataactcatagcatactcaggtttattataaaagtagcggtaaaggattcatctacggaacttgctacaagcttttgagcaggacgagcaatgtcatcaacttttacctcattgacggtgacttggggtgtaaggccggtgttggcggctattaaatgccaattttatgccgcccatacctacataaaacataagttctaacacatccaacatagtggtagggtttaattttgacagattccacgagtgttggtgtatatttggatgcgggtaataaactgctagagtggggagcacatctagacttaaatagagaagaactacatcaatataagaattgggctcacaacttcatcgaaacattagaaattgagcccaactaatatagaaatggaccgagggagcagatatggaggtccaggaaaaaagcccacaggctgaggagctagccagggttcagccgaaccctaggttcggccgaacccaaatcttggctattggcctcctcctttcacatggatgctctagatgactccaaaatgacagttgcgtggcaattcagacatttccaactgtagagccatcattggaagcctataaaagggcctcactcccttactttacacacatactccgagcttgagctgaattataagaggctctattgtactttattctatactagattagggagagaataaggtagaagaaatcggagaaattccggtgttgtcggtaatcttttcttactttttataccttgttaattactctgatttaataaaaatattcttctgagtaattaagattttgctttgtgagaattatctcttgtttagttcctattagcattcgggatcattgttcgctacattgaatatatagtgtttactttagtgaattataaacacgagagtagtaactaattgcttaaacgtggtgtttaggtagttaattttcagtgattgctgcgtatcccacatatcgttagaggttggtgtagaggtagtgacaacccttaagagcaccgtagtcctccctatctgggtacggagtaaagcgtgttctggtagcagcgagcaagccagtgcctgatattttcttataggattaaaccaagctttctatagacacagtttctcgctaggaaatcctctctaccattttcctatctttgcttcgtgtccttggttgaacctagagaagagttgaacacacatgttccttgtggaaatcgataccttggaatactcccgggtgaagcgctacatcggtatatccgtgcgcttgcggattttatatgtgaccttaagaaataccaatagtcgagcttaccaataactcgttgacgagtcttgacaaagcatcccgccaaaagggcctcttgcgtcgcgatgtctgttggtatttcttaacgacattactagaaatataaatcccagcaaaggcgcataaaaattcgtggtatattatggttatagagttcatccgcaagtgcacggatataccattgtagcatttcaccccagagtattcaaagggtatcgtatttatttaatcctgtgagaagatcatagtagagagaacctgactaataatttatatgttacttgtaataatcatagactaataaaagcaggggttaagataatctaagggtagagtgacacacaaataggggactactcattctcatactaaaatatctaagctaagtggaaataaaatagaaagagaatctattcctatacttctagtatacatagtatacatacattctagttatctgacatactagctaataccctctatccgatgcactcctggtacttcgagaagccactcctgactatcgagttccttacgatagcctgtcataactatacaaccggggctaaatacagaggagtaccctccacaggaaattaacttaagactatatacacgcacggaggaatacccatactaagctgtcaccatcagcggcccacctctcatccacagcatataaccccaaataatgatatcccgtaatctagacaccacacctaaactaccagatactactctaatatcatcgtcatgatataaagtaattgcataagcaaacactatacccgtaccaatgcatctcccaaataagctagcagtacaatcagtataacatgaacataatgtaaagttggcattcataaactcggtaagtatttcaataccataaatgtataaggaagagtattctaataaaagtacaaagcttacaaaagagaagagaagagctactagggccatacccgaactcttccgaaggcttccggactccaatttctactctattcctatttcactagcttgagaacactaaactaactcgagagaatataagagacctcttgcttaaggtgtgtgactgaagtgagaatgacaactccttttatagccttccaatgatggctgtgacagttggaatggtcggaaataccctccaaccgtcttgggggctaatccacaccatccaggcgaagccctggatcggatggcgctgaggagcctggttcggccgaacctggggctggcccaactagcccatgttttggctggcggcctcctctgttgcttctcttcgcagacctgtgtcaattctgagttcttggtccattcatacataagtctgattctcaacatcgtccgattgatttttcgtttgatttgatgtcgattctccgccactttatggttattctctacaaaatgttagtgatcctactagtggaatattattattctaacatggatatgcattgcaagcataactagttctcctctattttggtaatattgacgggcgaaacttatcgcaaacgaccgtcaataacgtcatttgatctcttgacattattcctcatccaaatcctccaaagtgatggggaggaagttgcttggattcacttcatgcttggccatgatgttgatgaaggcattccccaacggagtcgccaaaaatcgtgttggcaacttttatggcaagaagaaaatcacgatcgggacacttaaatgccttgtggtgatatcgagccaccaatcacttcaatctagtaaaagctagatcaagttaggggttttgatagattaaacaggctagcggagccaatttggagaaacaagcaataaacacccgtcttgtgtacgaacggaaggtttacgggatgtacaagggatttcgcactcccttagaaaaggtggacgatttacagtgcaaatcgacaaagatagatgaactaggctagacctagacaaaagtagatgcaatattgaaaaagtgattcaattggctaaatcgtattgggagtagattctttttccaattgaaccagccttgtcccatttaaagggttggtcttgcctcatacaggtcctcctccacgttcaacttaggatagaaaccactacaaacccgaaacatgcctccccgagcaagaaatccagagacccgacgaaaacagactcggaatcggacactatcgatctgatcgaccaaacaacgccggtcagaccgacccacaagtagcgatctgaccggttcacagttgacggtcactccagctccgtgaaggaaaccgatgctcttcaaattttggcaatattttcctaattcgactatagctaccaacaaatcgaagcttctattgctacataaagcagacactcggatgtgaattttttcttcttcttttttaacagattttcatataaataaaaaaaagccagtttattgtgtagtaagttatcaacgataagtatcgtccactttttgtgtgcgctatggatgactaaggtcatgaatacggttactcaagatatcaataaattggtaaataatgggtcaaaggtgattactagcagctattgactaatattttgattcaaaattttgattgaaaaatcctgtttttattatactacctccgtttttttcatatatgacaccacagacttttcatataacgtttggtcattcgtcttattcaaattcttggggtaaatatgtataaatatatgttaaggttagagttgctttgatgataaaataagtcaaaaaaaaacaagcagagagtgtttggtggctattgatttgaacgtgtggcaaagtacaagcctgatgatgaagacgacctcacctgccgacttgctgagctcaaggcccgtggctgagggatttcagtttagctgataccgaattggaaaagaagccagctgtaacgctccgcttttcgtgagtcgttaaaaactaattcggcaaaatcctaattgcgaaaatttccgttctttgtgtgcgagtctaagttgtatcgtggatctcaattcaatcccgttgttccctctcatcgaaatcaaatcctcctcctcgaaatccctattccgattcaagtattcgaaattcaaatcctctcttgaaaaccttgcgaaatatccgcccgactccaaaaatatccaaattcccattttgaattcaaattcaaactccatatcaaatttctatccaaatcagatctcccagtaaaattctattttgcctccttctaattttggatgggtcggatccccctctcctcggcccatctcctctctcagccgtccctcccctcccctctctccacacgtgcgttgcgcgtgcgccgcgctcgagagagagagcgctcgttctcttctcatccttgctccctctctctctctccgtttctctctctcccgtcgaagcttccccaccggcaccgattcccgccgccgccctttcaaatttctgccacgccctcgcatccgcgcgcgcgctcgcgcgtggccgaccacccggtcgccgcccgtgcccgcgctgccgcctgcgtcgcgtgctgcaacccgcccccactccctgtgcgcgtgcttccaaaacacggagctagagctcgcccccccccctctctccctccccaaaacggcatggtcaagcttccgttttccccattctttttctctctttcccaacctcaaccaccgcacctccaatgccgccgcttggccgctagctccgagcacgaccgctagccgagctcccatgaccacctaagtcggtttcctcccccaaaaccgctcgcgcccataaaacccgagccgagctcctccccctctatatccctctcgtttttgcctgccgcaccattgttgccgcccctgccctgcagtcgccctcgccgtccggcaccgaagcaccagggaaaccggtgcgtgcggggacgcgagacgaggactccgggcacctcttcttccccttccccggcccaaggccggagagctcgccccgcgccgtcgaccgtccatcactgcccgcccggctcggtagtgccttccttctgttccttttttctcgctcgctctcgcccctccttggctcgcgttgtagctcggctagcctcttgaacacgcgtagacgctgccgctagccccgccgccgcccggcatggcctcgccgccgttgccgcccgctcccggaggccgccgttcatcgccggccctcctcggtgctcttccaccccatccgacgccggaaatggactccttgaaccccggagatgctcccacctccttgaattgaatcctcgtcgcccctccgccgtttcccccttttctcgccgccggcgtgcgccgccgcgattcgtcgtcgccggcccctcttcgaaggatccaagccgttggctcatcccctcccgtggccccccttgtaccggtgaactccctctcgattgaatcgccgcgttgtgcttccggtgaagtcggccgccgcccgccgtccattttccggctggcctcgtcttcctcctctcgccggcccgcgtggcagccacgaaggcggcacgttggcgccacctcagcatggaccgggtcgggctaaccccggtcagccgcctccctccgctcccgctcgcacgcgcgcagtccaccgcgagccatgaggctgcgcgtgggcccgccgcacccgcgtccaccgcgcgccgcgcccctcccccaaaccctagcgccacccctcccgtgagcccttccttcggtgaacccggtcactgacaagcgggtcccactcgggaccacgcgaagtggacctagcccaccggctccccctccctctctcccttccgcgcgcctcctgggcggcctcttctcgggccggccagcccatttggctcggccgagccgcacctttctctcgggccacgcccatgccgcccgagggaagtctatttcgtatccctccttcctttgtcccataaatcagtgccttattccaaaattccatagaccatttcctttggtcccgcacgttggtgactgtcaataatattcttgagaatattatttctataaattccagaaaccattcctcttatatatatatatatatatagttcctcggccctgaagttgaagatgaagtgaagcgaagattagggtttcgtcctggttcccagccgtcgcctgtggtgttgggtgttagttcgttggttccgctgctgctgttgttgttggtgtttcctcgtccgcgtcatcgattgcattctcgggctattctgagctgcaatctaagttaaggtaaataagtcctctatatattttaaggattgcaatgaatcatatttgtcaccgtgggtaccagcactatgtcctgggactggtaccgtgatcgcggtttcgtaggaagcggttcgcgccgtttttcctacgacacgctcctgtcaggtgctgttgtacggcggtgccagattggggtgtgacaccagccagctagcctggcagccagcccaaacccaccagcctagcattgctgaaaccctaactctcgaacccccatccccagccgcacttgcccgtccgccgcttctcctgacgcgccaagccgacgcccgcctcctgccctcaccatgccaccttcgcaccaacagcctcctcctccgtcctcctgtcacgcatctgttgccgccgatagtccttgtgccgagctgtcgactgccgcctctactttttttcccccattgccccgctgtgccggtcaaagcctcgcggtgcgtgatgactggtgtgtgtgtgtggacgaggtgagggcatggactatgagcagtaccacctcagtaatgtttaccatactgtttttttttttggatttatgtgattatttttgggattattggtttgttgacgtttgatgtcacggttctggtatttgcatagtatggggatcgtcggtgctaggatatacgcgagactgaggtaaaagagacagagaagaggatttttatacaggttcgggcccctgagttgtcaggtaataaccctacatcctgttggccgaagccggtcgttgatcttattcaccataatcacaccagtacaatatttggggtagcctatctaattgttgtcgacatggcagtctgacaatctgactcgtagtcaacaactgggtagccttcctcctcgaatccgtgcccggcgagatcagagagagcgctttcgtctctcctgacagtatccggagacaccgtaggggactagccgtgcttatccctgaagtcgatatccggcggcgtgtcttggcttatgttcgcttctatgttgtggcttctatgtcgattgtgttctatggtgggtgtgtcccctctcctcctagggggtattgtatttatacacataggtgtccccttgtccaagtagaactagggaaaccaatatggatacaatccgagtagtccttgtcgttttcatgtagaactctggttatttttctttattcggaactccctcctatatccacaggttgtttccttataggacatggtatgtggtgtaccctgccgagatttggtcaactactattaggtatgtggtatccataacccataaccctgacatggttggtgtagttctgatacttatgctcgattggtttgttaaccaatctttgatttctttttattcgtccagcatccgtgactaggattttgtattgatgtctaattttctttttctttgatgtaattgctcgtgtgtggatggagggcgctgcttggtcggattgacggaaaaaaaattatcgtgacaattggaaatttataaacttttaactagttattaaggtggtgtttggatccagggacttaactttagtctctgtatttagacactaatttagagtattaaatatagactacctaccaaactaattacataaacgaaagctaatttgcgagacaaaatttttaagcctaattaatccataattagagaatgtttactgtagcatcacataggttaatcatggattaattagactcaatagattcgtctcgcgaattagtccaagattatggatgggttttattaatagtctacgtttaatatttataattagtgtccaaatatctgatgtgatagggacttaaaaagttttagtcccatctaaacagggtctaagatatagagtttcttctcctttcctcatctgcatggcccaaaagcccgtaatttggctgtacagcgcagcttgatggcaaaccagcccatgcatcaggttccgttttcctttggaataagcccacttggactaccttcagtggtggtcgaatctaatccgtatcccttaagcacagtaccggatatctggacccatcaactattaaaaccggtgcaatttgactcgctcagcagttttggagggtggtttcgctaacatggcgcctacgtagccgtgttgacctggtcttcgttccacatgacgttgatgtggcgcttatgagcattagaattaaaaaatatatgagggacccatttgtcatcctctctccgccccacatgtcatcctctctcctccccttctttctcctccctctctttatcccttctcagtttctctgcccatttctcttccccttcggactcacacggggagcgggggctggatctggcggcggtggcggcgggcggggcctttctgcgagccgtggtcggagctgcacgtctacgggtacaacagcaacagcggcggctgggtggacccgacgcgtgcagccgtgcaacctcgagcggagtggcggcgaggtggcctggacgcttcacggcaccgagaggcagagaagccggttgttctcccctctccttcctgccaccacggcgacaacgttgagatgacggtcagcccaaatagtggcgcaggcggtagagagaagctagcgcccagacgacgaccttcatctgctccacctagacatcaccatcgtgtacaccgactggtatggcggcacgtcttccagcttaagggtggacgtggtccaggtatacccacgggcctcgttggcccgtcccacgattttggcatcaatgggcagatgggtcggtccaaacaaaaacaatcagctctacagggtacccgggtcggcttcattaggacactgaacaggctgagcgcgacaccccttcctctggcggtggtggcgcgagcgccccttcctctcaccgtctcacggcggcggcgaggcgcccatcaagcgcggaggcggcgaggttcagcttcctctcatggtggcgccgctccatcgtgcctgtcggtcccccttccccactagcaccagcgtcaccgctggccgagccgcgcctcttcactaccatcctgtcgtccaccaacctccttgactccctacttgctaccctcctttgccacctctccctgcgcctatctccgccgcctccttcatggcgatggcgacacgacctcatctagcctcgatggcggtctccatgtcaacagttcctcctgtgtctggtgatggtatgttccaactagccaacaactcctcttttattgatttcaatccaagaaagcatgtttttcttcttaatttcgatctactgtttccttgccaagtattggcggattgctagctaataattctgtaattcttttgtaacgtgggaataagttcatacaaattgaattttcagtttcagcagaaatttttacagttcagttttagcagaacacttagttcagtttcatcagagagtttcacttcagtttcagaagaaattttaagttcagtttcagcagagattttatttcagttggctgatttcttgacaaatgtgcagaccagagctctgcacaatttcttcctcccacccttctgttccttttttatgctccttctgtgttttctatattcggcctggagtcctcatgttgaatacaagtgttatcttggtatgagattctaaagttttgtgtattacatctgtgatttgtatggattgacagagttgtgtgtattccatgtttgaaattgaatattcggcacttggtagaatctgatgatgctttgttgttcatcacgtgttaattacaaaaatcaatgatagcacatactgatgggccgacccattctacccaatggatccaatggacaatgggtcgacccactcggtattgttataaaccatttgggtaacatggtctaagtatgggtcgacctgtcccggaccacacccacccatgttccagctttgtggatgcacgagctcattttttttctttctttctacatatgcagtggctggctggttgctgccgtgccgactgctactgttgtgcaccagtagcatttcgtttgaggcttttcagctgcctgagcattagaaagaatccacatacgcccggtgctcgtttgttggttgccttactttactggactatggcgacgagcggagtggcgtctagctgcaggaccttgaatccttgatgcaacagcggcggccttagcagctcgaggcgcagctacatcgacagcgcggctgtggcaactcatccagcttcgaccctgtcggctgcctccagcttctgcctccgcaatccgctattcgctgccaggctcgaatccatcggcaagtccgcgcgccgccgcatgcccgcattcacggccctccggccacgaactgccgaggagccccaatccaggatgccattgacgccctctcccaggaagggctgagtacacggaggcgaatgacaaatgggtcccacgtaattttttcattatgatgccacataatcgccaaatcaacgccatgtggaacgaagacaaggtcaacactaccacgtagacaccatgtcagcgaaaccgcccttcaaaatcaccgagggaggtaaattgcaccggttttatagtttaggggtcgagatatccggtattatggttcagggatacgaataagattcgactgctagttaagggagtcgatgtgaacttattccttttcctttcccatttttttggtgtgctgtccagaatccagattgatcaagaggccgaaccaggcgcgatgatagctgcacaagagacaagctaaatcgacagtaaattactgcaccacgtgttccaatcaaattatggggattccaccggctttagaagataagactagaaaatctacgtgccaactaatttgcaccttggtttttccatatacaatattctatttacgtaaaaatcatacacttatcccttaactggatcaaacgtttagggatggatcgatgtatggtactccctccgtttcaggttttataaaatgttttgactttgattgattttaaactgctttaagtttaatcaaggttataaataaatatagtaatatttacattatcaaattagtttagttaaattagtaattaactatgtttttataataaatttatcttgagtcgaaaacattactattttttctaaacaccggtctagatgattctttaacagtccatcgaaatactgaaacggattaactaatttaatggacttttaaaactaaatattcaagctacatccctcacacccacatggaccaaactctgcaaaccgaataaaaagccttctgaccccttgagctcttcggctgattttgacttgttttaaattgtaccaaatatatcttcggtcatgttctcatattttctggttgttgttcatgtgtgtgccccagcttcaacaacctcttcctgaactgatgtctattatacactcacgtgcaccatcctctaaatcagatgcagcctatttttggacctttagacttcagcacccaaactttcttcctcggtgaactacctcttccttgtacaacagattgattcttgctagacggtcatccttgccatgtgactgttttgcaaaattcaatcgacttacattaatagccgattgtattttctgataagtattacaatcactagtagaatgatcaaacaaattatgccacttacaaaacttggcatatttatgaatattttggttgtttatatagtactattttaacttggcaattctactagggaattatttttataattctatatatttagctcttctcttatgtcagttatattacctaatagatataattaaatattactaaataattcatataaagtctaaaagatgtaaactcgtgtttatgcttcaactcaattatattgaatgcacgtgttggaaacttagactataaaatcaatactcctcatcgaaaaatacatgtacgaggacaaacttgttattcatccctactagtttatccaatattcctcgtatttgccattcattcttcaattgccagtggccgataaaaactgccaatctataactgtatagttagaacacccactaaaacataatgtataccatactaaccaactatataggcgcatgcaaggataccaattacatctaaaactcaagatataagtatgctaaatctcattccacatatcattttcacatctcaactccatataccatttgtacaacatcatatagattcatgcatatatattccacagtaaagcgcgggatgttgtccattatatataaaaagttacaccacacttatttatttggaatgatcacaattaatcacaaacaacccaagcgagcacacacaattttgtctagtttcacaacaataaatatacatgatatagactagccaacggacgtctgctcattgaagaatgagtaacaagttcaaggatagacctcgatgattgacctgaagcccatgactggcatgatcttgtagctactaaatccagcttcaacgaaaagtttcttccactcctgttcatctcgctcaacgccattgacaaacatgatgagcgcgtcaaacaagatctgcacatctctgtgcttttggtcagatgggccaactccgaccactatatccatgattatcacctttccaccggcgtctctagatgggatggcttttttgcagttccgaagtatcttcacacagtcattgtcactccaatcatgcataatccactaaatatagaggaaacacatatatatgtatcaataaaatctgtatgtacatgtatacttctattgataggacactttaagaatattccaattttgataaatggtgaaatagggaatatttttagccataaacattagtgggaccaaactgtaatgtcttaaaataaaatttagagtcgatatcaattacaaattgctgattactattggactagtcatcaaccttaatttgcacccacaagggaaacatagttttgtaagataaatttagagaatttcagtgtagggatatatggaattaattgcggatatgtattttgagagtttagggatctagatgacacaccccttcatatatgtgtcaattagtgataaaataatttacaacaaattaaatgactgattaactccgtagatagaagagatagaaatatacatagatagcaactacatagaaaaaaagttggctaaagtccagttaaacatgtggttcgatatttttagacaaaaaaaccaaaatatacttgagagaatttcgagccagaccagtctatgtaccttgaggaagacagcattggctgctggaatactgtcaaacatgtcgccggcgatgaactcgacaccggtccccctgggtgcgtcggcgacgacgtgggcgaggtccatcacgctacatttcacctcggggaacgccttcgcgatggcccgcgccgccgcgccgttcccgccggcgacgtcgaccagcgagctgatcccctggaacacctcgccgtgctccctgaccaggatgtccatcatgaaggcgctgtccgacgccatcccgtcgttgacgaccgtgttgaacgcggcgtcctcgttggtcatctcccagaagctctggccgtgcgtgtgcttgaacatgcacggctcaggcagctcgagctggagccagtcgctgatccggaagaagggggcgatgaagcacgggtggagcagcatggacatcatgtgtcgttggttcccggcgccgatgaggaggcgggacaccggcgtgagcgtgtacatgggcgcctcgtcggcttcggctgcggcatcgccgggcgccggcttctggacggcgaagatgccagagagagtgagcacgcgcatgaggcggcgcaggcacgggatcttggaggggtggagcgtgaccctggtggctatctgggccatggtggcggcgccgccgtggtggtggatggcgtcggcgatgccgaggtccaaggcggccttgagagccatggacttgatgacggagaaggtgttgccgtagagctcgctcagagcatcgagcgagctggtggcatgttgcccgttgctctgaatgggcgccatggcactaccaattaattttgtcttccttttagtttggaatgggtttatgcacaagatgcactataaatagaggtctcaaattactgtatcaatgcaactcgttctggaaacatagaactactatactaggttatcagagaaaatgaggaaaaatgtactagtttcagggattccaaaattccaaaaacaaccagcacaatatcctatgcaattatgtaaccaatttttaatttaaattatgacatttggcaaaaatgtaaatgcacattaaagtatttgctgttgtttctattatttattgtgttgcttccatttgtcaatatagatgaaatgaaacaaacatgtccgctagaaggatctcgcggcatcatctcgctggagactttgcgtattaggatcatccaaacggacatcaaaacattttagtaacaaaaagtgacaataaagactgtttcgtcatatgtaactttacaaacatttataactaaattagacatactttaatcccctgttgacctaatttaagttattaaaaataaatatactctctctattttatattataagtcgttttgacttttgcctagtcaatcttttttagtttttactatgtttagagaaaaatttagaaggatctcaaaaaataaaattattttcactaaatgtaaaattgaatatattttaataatattttttattgaaaatgatattatattttttaataaacttggcccaatgtaaaaaagtttgactaggtaaaaattaaagcgactgatagtatgaaacgaggggtgtactgaccatattctaactcttacaagtcatctaagcccatctccacactactttcgaagaaatcagttgagacgaccgtgaatgaaaagataagttctctttaaaataagtcaaatcaatacattgaaactgaactaaggctgtgtttgagggagagggaattgagaagattgggaagatacgtaaaactaggtaagccattatcgcatgattaattgagtattaactattttaaacttcaaaaatggactaatatgattttttaaagtaacttttctatagaaattttttttaaaaaacacactgtttagtagtttaaaaaacgtgcatacggaaaacgagatacaatctcccctttctcatgtgaacgaacgcagcctaagtgaagcacaagtggaaaccaacggccagcatatggcctagcaacgaacaacttgggtgtgttcgtagaacaagttaccatccgggacagtgatcacggaaaacggaacaatctattagcacgtgattaattaagtatttaatatttttttttaaaaatgaattaatttgattttttcaagcaactttcgtatagaatttttttttaaaaaatacattgtttagcagtttaaaaagcgtgtacacgaaaatgaaaataaaaggagatgggctgagaaaagaggcatcacaacacagccatatatgcgaagcttgatgcggactcttggcttagccagtagccacatcctagtgaagcattattaatggctcacaaccatcgatgtacaatgtggccaatgggtgctgaccagcaactattggccaaagggtggtgaccagcaaccattgagcatggaaaaaaggacgacaagatggcaatagtaatagaattatctttaatattataaactctaattaagaggacgacatgatgggagaaatgaaatttatattactagggtactataagtatctgtttttctgtggttgataatggaagccatcaacaatggcattgtatttggcagtggtagaattagaatggttcatattgggattattatgagcagagggatgagtcctccactactgttaaggagtttgcgaggtcatttggattgccaaaaataaatactatgcaaacaccaatatttcttttgaatacacataatatttggttctatgtttcgttaatattggggaatgcaaatcattataaataaatatattatacgattcatattatgatagaatatattctcggtattaattaataattcacataacaaaattagactaattcaaaccacaatcataaactttagtctatggcacttcagctgttacaattgctccgcacataggaattatattacatagttaaaaaataaacaagcagatgaaaaagtataaatataattccaagatatgctagctaactagccacacagctatgtggataattcatttgcttacatattatatacatatgtgtgagtgtatgtatgtatgtatcaaaggtccataaaaaggattttgaattacacaattaaagtatacatagtatgaattgttagaaaaaatatgcaatcgtgtctaacttttagtcgttctgtgaaccaagtgacattgtcccatgacctgcaagtcaaaaaattacaaaattgtgagtttgagaactcacaaattggtgtttgcggaacttaaatcaagtgagagcagtgtgtcagctaattcttcttccattagacctccttgccgcagcatcatgccaggcaccgcctggctcttagcaaaagtaagggaacatcgtcaactaaacatgtcctacttgcagtgatagtaagaacccaaagatccgcattattcctggtgaaaaccaactatgaaaaatataaatgtgcatatagcagcatagccaagcttctcctccttccactgtatgtgttctgaaggttcaatcatgtatatatacttcctatttggaaacaatgaaagttcatagctacttgtgccttctttggttggtttatagtaatttactgtttgcgcatcatttagttaggctcattatgtcacctccggaaattcaatagcaatttcatcactaatttgcacatacaattaatcatcgtccaaccatcaactgaggtatacacaaatcgataattcaatatagatccaagataataaaaacattaaattcttatataagaggaacttagtcctcacaaaaaagaaaacagcgacagaaatacaatctagcggtggattcagctcaactcccatgggcaactcaactagattataagccaagcgtcttctcgttcataatcattcttcaactgaggttgataattattgcaagaaatgtacatgcaatacttccacaagccacataacaattatgcaagtgtaatagtatgacaaaaggacatcatatgggggttcattcgcaaaagcagtatttagcaaatatttgacaatactaaaatagttgagtaattaaacaatattatatcacattgcacatcacaacaatgttgcacagttccaaccattttgaacaaccaagcccggttgcacagatctaaccccactcaaagagctaataaattattattaccaatttatttctcattaatgagttattgtgagagcaatcacgaaaaatattgttaggctctcccataaccactgccatggctatttgatcgttttttttaactctgaccagaggtgtacaaatttacccacaatacatgattccacacatcttttcatgtcctgaaatacccccatagtactacaaaggaagaaattgtgacaagactctttgcataacacgtcaaacaaaatatatacccactaattatctgtctccggtagggatagccagatacctagacagggagactacttagcacctaaacaactgtgaacatattatctaccgcttgttgacttattatctgtcaagctcaaacacacaccgtgacaccttccgttgggacatgtcatactacagatccaactattaaccatgttggcttatggttagtacgattaatacttcataacagtagctcacgaatcgatctttaattgttatgagcacgatcaacataaccatgtgctcacaactcaccattagttaagttttagttgaaattatgaacaaccacaaccgtcatcgtgatctttcattaataaccataattaatcatgaatgaatcattgtggccatggtcttgaaaatggcgaatgtgagagcatctggctagcgagcttgtggcatgagatgcacattgctctcagtgagcaccatggcactactggtttcgttttccttttcgtttcaaatgagttgatgcacgacgtacactataaataaaggacaaagggctcaaactattatcaccacagttggttctggaaatatggaaaaaaaagtattttttttattcttgggcaccccgggagtgcacatgttaaatcgtgtacggattgattgatacagtttggtctatttattgaaatagaagctagatgatatgtcaaatcaattctgcctttagcatttataaataccgctaattgcctctatattactagtagccaccaagtcgcattgcgcgactctaattaagtgcctacatgtcttcatttatatttatataatgtgtcgttgtagttgcgccactgtctatttgtgctgaatttctcatgaattcatgggcatgtttcatgagtaccatggtgaatgccagatgccgttatgtttttcagtaccgagcatataaaatttataaaattgacatcattgacagcattttatatattttcttaaagctacatataaaaaaggcttgaatggtggcttactataaattccgagtggcaagaggcaacatatgaaattgcatatagacttgatgtcccattattatatttgtaggtgtgtgtgtataatataattttgaagaccgaatagtaacagtagtacttgttagattgatctccctcccgttgagccgttgggctcaagggggacttgacccgcgccctgatcaggggcgcccagcccaatggctggtgggcccctatcaccctgcgccatataaagaggggtggaggccggggcggcgcacgacatcaggttcgctaccgccgccaactccacccacaaaccctgatccgatcgagagggggcgcaaccagtgacgggaaaacgccaccgccgcgccacgcctcatcgccacctacgactcccactgctacgaccaccgtcgtcgtcgagcacactgtcgccgccgtcctcgtcaagctgagcgacggcaacgacgatggccggcacttcctcctcatccaacgtgtcaaccggtcacatccctaaacccttttcccttaatctctattgttgttcaatcattcaaccaaatagaaccaacctgactagatctaaacctaggtgatcctagagagaatactaacaatggtatcagagctaccctagcgcatagatcggtttggggagagaaatccacaaagaaaaaggaaagaaaaagcaatgatccgctcggatcaaaagatcgaaaccttaacccttgaaccttaccttgtcgccggccgaacgttgacgccggcaaaggggtgaaagggggagggcacagggcaccgccaaggagcctctcgatggccgtgtgcgcacccgcaggtgcacgcgcgcgccggcgaggtggcccgtggcggcgcatcgccgctctctctctctccttcacttcacaggtggaggattagagacggtgggaggagaacagaaaagtgggcgcgccacagcgcgaggtcaccggccatggcgcgccggccatgatgcggcggcgcgaggcgcagcggcagtgcgacggcgcggcgatgcatgggccgtcaacgcagccacgcgcgcgaaagatagagagagagagtggagaagctagggtttcggctagctggcggctggggtcgggtttttgtccctccgatctcggcgcccggctgtctgatcgaaaccctagtgattggacggccggcggcggctggaccaaaatcggcccatgtggggagcgcatggcgggcggctttcccggctcaggcccaggttgcggccaagggaggggtgagggagcgcccgcgcgcatgcaaggcggcagtgggccgaccggcaaaggctgaaagagtctattttaggtccctcggggccgaagcaaaagaaaagaagtccattttttgtccttgtttcagaagcatttgcaattatagttattaaaatgtgtttatttctaagcaagttgaacccacgtgaaaattgtttagagaatagataaatgtgagaaatgcttctgaacatgtattttgtgtattttcatgcaaatttcaatggaattttgtatcgattttgcatgttttatatctgtttaaaatttgatccaaagtggtagtttttttacagagagtgaataacagaattttgttactgttcatatgaattttatatagatcttccgctgcaaatagataaaattgttaaaagttgtgtttttaaaataaattttgaaccaacgggagaatttaattttaggaacattaattttgtgctatgatgttgtaattttctgaccaacgttgataattgcaatgttatagttatggctctgtgttatatctatttttacccaacggtgatgtaggtctaatgcataatattttaatgttaattttgttctcacagctactccttgattggttgcattaaagatattccgacctgaaaggagataactacgaagaatggaaaagagaactcgaccttgcttttatcttgggagaggtggactgggtgttgactaccccatgtcatatagaacctgctgaacttgacagaggtgaaaaagagtcagatgctgaatggcaaaagagagagagggaccatgttcccctcatcttgtcgtatgacattgagcatgcgaaatggtccttagccaacaagaactgcttggctgaggtaaagaacacgattgagccaaccatattgggctcaatcccagagtgtgacaccgtctctgagtacctcaaaagtataaagagctagcttactagttcttcaaagacttatgcgacatagctgataaagcagcttgtgatagagaggtaccatggaggtggtgtaagagacgacatccttaggatgagcaacatagcttccaagttgaagccaatggatttgggcatctcagatgactttctggtccatctggttatgacctcattgccaaagcactttgacaactttattgtcaactatgaaataagtccaaataaatggaatttttaaagagctcatctctaattgtgtgcaagaggagaaaagaatcaaagagaccaatggtggctccattaaccttgttaaagataacaaggataagagccataggtcaccctcctaaaaagcaaaacagcctcagcatctgcctcagcaacaatagttcacagttgagacaggatcagtgtctccactgcaagaagacaagacattccaagaaagatcgtcctgacttcctgatagtgatcatggcaaagaaatgtgagaacattattacatttgtaaatgaatctcattatgattggttattctagatccacatagtggatttattctggagcaactattcatgcatgtaattgtttaaaggcattccgttcgacgaggactacgcaaagaagcgaaagatccattagagttgccaatgaagcaaaagttgaagctgttggagatcttcacctagagctcgtgaatggcttcacacttttacttcgagatgttttttatgtcccatctttgcaaagaaacttaataagtgtatccaaattggattttgatggatatgattgccattttggaaatggcaaatttgaactatggtataataatgcatgtattggtcttgctgtgttgagttcctccgcgaggggttttctcgttctcggtgaacccctgtggagatagatggcctggcgaagtcgatggcgccgctgacggagaaggtcttccagtcgatggattggcgttggccttcctggtagttcccatgtcctgtgtcaaatgtcttaggaaaaaagtgtaatatagttatggattttgatgggattgtaagaaatacttgtggaatatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgccttggttgaacaagcactgatcctagcccccagccgtgaagttggaaagtttatttccgattacacggcttggttaatacacacggcgagaactcttacacgaccagatcttacatggtctttcgtctctacaggatccgacaagaccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctatacctgaaaaataggctttattgaggctgtaagatgtcttacaagtatggatactattgacttatacatagaatttacgtaattgatcaatgttccaggaatttgccaactcgcgaccatcgctgtctgcgattttgaatgcgcctggccgcagaacttgtgtgatcgtgtacggtccttcccatttgggtgagagcttgttgcgccctgcttggctttgaacccgtcggaggacgtagtcgccgatcgaaagtgtgcgtgctcggatgcgcttctcgtggtaacggcaaagggcttgttggtagctggctgctcaaacggcaactcgttcgcaatgttccttgaatagatttacatcgtcgtatcgctgctcctcctgatcctcatcgaagtacttctgtactcatgtactttgatgtcgtagctcggtggggagcatggcctctgagccgtacacgaggaagaagaatgtctccttgttggaagttgtcggtgtggtacgcacggcccatagtactgatggaagttcttcgacccacttcttgtcgtgtgacatgagcctgtcgtagacgcgggtcttgattccttgtagtactatgccgtttgccctctagacttgtccattgctttgagggtgagaaaccgaggcgaagcagatcttgactcccagcctgatgcagtaatcctggaaatcggcactgatgaactgggagccattgtctgttatgatacggtggggcaatccgaacctgcagaatatccctctgatgaatttgatggcgttgtcggccttgatttcccccgtgggtatcgcttcaatccacttggtgaatttgtcgatcgccacgaataggaacctgtagccgccctgtcctcgtgggaatggcccgagtatatctagcccccagcacgaaaacggccaagtgagagggatagtctggagtgcttgcgctggcaactttgtgtgtttactgtggaattgacaggcttcacaccgctgaaccatgtcgcaggcgtctttgagggcggttggacagaaaaactcttgttggaaagcttttccgactaatgtccgaccggcggcatgttacccacagatcccttcatctatgtcgaggaggaggtgtctgccgtcgtcggacgagacgcattttaggagtaccccattcgttgccttcttgtatagatcgttgccgatcatacaatagacttttgatttatgggatattttctcggcttctgcgtcatcctcgggcagctctttgctgcatatgaatttaatgagtggggtgcgccagtcgtctgtggtatcgatatcagcaacggcgccctctgcctctgtagcccccgagctgatgttgggggcgtccgggctatcttcgccggttgcctttttaactgatggccttgttaggacgtccagaaaggtgccaggttcaagtggttctcgtctggacgcacgtcgtgctagatcatccggtttattgttgtctttgcggtatacatgtcggacctcgatcccatcgaaccttttttctagcttcctgacttctgcgagatacttggataactcgggctagagcacttgtaatctttatgcacctggttcgcaactagtttggaatcccctttcacgatcagtcgccttactccgagtgcagctacaactcttatcccggcgagtagtccttcgtgttcggctgtgttattggttgccctcaagttgaggtgaattgcatgcttgaattgagtgcaataaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttctttgagtcttgtaggcgactccatgtcctcgattgctttgatcttctcgggatttgcttctattcctttgctagagacgaggaagccgagtagcttgcccgatggtactccgaacgtgcacttttttggattgaccatgaggcgatatcttcggaggttgtcaaacgtttcccgcaaatcgtcaattaatgagtccctttgcttggccttgacaacaatggcatcgacgtatgcctcaacattgtttccgagctggtcgctaagtgcaccttgaaccgtgtgcctgaaagtgtttcctgcggttattagtcccaacggcatcttaatgtaccagattaccccgaacggcgtgatgaatgttgtcttctcctcgtcctctttcgccatgctgatttggtggtaatcggagtaagcgtcgaganagctcaacaactcgcaaccggctgttgagtccaccagttggtctattcgaggaagaggaaagtgatccttgggacacgccttgttgaggtcggtgaaatcgacacacattctccatttttcgttggccttccgcaccctgactggattggctagccactctggatggagtacctctctgatgaaaccagctttgagaagcttgtcgagctcttctcgtatggcttgttttcggtctggtgtaaatctccgcagtttttgttttactggcttggcatcgggtcgcaccatgagtttgtgctcatcacctccctgggtacccccagcatgtcagactgctgccaagtgaacacgtcagcattgtcatggaggaaggtgatgagcgcgagttcctatttctctcctagtgatgccccgatcttaacggtcttgttggggttggcactgaagagtggaacgatattgattgcgccgtctggttttggcgtcttgtttgtcttgctcactttcttgggtggctctgctgtggcaggcgggctgggcgtatgctcgaccatgtcgaggctccgcttgtaacattgtactaccagcttagcgttcccttgaatagtgattgttcccttcagtcctgtcatcttgagcacttgatacgcatagtgagatgcggcaatgaacttcgcgagtgcagttctcccgatgatggcattgtatgctgtatcgaattcagcgacatcaaaggtgatttgttccgtttggaagttgtttgcttggctgaaagtcacaggcaacgtaattttacccaatggtttggacgatgactgaggagtgattccatggaagggttgatcggtgggcatcaactcgcttcgtaggatccccattgcgtccaaagtgctggcgaagagaatgttgattgagctgccgcagtcgatcaagactcatgcgatctttatattacgaatagtgggttcgaccatgatcggatatcgccctgggatgatagcagtcttggggtggttctcttctgagaattctatcttctgctcggaccacttcatcttgggcgcagccccctgccacgtcgaacagacttcacgttccgctttcttgtaatctcgctttgaggagtatgccgtggaaccttcgaagatgtgtgagacatggagatcggaatctgggtatgctgagtccgattcctgagtaggcacctcaatgtccttctcaaccacgcgtactcgcttgcatttttccgatgccatgtgttttgcaagcgactttttgaagacgaggcaatcttctagagagtgtctgtccgacttgtgtatagggcaccatgctttcttcgtgtcgctgccttgtgggtctgggcgcttaggagggtccgcgtattctgttgcgagaacttccgattgagctttccttttcccactcttgcgatttttcttcttgcttgactcaggtgcgtacttggctggtttcttctctcctccggtctttggtttgtcgttcttgcgtctcagtgcatcatccgcatgagcgcattgattgacaatttcgaataatctccgagtagtcgtgacgcgccttgttgccaactcttgagtagtatagcgatctctgacaccggatttgaaagcgcgaattacagaagcatcggtgatctcggggattgtgtttctgcactcgttaaagcgccgaacataatccctcaaggattcacctgggttctgtgtcaacgcatgtaggtcgtcttcgatcgcatggcgcttgtaagttccttggaagttggctacaaacttgtgccacaagtctgcccatgaagagatcgagtaggggagagatgcatcagccatgaacgtgcagagcctttcaatgcggttggtaagtaattcaccaacgcgttgtcgcccgctccggcagcgtagagtaccgtggagtaaacttgaaggaactcttctgaggtcagtgctcccatcgtatttctctattgctccaggtcggaatctttcaggccatcgggcatcccgaagtgaacgaccgaaagctctacacccagcgctgggggcggtggattgtcggctatcatacgtccttcgtggatgtctgtctgatgatgaagatgacgaggatgatgacgatgacgatgggtcgcttggttccggcgtacgattacgaggatgtcagccgggttctcgagaatcctgttgtcgtctcccgttgttgtctcggcgccgatctccatcatcgtcatcattatggcgacgtcctcgaccagtatcgtccagcacctgccgttctcgatcgtcgtttatcacggtcttggtcttcgcttgaacggcctcctcgatcttcgttatcgtgacgctgtgaagagacatgacgccgggaacggttctcgttgtctcgtgtgcgtcgtgcctctcggcggccgttcaggtgatcgcggagatcgccggtgccgcgaggtggaggggtggctcgatgaggcgattcccggcgttcagggttttcaccattagcaacgctagttggtggctgttctgggtgcgctgcggcagcggcctcttcgaatgcgttgctgaggttggtcattgattcccgtagtcgttctgtccaatgtgcgagatcgtcgttcagaatgggatcgtaaggggtttccctcagtattgcgttgacggctctgatgtgctgggccggagtagtcacttgattctccgcttccgcattggtgcgcgctgacgtgccgacatcgtcgatagccaatacctcacgcggcgtactcgttgttgatgatccatagtcttcgatcaggtgcaagactgatggttcgtggggatcgatgtcgattaccccaacaaatcgatctgaaatcggcgtcactccttgttccttgtccttatccctgatggggatgcgtgactgctgtaccttaggaggtggcgtcttcatggcgctgagaaagacctggcagctcgagaggtcgtgattctttgtcttgtgaataggacaatagacatcatgagttggagaggtatgttgaattccacgctctttgcaggcacgaatttcagcatggacgttgagaaagacccagcaggcttgcagggagtgtttcctggttttgtggatagggcaccaggaccttgtcacctcggaagtaatccttgtcagttcgtgattcctgttggaaagacaaggcttggccgcactaggatccttctcgggttcggatgtcgccgacgtttcgatctccgcttcggcgggaggatccttcgacacggagtcgccccgggttgtagccactgcgttttcgtttcaggccattggcggaccagttggaatcgacattattgtgtaaaccggaaagacgatttcgccgacttgagtccacaccagtgttgttgaaataggaactccttggttgaggttggtgttaacgctgttgtcgacgaagctggatgtcatagtagtagaaccttgagcaacaagtccccctacctggcgcgccactgtcgacgggggatacccgtagaccagatatagagggtattggggtacgctggtacgaggatctacgtaatatgacatcgagcaagcagaaaacaaaaattatattggttcaagccccttgataggtaatagccctaatccagttgatatgggattatatgatggaaaccacagattacaaagggaatagtggaactcgacgataccgacgagatcgtaatcgagttgattcaactagatcacccggcgattcggctctcctgtaagctccgacttcgtaggctgtagtggatgtgttggctctgagattcaatggcttcggtcctcccggggggtccgttttataccgcaggtcaactggtctccaaataagactcggagacatcggacccgacacaatacaatgacgacccagttctattcgagtaggactctttccatctgtagactccatgatggacttccttaacttatgctgaaaacgtccgtatacgcgcaaacataccatatcgatatgtgacgtatatcgaagggtggaaggtataccttacttatgctgagaacgtccgtatacgcgcaaacataccatatcgatatgtgacgtatatcgaagggtggagggtataccttacccgtaaccctgacacccccattaaggaaattcgttttattttttgttccaccaaaaatgttgcagtgaactgaaacattctttcgctatttatgaaacattgtttttatataaggtgaaacaacacccgatttaaacgagggaaacattttcaatctacttagtaaaacaattacgatatatctggtggaacatcgtacaacatttaaaaataattcaataataagctaaatatttttttcgtcggaatatatccatgtgtggtattgttttgaagatttaattacaacgaatttaatggtgcaatcgaatcatgatttggataaataatttaagagaaaaatcagtttaaattagttttgcacgtaaatcggacgctgagacgtcagcgcccgattttcccctacccatggtagggtgcccgatttgtagaggtatatacatttaaaaagaattgatgtaaacatatcatagtcgtagtgcaaacctgcaaactcactgtggcgctcagccgctcacagtcgcttgatcggtcggtcagtaaactcgctgccgcgccaaagttcgcttggatcgacagtgaactggctgccaaattaattgctaatgaaactaattaaagaaataacgaccaattgctaatagcgcaagttaattaattgtgcgagtttgctccaaagggatgcgaacctgctacatgtatctattgaagtcgcgcgctccccgcgcgaactcgcgatgacacatcatgaacacgttacaaaaccacacactcaccgtatgacctcactgtgaattcgcaccccattcgcgacagtggtatacttcaaccaatttctttcaaacctgtatattgctataaaaccggtgaaaagaaaagatagcaaatcgtgtgtggcacgatcatatgacacaagaaaaaacagcttttgcgatgcatgcactaggagagacatgatctttagtactagttctcaacccctattaattccagttgtagcaaccgagactaaagatcttgatttttagtaccggttgaaagaaccagtactaaagatatgcactaagtcaaaaaaaaaaaatatgtgggatgtagaattcaaactcaagatttatcatctcaaccctcacgcgcattatcatcctatttactacacacattttttaactaaccctgaacacatctttaacaccggttggtaacacccgtactaaagagtttttggtaacaccgggactaaagatatttttggggacttgggcttttagaaccggtactaaagagtttttagtaccggttcttaatacatccggtgtatttatggtttggggcattagataaaagatgagttttgt

SEQ ID NO: 81048 - DNA, 2271 bp, Oryza sativa
agcttcatcttaacctttcctgtagctggagctcagctaaacagtttcagcttcacctaaaatgagagcagagctgggtggaacgctatcataaaataaacaactccactttagacttaagctaaatttagaagttggagttctaccaaacaggtctttgaagctgaagctaaatttaggctgtgtttagatccaaagtttggatccaaacttcagtccttttccatcacatcaacctgtcatacacaactttagtcacatcatcttcaatttcaaccaaaatccaaactttgcgctgaactaaacacagccggaggagctaaatttagaagttggagctctaccaaatagttccttgaagctgaagctaaatttaggagaagtggagagtgcatttggcagctcgcctgtagaaatagtctagtagtagcgagtagtgacactgtagatgctgctggcttagtgcaaactgcttcttcattgccagtgtgtcctgatatgtgaagcattaatcagtgaagctaatctggacgtgacgcttgaaaagcttcaatgttctgctgtaatgcacacagtttcataatgtttagaatctagtacagttctgttttataatcgcagttttgttttcatgaggcatgcgtctctagctgccctttgttttgatctataggatccatttttgttgaaaagaaaaatgtttttctatttttttagataaaaatcggacattctattcattagcaggcaagtttacattcataatcagagtacgggaaggaattgagaacccccaaaaatgtttactagcgtagatacgctggaggcttcctcatacagatatcaaaatcttttgtttgagcagagagcacacttcataactttgtaggccaaatgatttttgatatttccatcagagcatgtaactaccactgtccacacaatcaattaattcgtacaactgataatgccaaacagaaatggctcattccgtaacaccgttatttctgatatttcctgttacaccatactgttatgctagcattcaaaatgaaaccagaaatgtagatgtaaggcagtgtcatacattagaaaggatagttttactttgtctgggaatcaaaagataatcagaaccaatatagctaagattatttctgagatgcagctttagcagctgaacacgagcaaggagaactcttcagaggtagcaatcaaatcatttgcccatttcccagacaatggcactgtcctctgcatcagcaagtaagaagagtaagtatatgtacaaaaatatacaggcaacaaacaaaaaggtgttacatgctttcaattgttcaacccaacattatccaagacaaaagaagagtaatgctttcaattgtataatacaacatcataagttttcaagaaaacagttactttgcaagaacgtaagttgaagagcactgctacacgtactaattttttcttactaaatttgtactaacaatcatatcaaccgtttgatttaagcagatggaagttataaaaaatctagatggactcatagcatgacatgtcagtgttagtaaaaatttagtaagaaaaagttagtacgtatagacttttcctaagttgaatggcccctcctgctaccaaataaaacaagaatgcacctttgatctttttgtttatccaaacctcaagcagcatccctgcgccaactccagcagcacacgcagcgccatagattgccaatgcagaaggcaaagatcgccgaggcagaaaatagcattcaggaacttgtctgattttcttcgggagacgctttttaacaactggttggcttgggtcggtgctcaccgaaccaccaactgttttccagtccacattcttcagcatatcttttgtgtcctcactgcccatcctgaaaacgcctgtatgcatcaatgttaatcagaaccaagctccaaacactatctgagaaagtgagtggcagctccaaacaccacgtcccactaggcccgaaaaccttaatccgcgaatgtctgaacgcggcaatgggggtttgggtttagggtttccgggggagaggaagtgggggatggattccatggtcttagagggatggcctgggaggcagaggaccggcggcggcggcggcggaggggcggggcgaggggatgtggaggaggaggaggaggaggaggcgcggagctgacctggatcgcctcaccgtcggggaggtcgagctcgtcggcgtcgtcaggaaggtcgccagcgttgttg

SEQ ID NO: 81049 - DNA, 7410 bp, Oryza sativa
gtccctggtttcgtttgacgtggcaaaaaaaaaaaaactaggacccacgtgtaagtgactgttcgactaaaaataaactatttatagtgggacccacgtctcctccccaatctcgctgtctcttgccgtctcctccttctcccaatgcggcgacccagcggcgggatccatgcggcggcggccaacctggcggcgggacgatgagcagtggccggcggggaaaaggggcagagcgcgccgacttggagacgcttcggcgacatcgtccacctcgacacgagcggtggacgcggcggatactcctcttcctcctcccctctcttggtcactggccagtggtcaccgctcgccggagaggaagacaaacttgtggtggtcgtcggccgattggcaatcattcggcaacgacgaccgatgctggttcagccgccgaacgccgacgcccagcacactgacatccccgacggccgctccttcctcggcgtcccccgctactaccgccacagcctcaccgtcctccagagagccgtccgctcctggaatgcccacaaccacaagcatccaatgacggcggcggtggcgccgtccgcttttgtgtcaacttcggtgacatcgtcgacggcttctgccccaaggacaggtcgctgctggccgtccaggccgtcgtcgccgagtttgaccgcttcctcgacgcgtacgacttcaacgccgtgggatggtcgcgcgaccacccgatggccgcggcagcggggagattcttggacaagaggaacccgaacacggacaagaacaacccgagcggccttgccggcgtggccaggcggttcgtgatgttcaacggtgccgtctgtgaggcgcagctgcggtggctcgacggcgtgctgcggggtcggtgctgtggcgggaaactgcggtggtgtgcaggcacctgccgctacacctcggcgcggcatcactgtcagggctgatgtggaactatgagggggtgatgcgcgtggtgcaccggtacggccgccgctccgcccacgttccgccgccgctccggccgccgcccgccccgcttcgcccctctcttcctccatccctctgctctgccgccgctccggccgccgcccaccacgctccgccggctggagaaagagaagagggagagagagagagaggggatagagagtagtgaggatgacgtgtgggcccacgtgggtcacaccattttttattacgattttgctatcgattttgctatatctcactcgaaagattttttcttatctctcactcgattttcttactcaaatttacagtgcattttcttgtaagttacagtgtaatttatgaaacttacactgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgattataaaaatctttcgaaagatgtatagttactcccttttgctatatctcactcgaaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctagaggatatggtaatttaatgttcattatggtgtttcttaattgctttttgctttttattatatctatcggattttaatacaaagattaaaaatctgtgtgatatgattataaaaatctttcgaaagatgtataggtactccctttttattattttgtatgtgcaactgacatgtgggtcccgtaggttttattattttttcggatctaattgacacgtaagcgccacgtcaacgacatgtcagataagaccgaatcaaattagccacgtatgcgccatgtcagccaaaaccgctatcaaaaccgctgagggacctcgtttgcccggtttttgtaagttgagggacgtgtcgtgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctctctcctttcccccgaggccccacctgtcgggtccttcccccacctcccgccgatcccggtgcgccgccgcgccgaaaccgccgccgcacccacttcctccgctttcgccgcgcccacgccacgtcgccgccctctccccgcgtctcccggccgcgccagcgcacgagaggggcgggattcgattttgaatctcccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacccttcccggccgctgctctgcgtcgccggaataccaccgaaaccccatttccctcgcgtcgtcggtgagttctctctcccctccgactccggccggcgtggatggtcgccgtgggggttttcctccgccctaattcctctcctctctttccctaggtgtcgccgtcgctcgtccgcacctcggcatcgccggtcttcgccgcctccctcgtttttctccgccggccattgccgcccctccggtgaggtctccctccccttccttcccttcttttttttttccccgtgcgccgccgccctcttcgcgcgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgccctccccctttgactcgctgacgtgtggggcccgcctgtcggcgccggccctttgctgacgtcagcggcagtccttttcctttgagaaaataattattaattgcgcaataattcgataataattatagaaattcattaaaatggctcaaaaccttctaaaactcatatctaattcattcgaactccaaattgagccattcaacttgcaaaatccatctaaaattgagttctacatgtttgtttactttttatgtactgtttccttggtttttattagagtttttcctcgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgtcctttgtcaaccttgggtgataaatcgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagattttaatgttacttaaattactcaacagttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacaaagtggtatcagagccaactcgactgtaggttgagccaaatggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggaggataaactgtcagcttcgtgtctgttcggaagtcaagtcaagcatcaagcttcgtgcagcaaagagcgagaaggtcggttcagagtcgtcgttccgtgaagatcaagaagagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagagtagcggaaagaactccagcagtagtgtgttgcagtcaagagtcagtgtgttcatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcgaggacaacagttcaaaggttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggtttttctggaattacttgttatttgaattgggaccagtcgaagcggacatagggtaaatgatttataaatgccagattccattttcatcctcttatagctagcgtggtgaattctcaggttaccaaaattgctaacctcaacagttcagcccaagctaagtaagtttcaggagcatccgcagtcctagactgggtcagttcaagcaaaaccagtcggtccagttttggcaaagcaaaggaacagaaaggtcgaatccagccagttcaatcgtacaggtttgatcaaccagtcaatcaatcagttcgaagcagaatgtggcagttcaaggtgcagatcagtcagaccgcccatcagcaccggctttctttctagccatcccagaatctcgggacgagattcctgtaaggggggtagatttgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctatctcctttcccccgaggccc

SEQ ID NO: 81050 - DNA, 2790 bp, Oryza sativa
  unsure (1)..(2790): unsure at all n locations
ttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacatgtcgtacccggttttgcggttcagggacgaaaatcagactggacgacaaatagagggacctaagtgaacttattccaacaaagaaaggggagaatctatataaattggcaaaatttgctacaggacatctaaaaaaacgtgtaattagttagaagacaccgcaagaacgcgtttttgctgtaggcaccaaaaaaatagtaattagctaatggatacccgtgtgattattttattatatcgggaagaattgaagagagaaataactgtgtaattatgtttctaccctttgatttttttcttttccttttttttcttcattatctttttctccctctctcattctttctctttttctctctctacacccaaccaccactacgttctctccttccgctccttccgggaggacgaggtcaggcgcctcatccgctccatctccgccgagagcagcggcggcaccgccgccttcaaccttgcccgtcgtcgccgccgcttcgcccgttgtcgcggggctccaaatccacctgtgtagctcaaaaccaaagctggtcctggggttttgggggcctagggcaaaaacttatatggagtcccctatatatacataaactaatatatatatatatatatatatatatatatatatatatatatatatatatatatatatatatatatttatttatttatatagtcttattaagagaaaaaaagatagagaaattcatcagataagatgaattggacttggaggagtgtaggaccttgaaatctgatgaattggaggagtgtagtccaggcagcaggtggcaggggcagcgagcaatgagcagtagcgagcaaagaaggcgatcggtggacgatcgacacaaacgagcatggctactggtgagccgcgatttgccgacttgccgttttcgtttgcgagacgctaagaagtcgccgagagcgcaggagcagcgagcgacgtgagtagcatgcatgatgtgatcgaggcgaagcgacgggagtaagatgaagatcgcttcggcttcgctgaaacaaacttggcgatggactaaaattcattttctgtgttgggctatttagctgtctaacttaatataggcccatgtcccaagaactaaaattatacaatacataatatatatactatatgtgtacgtataaaggcccctagattttgagggactcgagcggccgcacagcctgaccccccctagggtcgccctgctcaaaacgacgcacaggcagagcagctagcaaccaaaagcaaagcaaacaatggagctgcgactgcgagcaagaggggacatgatgcggtgtagccgccgcctcctttgcagcctcttcctcgccatcgcagcgctgtgtagtgtcgcgtcggccgcggcgacgactgggacatcagctaccagttcacgtcctggactacgtccgcaagctggccgtcaccatcaacggccacacgttgggccccaccatccacgccgtccagggggacaccatcgtcgtcaacgtcaagaactcgttgccgacggagaacgtcgccatccactggcaagacatccggcagatcggcacgccatgggcggacggcacggagagcgtgtcacaccctgaagttctcctcccaagcctaaaatttaatttataaatgaccctaagaaaatgccggtgcaaatcaagagaaaaccctaagaaagtaatacaaataataatcgaatctgacatgtggaatttttcttgagttctacatgtcgaaattcactaacaggatttttagtggaattttcagagccctagaaataattttaatcaattaaaattgagcacaggcaatatttaaatccctggaaattcctttctttctttttccttttctttctccttttcccttagtgggccgccggcccatttcccctcctctctccccgcgccttgctgggccggccggaggccacgccctagctcagcccgcgccccctcctctcccggggtcaccgacaggtggggcccacctgtcgggtcctcccccaacctccagccgctcgccgccgcgcccgcaaccgccgccgcgcctcgcgtccgtgcctcccaggccacgccgtccacgtcgccctcgcacccacgcctcccgcgcccacttccccctctctcccgctcgcccgcgcttccgagacggccgggattccattttngaatcccgcctctctctcctctcccactccccccacgttggccggcgattcccgcctctcccggccacgtccggccccctctctccctatttaagctccgccgtcatcctctctctctttttccccatttcgccgaactctcccgagctc

SEQ ID NO: 81051 - DNA, 9856 bp, Oryza sativa
aatagccgtgctcacggttaatgagcaccgggacatgtattacacttggctagactctaaattcttaacttgtgggggatgggatattgcatgatgaattttatgctgatggagccatttcccgagaggagggaaggtggacatcctcagaaaaccatgacgattcaatggcgggaagctatccttgggatcacaatggatggtggacagaaccgtcgttgtttgaagtgaacactggtactaaaatttgatcagtctatgctaggtttcaggcttgtgaaaagaattgtaaaattagctttatgcaaaagaacctgaagccattccttgaaataccctctatcatatgcattgttgttgtggtggcttgctgagtatggttggtactcacccttgctattcatatatcttttaggagagtgttgaagagaagcccttgtcggtacgcttgtgtatccaacaagatgatcggagtgcggtcttgttctaggtctcgtttcccagtcgactgcctgtggcatgttaaccgggctcttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtcaacaaccccctaccgtgtcgcccttcgacctcatcagtcctgaaaggcaacttaccagagcggccccacttggccagcctccttgctctcctcatcgcctcgctattgtcacgcccggaatttctatccgaaattccaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaaaagataaacgacgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcttttattatggtgagaagtgtgagactaatcacgaaagacattgttaggcccgcccataaccgcgggcacggctattcgaatagttttactctgatcagaggtgtaccactgtacccacaagacacagccccacatcatgtcactatgtgcctcaataccaccacggtacctcggaaaggagctgtgacaataccccttgcacaacacaatccactacagcgcacctttcctggttcataatcacccccttataaacaaggcatggactccccagcgacccctgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgccatgagcacgactctcaaaaccatgtgctcacaacccaccattatcaagttttagttggcaaataattaattaaccaatcacgattgacaatcgtgatctatcattaagccatcattaaatactagtgaatcataagttatcccaatagtgtgctaatgtttctaagcatggctaagcaatcacatctaatatctagctgaaccaatatatatagcccaactagtcaagttataatcacccaaggtatcaaggaataaagtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgtcttgctggccttagaactcttcaaattcttctcctgcgaaaacggacactccggaaacgtcggaatctaaacagaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggctcacgggaacgaacggccgagatcgatccatccaaaacggacggccgagatcgatcgggtctacggcggctcacggcagacggaccctgatgacgtcagcggtgacgtcatctccggcggcggctcggcggctcggacgcgcaagctcgccggcgaacgacggcgcttcggcacgaacggagggcactaggacgatgcgggcatcgcggcgaactcaccggtgatcaaagcaacggcggaggggcaacggacgacgtcggcgacgaggtcgaagcggcggagaccttcggcttgacgacgacggcggtgctccggcgatctacagcgacggcgaaggggcggacgaggacggcggcgacttggcgaccacgatggcgacctccccgagcgacgacgacgaccggaacggcggcggcgcacggctggagcggcggcgacgactgcggcacgagatccacggcgctagggctcttccgacgacgagagacgaaggcgagggtggcggcgggtagcggcgagcttggggatccttttataggggcaaggaggcggcggcgaaggcccacggcgaccggcgacgcgaaggaaacattggggttcggaggaaagagaccgatccgattcgacctcgaatccacgaatttccaaagcgatttagacgatgattccaaaagagaaaaggtagaggagatcccgaagatcatttcccctctattgatttcaccggagaaggaaaggggcggccgaatttgggaagcggcggcggcggcgcggcgctagggtttcggccggaggaagacgacgactccgacaggcgggacccacctgtcagcggcagcgagctcgcgcgggcggctgcggctgcggactaggccgacttgggccggggagagagagagaaggttttgggccgactttcggcccaaagccaaaagagacttttaaaaaccttttttaatttaaattattcatgaaatgcaattccatttattaaaaatacttccttagctcaaataaatcccagaaaaatctaggaattatagaattaagcaaagtatttaatgaaattttatctgaccccattttatattggaatttattaattaaaattagatcttctcttctagacttttaaaaataaattctaataattccatttaaacaacaatttatatatttaggatttttagggtgtgacagctatgcccccgccaccaacgtcggcccaccgcctgctaccgacctcgtggcgtcgtcgccgcctcgccctccacccttgttcaccacccattgtcagtccgctgcccctagccaatccctctaagtctgatcccccactttcccctccctagttccactcactccaccaccaaagttctaacgctaatcttaagttggggcttgtcgttatgtggatgggacgcgtttgtgagatggacatctcgcgagtgtttgcgaactagtgtttccacatgccaacaattcagtagaaggcagaagtaagaggcaaagtgagagtatttgctgctacccagtggtcactagctaatcgatcaatcggttgtgcctaatttctaaataatgaatatgaattcaaatgatgatggaggcttcaaataagaaaagcagtgatgcgctacccgatacgttccttcatgcttcaagcttggccagtgtttttttttcttggcaagttgtctgtgactctgtgtgctacgccgacggctatgatgattggtcatctaggtcattgttgacccccactagtagaggataactttttccatggagctattgatgggatgaaaacagatatagcaaagatagtgatgtttgattatatctagaccgtagataaaagacaatggttgatattggctcaaatccacattgtgaagttaccaactctaggagatccgcacctatagtattactctcggctgatggaaacacgtggtctgtggccccgattgcatcaattatgagtggattgtctatctagccatttgattttgtttaaaaaaattactttttgaaatttgaatggttagaaattctttaaaattttgggaaactcttataaactaagggtgcacccatactataaacctaacctaatccctcctttatcagttggccactccctttgcctgatccgtcaccgccgccgccggcctatctcccatctttgtacctctttgcctaattcatcgctacccctttctaacctcctcacttccctatgcccgatctgcttccctcctctcttcccaccatgctaatgcacaccgttgccatatgtttcgtctcctccttcccgcctcccctatctcttgtcctgccctcattttccactctagcacgattctccctatcccgcatctcccccatctctagcggctcctatcatcaggcttgctacgatcaccagtccaacaccctcctccctcatggttgaggtgatctctgcctcactgcggtgtgtagtcggagagacgccagaactatggagggcgacaagagcatgaatcttgtgcatggttcgatggtgagtatattcgaccggtgtttttaatattttcagtcacctgatgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccatatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaggcatatagtcaaggaataaataatccaaccaaccgagtggttttgataatcgtaatcaaccaagtgacttgatatcaatatatagcatatgcggtgtgaaacctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccatacctggaaatatatggcatatgtggtgtaaaatccgagtaaataaactcataaaggatttaccaaccgcctagaaaatgacaacaatatataatcagcctaagccataatattggtcaataaaaatgcacacttacgtggcgaaaagcaatgatattgtatccaatcaattgcttgataaacccaaacagcaccttgactatataaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttccgggtaatatagaccaggtgtagctcatatgaacagtttctgatctgagtgattatcccttaggagatactccaaaatatatataataattgaatcccgactggcgcaagtattcggttgatagcccttacggggaataataattggtccagtctttgagcatagaaaatagacccatgatcatgaattcatgttgcatatatccggagcaagtccaaattgaagatataatacttgtatttgagctagtaagcccctgagcatgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagcaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatatcgagattcacaacaacgtcatggttggtgatgtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaaacaccagtcgacggcggcataaccagtcggcgacggaagatgatgatgtccatcagtagtggtagcggtataaaccagacgtagaggcgagggcactagtcaacagcagacgagatgaccggcggtgaagaagataaggccaatcaacactggtagaatcatgcagccatggaagtgcagaaaccagtcggcagccatggcaaacgtaggcagcttgtgttgaagatactgatgcctattagtagtgacagcaatgtagccagccgtgaagaagatagcatcagttggcgttataacaggccagccgtgcaggcggaaacaccagtcgggggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcattacgtttaaacgctctgcccaactagtcatagccaccaagcactgggagtcggcctaagcacttcccaagcatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcgga

SEQ ID NO: 81052 - DNA, 9553 bp, Oryza sativa
ctagatcccgtgctgaatgcggactcagatgcaactgacgaagtaggccatgctagcacatcatgtgctatgctagcgatagttggatactttgagtgattggtcttccaccaatttaggatgtcaaatttgttcccaaattgctggatatgattctatttgaggtacatatccaattcagtatcaacttgctcagttaattgtttagtgatgtgttgaacccaatcagcaataggatcattttctgagatagccatcacatgttcagcttggcgcagagagttagcattgctatccttgagtttatataagtactccttaaacaacatgttcaatctcttcgtaattttgtcaatcctttctttagcattttcaccaaaggcttgcccaagccgaaattccacaaccatgaatttgaatcttgggtcaaaaatgacaggaatgcacagatatttgtaagacttaagccaatatttgtcaaatttatccttcatctttttagccatacttcccacttcagtgtcatagttagaatgttccttttggtgccaaatttttagggtcggcccgtgaacctaatgggccgatccctatgcaggctgaatcccatgcttttagttcacaaccacaagttgatagtgcagctattcccagtactagaaaaacgattttcacaggcgaggttcatgttactatgcatggcggccgaattttcgaccccaaacggccaccagcattattgtggatcgggggtgcaatggccatcctgtaacaccccaggtaaccacgtacctagagtgccacagcaaaaaatacactcaaaatcactaactctcaaaattattagaaatttcggtagactctcccctaaaaatacggacatccatgacagacagtgtagcatcctgaaaatgtgtcattttctaatcctgcatcatgccgcttcttatgttcttaataattacctaagcctaggacaatataattagagggacctcctagaactaactcgcacaaaacctctcaagtatttaatttattttgtgtttttcatttaaaaatatagatttggttaaattgaggtatttcttgatttggtttaaaaccttcttttgactaaaatttttttatccaaatttagtttgaaaaccccttttttacttttatgaattatggtccaagaaaatcctccaaaccaaacctttcctattccaatttggaatttattgttaacccatcctttgatattaaacctatgcttaattctccttccaatattccaatattcaaattccaccttttgatctagccaccaatttaatccctgtagcttgatttcctcttcggcacaagaatagcaatattataaatattcgtatgattgctcttgtgctaagaagaatagatttttattttatcctcctcttccaaatcaatttcctttgagccacaaataattttctagaatccatgccatatattttacggctcaaattaaaatcttttgcctccacctattttcctaccacattcctacaaatatatccaaattaggagccttattattcatggtattatttctatttgagtgcttccaaaataatttccctcaaattccactctacctctaaatttactgcactcaaataaatttgaattcccttaccttcaaatttatctccacatataaattcttttcaaacttagccacccaaatcccttctaaaatttagaaaaaccaattatactcaaactgggccaaaaccctttccctcctctaccccaagtcggcccagccaccacagccgaagccgctcctttcttctcccctttgggcgccgccactgtgcacgccatgggcgtgccgccgcccatggcatggcgccatcgccgtggttctcctcctgccaccgccgccaacttgccaaccacgccaggtcgttgccatgccgtgcccttctcctccaccgcccaactctaccacggcttccacgtacgcgcgcggcaaacgtcgaccaatcatactcgaactcttccgaagactcccggactccgatttatattctattcctactccactagcttgagactactaaactaagcttgagagaatatgagagagctctttctagaggtgtgtgaagaaatggagagagtgaggggttcggctcgacggctaggattgatctccaatgacggttggtgggtattaccaacctttccaaccgtcataaacatcattaccagccaagtctgcatccatcggtgctacggctggtttggccgaaccctgggctggcccaaccagcccagttcctagcaggcggcctccactcctgttcttctccgcaaacttgtgaattttggcccaatttgttgtgtcatttctgagtttttggcctattcatgcataaatctgattctcgacatcgtccgattgattgatcgtctggtttgatgttgattctccttcacttcattgttattctctgcaaaaggttagtaaacctaacactagtggaatatttttattctaatataaatatgcattgcaagtataactagttctcctctatttttggtaatattgatggtcgaaactgatcgctaacaaccgttaacaactctctcggttcaatctctctctcgcacttctctcctgttactggtacctccctctgttgctgtgctgctactctacttccctggttctggtctcctgcgcgcataggagatcaggacgagcagggccttcggaaccttgccctcctgacgatctgcacgggtaggcgggaaatcagggttttggggagccttcttcaacgcaactactcttctctgcatcctcaccatgtcggtggacaacaccaatggcgcggatgggaagggtacggctggacaggatggtactggaggcttcgtcaacggagacaattctgcctcacaatcccgtggagggccattcattgggtataatctctctatactgttgtttactgcgttctttcttattgtgtttctgtttagcgcaatgtttttgatgcattgccgtatgatggatgtctatggttattatatattaagcatgatccgttcgttacatttgtttaacaattgcactagtttattccttgttaaagtcatgattattatcttgataatttggattaaaatatgccgaattgtgaccatatatccaacatcaaggcccatatttggtccggtcattgggttgcaagtttaggctaaaatccatacatattagggaatatccaccttgcgcaaacggttctacctgcgtatggagccctgagaacgcatagggcccccaaggggcggatcaaggctagggatctcctgtgtcatctccattgaaataaaaagcagtataggatagcataaatagttaacctgaataatagagttgacccagctaacctgggatttagaaaaagaagaaattaatgttatccctcaaaatccatgtatatattgagctttatgctttagaggtttctctgatttgaggatgctagacttatggcaggcccctgcccccttaaagttaaatatatttaatggcttccaagcacagataggattcagccagcggttgaaccgcaaaaaaagaaaaaaattggtagtgctctgacttctgtaaattttgtggagatttagaaccatcccaacatattgttttcaattgccccattgcaaagtttgtttggtgtatgcgtagagatgccccgggcgcatgaagccccctctgattttgaacatttttacaagctggtaagaggtagagctggagtaaatcagaatggagttataattacattactagcaacagtgaggtgacaactttggttaactagaaacaatatgatggttttctagatgtatggttcttcgaggtaagattatgaattttcccttaataattaattatctttcaaatggtgtttcttctcagtcgatagaagaccctgtaaagcctcaataaattgaattcatatagaggcagtgacgctgaatatattacaggtcaattctcaacttcaggcctacactagaacggataccctcatctcaatcgggcggtaagccccatgtcaatcgggcacagcgtccatcacaggctagaagtcactgatgtgaagagttatctcaattgggcaaacggctgtcacgaatgaatatatctcaattgggccctaagtaaagcccgtcatcgataactttgacccagacaaccagtcaaactatagcccgtcacagataacctatctctatcgggccacaactagcgcccgtcacagatgactactaaccttatcgggcctaaactagagcccatcacagatgatactcatctcaatcgggtctaaactatagcccgtcatagatgactgatgacctcaatcgcgcctaaaatagagcccgtcactgatgactactgacctcaattgggcctaaactagagcccgtcacagatgacaactaatctcaatcgggcctaaactagagcccgtcacagatgacctcatctcaatcgggcattttgttatggcccgtcacagatgactataatccaaaaaaaaataaattttgttttttggctagcctcaggcctttgctagccatgcccgctgcaaaaatgacagaaacaatcacagatatccaatatccccagctccccagcatcacccattcatatacatatgcattcacatacacaaacatcaacatatttcacacaaccacacattcacagccatctcatatttcacatccattcaaatatttattatatttcacctgcaaaaccgagttaattggataaaatatttatttagcaagtcttaacataaacatatgaaatatatacataaatatgaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcagccaaagtcttcaccttttctctatacagaaggcgcatgttgtggtacatatggaattcgcactggtcacctatttgttgcttcacctggaagtcttttttgtggatgaggttgtcatgtcctgtcttcctgaggcctcctcttcgcacgtattgggcccacgcttcatctatcgctagttgaattggggtccaatcatatgcgttcttatcaattctggagttcaggtagtgatatgtactccacttaggtgttatgaccagaaggatccaatgggcactgcggcattaatatagtgaaagttaattaagtactcaaggaatgtgtcatgctgttgtgtatatttagttaacacacttactattaattataggcgcacataatgtactccttgtctcggtgggaccacaaggtgtcgtagatgtagttgaccattccttgacggtcattctggagatttgtgacagtgaccacttttggatcaaggaaggcaacttccggtgcatgcttctaacaccattgccaacttaacctacacacaggataaacgatcttgtaagcaagttaaaccgattgttattaccagattgagttgggcaacaattcttacaaggagtagcacttaaggaggcttgtgtccaccgctcggagcctgtagaggtcgaaaagatccttgaagtcgaccacgatataatttttggaccaaggaatggctttccatcgtgctctccaaggatatcggtagctttattcagcttcctggcgttagatttctccatgtagtataagtgaaggtccttgcaagtggtgcccattgcggcaagcacgccatctccaaccaatggcatgcctagttggaactcctgtggagcgacgtattttttcttgccctctttgcccttagtctcttcctgacccttgccgagatctagcttccttggagctagaagcgaggcctgcacctttcctccccttcctctcccctttgcttcgggtttatcgagagtaattctttgaggggaagagtgtgccttcctgctattcttcatcggtgggggttcatgaatcgccttgctgtcggcctctgttcggtcctccccaaaatccgtgtcgtactgcaactacacatcgtaagattgtgcatgacgatcttgagaaggaggtgctgaaggagcagaggcgggtctctttggtggacgaccgcctggtgcagtggttggcctcgctgtaaccctgatctcaatgtggtccttgggccattggatgaaggtatcacgggcatttcctagtgagaggacctcgtcgttcggtggatacttcagagggaacagctcgtattcgggcttcaccgagtcgacttgaacttttgaacagtcggccctgagttgcgctccatgcactcttgtctctggggtcgacttgtacgcaagtccctcggctgctggaaccatgaaggtcggcatcaccctaactgtgagggtgcagctcgttggttcctgcgatagattaatcaattttttttagaatattatatatcatatggattcgttatgtctttcatgtattgagtaagttcacggttaccgttatgtggtcgactgcactgtcgaccgatgttggattttccgccaactcagtcgatgcgcaactgctgcgttttttggtgggacttcctaactcttcgtgtgcaacagtagcggcggcctgggggttctgttgctcttctcggatctcttgcctaatcttggccctcatcaactcgggcttttcgtcgaattcagatgtcagctcagctcttatcgacgcctggatcttggcttcaaggcttgtatctttctccgccttgttggaagtccgcttcttgtactgccacgcgtagtctggaaatccatacttccagggcacagaagacccaacgccctgtgtgcgtccacggtgttccttgttgcccaacgctttcgtggggaggtcgtcctctcgtctttgagagcaggcctcttgcgaggcttgttgctcggcaaccaactctttctgcattacaatttagtggggttaaatagactgcacgataggaaacaatgtgaacatctagtttgactagacacttactatagcttcgtatagtccttgatcttctgcatttggcatgaagattgtgccatcatcattcttctggtacctggccctggcccagttcctagcccgagggtgtgggatatcgccaaacacgagcggtgtgcacgattcttccgcttcttcatcctcacgctgccattcctcttccttaccggcttatccggcggtgccaagctagtgcggatgttggttcctggtctagagcaagcgatatgccttgcttctagctcttgactctagggtcgacttcttcacatggaatttctctcttggatctggattcgccgggttgtagatgaactcgcctactagcttagtcttgaagttcttctaagcattgcccataaccttgaaagcagcccgcctgagacggtcctcatgctccgcaggataatcaaaactctccttgaacgttagccaagcaatgtccttctctgcggcgggcacgaacttgatgtcatcttgtagaatactgaatttctgcctccctatgaccccgcagatagacctaaatcggctcaatattttccttggagttgtcggataccctacggcgtccaccactgttatgcggaaccgttccttagggattttgttccctgtcctaggagtaggtgcccttgaggacccactagttgtcgtcgatattggttcgccttgctgagacatcgtctactttttttcaaaataacaaaaatacacaattgagtgctacaatctattacaatgaattgaatgtcacttataaagataaatgaaacatataaataaactaaattgcgcatctcacagtaataaaatgaaccacatttcacatatcatccacatccacatttcaatgacatgtcattcacagttagcagagggcggtgcgatggaggactcacctgaggatggccggtggggctcggtggaggcggcgccgggctcggtggacggcggtgccggtcggtggagatgccggtcgggcaggtcggcgccgggtggtcggcgtcgggctcggtgggggtcggcggcgtgcgtcggtgaggacgcgggcggcgacgacgaggaaggccgacactggtccggtcggtgtagaggctcggtggtggcggcggcgggcttggtgggggtcatcgttgaggaggcggcggtggtccgaatggaggaccgaggaggttcggtggcggcggccgtgggctcagcgtcggttgcgacggcggcaggcttggcgagggaggatgacggcgttggcggcgggctcggtggcggcggcgccgggcatggtggagggcgtcgccggtcggtggaggtggcgccgggcttggtggaggcggcaggctcggtggtggcggcggcgggctcggtggcggtctcggtggtggtggcggcgagggagacgacggcaaagtaggagttggcggcggcactagggttctaaggaggcgggaaactgtagcgggacattgaaaaatgttcgatccgatctgagaaaccctagttatagtagagtgatgagtcatctcaatcgggctttgccgtagggcccgtcacagatgactcatcggtgacgggttccatactaatgcccgattgagatgacattcaggcccatcacggatgacttatctgtgacgggccctaagataatgcccgatagagatagattaatctctatcgggcttgaactaaggcccgtcaccgatgactatttttctatttttccagataagtctttatatttgtgagtacaaaatatatagctgctatataataatttattttattagtcataatacattttcagatagtaaatgatttcaaatcgaaatatggtcaataacaaaattgtagtggttatcaagatctacaacttttattttggtcacttgtctatataactttgtttccaacagcttgaaattgactttgacaatatgataaatctaaacagtatttgtaaatactaaatgatttcaaatggaaatatggtcaaaaacaaagttgatcctctcatcaggatctacatcttttattttggtcatttgtctatataactttgtttccaacagcttgaaattgattttgacaatatgacaaatctatacaacatttgtaaatactacatgatttcaaatggaaatatggtcaataacaaagttgatcctctcatcaagatctacaacttttattttggtcacttcttcatccgacaaagtgatagttatactatttacaataatcacattt

SEQ ID NO: 81053 - DNA, 10603 bp, Oryza sativa
  unsure (1)..(10603): unsure at all n locations
gatctgacccttcactatcagatactctgccgccatggcttacgaggtgctgggtcaactgtcgtgcacctcggaaggtatttcctctttgacgtctaggaatagttatccctgctggaggccattcggtgctggtaatagtcatcttatgtacttcttcttcagttcgcatcggtgcttttctcttctgattcttactcttcttgcctttggcttgcttagtacgtgaccccatgtggtacgaaaggctaggaggaaagcaattctcgggattcaatggattctctccattgggctctctactttgcacactaggctgcaagcttgacttgctgcgaggaggctggtttagcgatgtctgccctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacataccgattttggtcttgacttccaaccaatggtagctgtgaactaagcagcatgcttggaatggaccaagggtgtgcccttgttaactctcttgaggccagtggtggattgagttggaaacttaagttactggaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgggaaaattgccttttcccgaacgctagtgtattaattcccgtcccaggaaaagccggggtacaccacacaaacatgatataaaagacacatctttattatatcgataatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaagattgagcaagaataagtacaaccacagtactcagcaagccacaccggagatgcataattattgcaagggagtacaaggggataataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccacggtatacggacggaagacatgacatagtttccaacccatcctagccataaacaagagtaccgacccaaccccacctacggccggaacccccgggacaggtaggcaggactgagcccctaacagcaggacaccggccctgtgccatgacatctcgactaccgggccgcagctcgtgtagccttcatttgccctagagatgtccatcgactccgacttcgtccatctccatccgtgtacttttgtttataaccagactgagccacaaactaagccttacccgctagacatgtggaagtacggtagtgctttgcaacagaggcccgaagaccgatccttatatggccgaggtgctactatcaaaaccatgcaccctgagccttgcctaaaaccattttgagggttttgaatagagggggaggtgtgaatccaattccacaataatccaaccattccatagtgtcaaggtgataagagtattcccaaagtctagagttgtaaaaccacctaatgttgcctaattaacgagcgaagcatctacctaaaatcataccagtggtaccatgagtagagtgtccactagttggggttttttttaatctagggtgaataaggtaataatatcaataacaataataataaggttataacaaaggttaataggcatggctaaataaaacagtgataacgcgggagtttaaataaagcgataatgcaataatttaaatcaaaataattttataaacaaggattcaatatgtacaaggacgatgtgacttgccttgctcgctttcccaaacgtcggcttcaacctccacgaagagcggatattccgaagctgcagcgtctacacgaccaacggaaaataatagggcttttactctaataaactccatataacaagtaggaacaaagcacaaaaatgggttcttgacttcttaaggaaaaattagagacttgaacggtccaattccgagttcaaatggccaagttatggccatttgaaatttatatgctctttaaatgaatatttgcgaatttcttcatttaaattttaatttaaaaagtgtttattgcgtcagccgaggggagggggcgcgcggaccgggtccacgggagtggggcctacgcggcagcctcacggtccacggtggaccgggcgcacccgggctcacaccggccggcgtcgttggccccacgcatcagccgcacccgagggcgcgggcggctgacggccgggccccacgcgggagccactcggcgcgcccgagggcagccatgccggtgcggtcggcgggaggcagcgcgtccgcgccccgatggtcgccgccggcgaccaccggcacggcggagcggcggccaagagaggggagggaagggggaaaggaggcgacggtacacacccccggggcgacgacggcgacggaggaggcggccggagcggagggaggcggtggcgcggctcgggtcgatggggacggcggcgctccggcggtcggcgaccgaaacggaggggtggacgaggtcggcgaggatgcggcgaagccgaaggaggcggcgccgaggtgggaggcggctcggggcgacggcggcggcggaccggagctcggcggcgacggcggagaaagagagcgacgtcgcgagcttgaatccggcgaggaggaagggcggcgagaggcggaaacggacggaggaggtgcggggagggtttaaatagggttggaagggggagagagcggccggaggggaaggaaatcggcgcgggaggtccagccgccatcaatggcgccggcgagatttgcgggggcaaatccgcccgtttgaacgcaagagagagatggaaaaatggggggaaagggagagggaatcacggggaatgattccccccactttattgcacgcggggacggcgggaggcggcgggatccgcggcggcggcggtgctagggcacgggggaaggaggcgggagcggcgggaggaaggggatgacgggtgggccccacccgtcagcgagggtggcgggcgggcccgcccgtcancggcgcgcgcgcgaggagaggccgagagggccgcggggagaggagagagggagaggggggagaggagagatgggccgggccggccgaagggagggaagggggacttttagggtttttctttttataaaactttttcaactttgtttatttcttaataattattatttgtgctctgaaaattccactaaaacttatttacacattttaggcttttaggaaatatacaaaaatcctctaagccttgtttgacttttactttgcacattttaatttttggaggctttcacccggattttaattattctagccataatttaaaagaatatattttagggtcgttttgggacgtgacagtggacaacacatgtaatcattgtttcttcttatccgatcctcctccgcggcgttcatataatttattacgccctttctgtacttcgtagaatgacgtttcaaatttttcgcatacatccaacttcgatcaattgctacaaaataaaaaaacaaattagaggcacatattataagatcagtattgcaaaagtaagacgtgatgaaattgttcaattaatgattaatattactcacttgattgatccattttgatcacttttgggaatttaatttctgttttcattggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccgtcaaaaaaaagtgtcatctatgacgggcactaaacttatctcaatcgggcctctagttagagcccgtcacagatgaccctcatctgtgacgggcttcttttagggcccgattcagatatggaaccctcatctcaatcgggcctcaactatagcccgtcacagataagtgtcatccgtgacgggctttagttttatgccgatataccatggctgtgcgaccatatctcaatcgggtgaaacttcagcccgattgagattactttcttgtgtcggcccgcaaattccagtcttgttatgggccgtcacagatggaaagatctgtactagtgctataagatctggaattggatagtcccggcgctagttttcctttcctgcttgtcgagttcttgtttaaggtttggctcagcttcatggtgtttgtctggcctctatgattgctataagcggtttgttgcttcacagacctgcttcggtgagtttcttaggttaccttatgttttgatgctctgtatggctagatggagtcctcaacatgactttttttataccctctcgatattacatggcatccttcctcaatgtcctacgtgaatggcagtatttttctatgctttgctgaaacaaaattatcatcacttttcaacaatcatcatcgaccatagagcattttatttgccctagaaagaatctagattctggtctccaatgccctctgtggcccgatttgcttataccacttttggatgagcatatctcagttgctttaatttcggtttgcttgttataagccatgtgagtgttcttccaagaggagttgaaaattgaatcgaaacaactatgaattcttatcgacttatcctattatactttatagaagataatattgtttagtagaagaaatcactacatatataatggtatatcatggaggggtgagctcacaacaactttagcctgaggccaccccaatttgccgacaagaaacatatataggctttggaactattgggaagtttcaaagcttttagcactgttctatttagtagacggtagtatatttccacgtagaaaattgtgtgtggccaaaggctattctgcaagcaaacctttgtaaaaacgaatgctaagcatgctgctctgttatctcttgaaggtgaaaactgcaccccatgcttcttggtctcttggatgccttctctaacttgccatgcatagacagattacctgcaaccagttgtacaacattattgcatggataccataatctcagggcatcagtcacacacgcacatatcaacattggaaagaaagctgcaaaaacatttgaactgagttgtctcatagttgtgagttgtgactacccaaaacattagagacatgagacatcataatttaaatagatcgtggtcaaaatattgacaaccatcaagagaaatggggaggaaaagaaggtcaagtgtcaagtgtgcggatgaccggcgagtaacctatcactactggagaagtgatctttgcttggtcagccaaaaatcacattagtcctggttcgagtaggaacagagagtaaaaaatatctttagaaccggttttaaagcctaggggtacgggactaaatatcatttttagtcctggttcaatagctattaggtccccaacaaactttagttccggttggtatcaccaactgggactagagatcagatctttaatcccggttggtgattccgaccggggctaaatatctctctcccacatccgctctctctcttccttatcttctcctctacttatcatctcctcctcttctctctctatctaccttatcttctcctccactccttcccttcccctctcccctctccagcgggcaccctcctccactcctccctcttccagtgggcggcgtctatgttaacggtcattatcgatcagtttcgaccgtcaatattaccaaaatagagaactagtgatgcttgcaatgcatatatatgttagaataataatattccactagtattaagattactaaccttttacagagaatgacaataaagtggaggagaatcgacttcaacacaaacgataaatcaatcggacgatgtctagaatcagacttatgcatgaatgggccaagaactcagaattggtacgatgaattgggccaaaattcacaagtctatgtatgagagcaaaagaggaggctgcctgccgaaattgggccaggtcggcccagcccatggtttggccgaaccattgggttcggccgaaccccccgcagcgccgtttgatccaggtttctcctggacggctgagatgactccccaatgatggttggtgggtatttgttgacgtaacacgaggcctgggagatctgcttaactccagtgcaggtccaagactcgccttcgggtatgcaagcgtgccagttgatttgatcctgcaatcaacaagaaataaagacgaagaaactgcggttaaacctataaacgatagccgatcggctaggtgccgatgacatatcatttatctttgagccgatgtcatatgtaaattgatcggcagttataaatagataacaaagaactaaatctactcgatcggctgtaggtatcaacaatatatagttcttatatcgatatatacttaaatcaagtgattgggatagatcggtcaccatgccgagacagtataaatcacttaggtcgaagtatatattaataacgggactatatgtgtttataacatagccgatcagatagatctagcatgtatcggctaatactccgatacaactctatgttaagatattaaaacaagcagaatataccaaacgaaagcttaatatgcttagatgcgataatatctttacataaagggcagatttaacatgtcaacgaagtatatagagcaaatatagttaaatcagataaaatcggctgaaactccgacactaccctaattggcaaccaagaagcaggctagagattaatattctaagtacgacttaatagatcaaactcaactgatgcagcattaagtatgaaaagaagaacaatatctagacaatcaagccactggaagtttcatagagtggtagatatcctatataaactaaacaacgtcattgtctaacctaatcggctgccctcttccaacagatgttagccgattgtaggttagatagcgatattgccaaagattatgtaagatatatgataactcgacggattacataaacaagattagagtatcataaagatggaagcactaatcccgataacacaagccgtcataacaagttttacctcttgttgaagatcgaaactgatgcagctcaacccgaaaacaagaactcgtcgaaataaatctaaagcaaaagggtggcgatgcgccgaaattgtattgaacgtgtgtgttaattgattacatggggttcggggtctatttatacccgaaaattacaaactatgtccataccggacacgactcttatctctaaaaaactctaagataccataagtctttgcggcaaacttttgcccaaacatatctctaaggaaattacataaaatatcctaattaatagatacagttgccttctcagtactctatccatgtacagtaatcatcttgaagtacctcaattcaacccgatgtcaaacaccaagtcgtattgttggaatcgtattgtccgactcagacccagccgatcctaatcgtagccgatctagagtccagcagactcttgctctgttcacgaatcgatctccgccttcgaatccacttcaatctaatcttcttttccgatgccgaaattaccaaatttggttgttaacacatgccccccaagtccgaaatatttggtaatgtttcggatttgctatatatcaactccgagcaattctcgcactttgccgttttccgaccgttattcccgtgctttaaatactaaccgccaccctcgagaaatcttcaccccgttacttccgttttcaccgccgaagccaaccttctcctttctctctccggcgattccttcgacgctcaaggcgatccccaagcgatttcgtctccggttagatctccgcccgcagcgatgtcgtcttccgccagcccatctaccgcgccatcagcggagtacgctgaggtaagttctcatcggctagatcccttttcctcgcatgaaatcgatttcccccttcttcatcttgtttttttcttctcgattcctttggatttgcagcacctttcccatctagttgtggttcccagcctgtcacatgaaaaccactatttccttggtccaatcggcaatcttgaccccactaattttatcattggtgaaaccaacagaatcctttttagattagccaaccctaatctgggtcattggaagaatactttcaagttgtggccatctcttgagaaaaccacccctgagaagagttggaccacatcgtaccagtgcgtatcggctactaagaaagttcactgggatgagatttggatcagccaagtgcttgccctcaccatagctaattccaccaaggacaaacctctgatggctgctgccacctatttctggtcccacaccatcaatgccttcttgctcaaccaagggccgatgactccaaatttgatcgacattaccatgatcaccggtttagatgtaacctcatcggctaatcccatgagcatgaacaccaaaaatcagtttgattttagaaccaaaagcataggtggttggtctggctatgtagcagcatatatgggccaaggatccgttactcctcgagaacatgtagctttcttaccaagtggctagaaaaattcctcttctatggatccagctgtggccctacaaccaattggcaatttgtagccgaagctctagaatcagagaaacaatttcccttgggcaaaatcctccttggctatctataccaaacattgaacaatgcatcggccaagatagccgtcggctcagtagttggtgcaggtggaccatggtgtctgctgcaaacctggttgaacctgatggtcatgaaagttgtcaatcggccatctgtgacagaagctgagttcccattcccagagccgattgtaggagttgatggaaaagaacgcactcatcgcagatgcacatcatacggagaatatgcatcctcaccaaccgatcctggagcaaagctatcggctgagctactcaaggattggttctgcagcttctatgaaggctttcagaaagacgcccgggtttggttcccttatgaggactcagcagatcttgaacttccatcagactttagatttgaagatatcaatcacgaaaagtatcaaaaatccagggaagttcttacagctgcaatcagcccatgcatccttcctgtcggcattcatcagggaagaaatatccaagtttcttatgagttctaccacccaatgagctcagctagacaatttggactaggccaactcccaatcggcttattctttgccgacaagatctagtgccgaggagaaatcacatcaactctaatggtggatcgactacttaacctcccaggagcccctctgggcagcattgacaatattgagttggtaggatttaacagcagaaacttcaactgatggtggggtgaatggaagctgcacttgtttcatcaatcggcttcgatgtttatgacagatctattccctgatgtcataccccaggtaaatctcatcattattaacttgaatgttggtt

SEQ ID NO: 81054 - DNA, 11263 bp, Oryza sativa
gagcgcgagggggcgcggcagtggcgcgcgcgacagcggcgacgtgacggcgcgcggcggctcgaggcgcgaggcgcgcgcgggagggaagatgggacgggcgcgcggcggggcaggggcgcggggcaggaggcgacgatgtgacggcgacgacgatggcgcgcggggctcaaggcggcgacggcgacggcgcggcggcgacggcgacggctcgacggcgacggcgatggcgcgcggcgcggggcgcgagctggcgcgcggcagcggcgcgggcgacgacgatggcgacacgagcggcatcgggcaggagaaggaggagggctaggacggctaggaactaaatcgaacacctagggggctaatgaacagtgctagccggctatttaaccctattttagcctatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggttaagtttagttgtatagcaatatattttacacggataggttcaatctatttattctataaatagtaaattgagactcggcacaatattaatctaattatttaattaaaacctcacaaaattttataaagcttaatttaattatacgaccattatttcatgtgaattggtttagctttatatagaccattagagtttagtaatatcccattaattactcctagtgaaactatgtcatagatagagttccattataaatggtcatcatttcatgtgtatttagacgtcatgacacgcaacacatggttcacgtatttagtatttaatccataatttaaattagtaattaactttccatttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgcaaaagttttaaaaagttcaaaattttagtgatttttattgtctttgaattttcaggatgttacaggggtggcggtggaaaaggagctgaccttgttgcttgacaatctcattagaggaagctcgccggagggaggaagagggagctcggtagagagaggccttcgccatcgtcatcaccagaggagcaccgctccactgtgtgccttctttttcattggagggagctcaccggaggagggggcttgccgaaggatgtggagtgacctcgccggagggttgttgtcattgcagccgccgttgtcgctcgcggtcgagagaaaaaggaaggtgcgagacagagagagagagatagagagagagagagagagttgggctgggctgctgggcttgcccattagaccaacccactggtacgggggctatggccatgtgtcgcatctatgagatgtgctttgccaatgatctacacgatgagatcgagaatgatgataccacaaagtgtatcaggttgcatcggacattgggatgctcttgctcgagcggtcaactagtgatacgaggaagatgagtgacgtggcaatatcaagtccatttgaaagaaatgacggttatgattggctcaaactagaaaaatgcccatgcgttgtaacgggaaagtcattttttcagcgatacaacaactattagaagccgagcaataaattgaaatattgggatcaatatacattagaattgaaacatttaataaaaatcctaaaactgggattgctatacattacaattaaaaaagttaataagaattcatccttggttttggaccgaaaacccattcaatgtttccttttcagccctaagccaaacctttacctccctttgctcggcctgcctcccttccgcccatctcacaagtggagttgcaggtccaacttgcacagccgacaaccgtcttcaacctctcgaacatggtcccatgcccgtatgatgccaaagcagatcttccccatcaaatccggtcgaacatttctcgatctccaaaaattggttgagggcttttgatcccttcgatatcctctttccgttcttcccaaaatcagagtgtaaaacttgagataaaaacgatcgaggaagatcgcccatcgatcatcatcgcgactgttaaaatgaagattaaatccagtgaattaaaactgaatcgaaaggggaaatcatttagaaaatgatgagggacgaatggggaatcgatttttataatcaattggaggaggaaatgcacgattgacatgacggcggtgcggcactagggttcggcccgtggaaggcgcggggttcaacaaatcggatcggatctaaaaacagaaaacacccaaaaaccacacataattactaaaaattatcattaaaataaaattaaattccaataaaaagctttagagcgtgcgcacaaaagaaactctttcgcgtgtaaaaaaatgataggaaaaaataccggcgccataaaaaaaccgaacagacaaaaataaacataaagctttgcgtatttttttattaggtatatataaaaaccaagtaattagctgtttaattaaattaaatgtaaatgccttacagcttatggctggtgaaaatttcgaaatcgaaggacacgcataaggaatcatctatactaatataaaaaggaggagttgcaccctccaatcctacgtctccaatcctacgtgtgaaatcatccggatcaatcctaccgtccatccgcacacacgatttcactaccgcccgatttactgtcgcgaagactactctccatccacgcgcgattgcgcgaagacatcgctcctcctctctcgctcactcctcgctcctctgtactgtatccgaggtccccttccgccgccgccggatcctaccatccgccgtggccagctccatacgctgcggccggcgctcctcctcctcactccggattactgccgccacgcatcctcctctctccggattactgccgccgcatcctcgccggagccgcttcttctccgtccgccgccggagcaggtcccattccgccgccgttggatcctaccatccgtcgcggccggccccatccctcatgtgcgacgagccgtaatccgccgccgccttctccctcttctccaccgcttgccctaccccgccgctgccgcctcctcacgcgctcgcctcccctgtactcgcaccgcgggcgtgagaggccggagagacgaggtcgccgtcggccacctctaccgctgtcgccgccttctccctctctaccgctcgccctacctcgcctcctcgcgtactcgcgccgcgggtgtgagaggcagatcgccgtcggatgcctccaccgccgccttctccctataccccgtgctcctcaatcctctatagcaagtcctcgatccgcgcctcctcggatcctccgcggcaagccggcaatccccacacccctgccacttttgtcgccgtcgtcaacatcctctctgcccgagcccgaagcctcagatctacgctcatgccgccgccgtcattgtgtgactccctgccatggaattgtggccacgccacctcggcgctgttgtccataccctctccgcctgagcccgaagcccgggatacacgacctgaggtcagcgtgcacttctgcctctgtagccgagcctggcgtggtgctgactctgggagaagacatctagtgtagatggctcgacctcttgctgcggcctctgtccagtgcccgatgccaggtacccagcagccagcaacctgcggccggtatctttgcaccgtgcgactgattttgtacaactattggaaatctttacttttggttttggtttggtccggcatgattcaagatgtatgtttctgctctcattcttgtgtttatgtgttttggtgcagttgcaggctggaatgtggatcgaccacatcgtgatgattgggagcattcccaaggacagattggtattggtttcgaactccttggggttcaaatcatgttggtgatattccacgttgttattttgctttgtaatatagtatccagctggacatgttttggccagctatggaagaatacatcaaataaatatcaaatgctctctattttgtctgtacatggagtaagtggttcttttgatgcttcaatgattcattttgttaccttcaattttaaaaggaggaatgcctataagtaaaggcatcagattcaatcccaaagttggtccttttgcttcgaaaggtaactagcataatttcttccaaaggtaactagcataatttcttccaatcctttaactggaacattaatcttttctattcatgaactggatgcccatgagtcagtacttgggttgatacatacgtacatacatacatacaattgctgtaaatatagctttttatctgaatatatagtgaagtataaaatttcactatcctggtgatctttttactctacaattgctgtaaaagcctggacatcccacttttcaccgagtatttctgtacaattctgttggagagagtacaactgcaggtctaattctgtgtgctaaaaaggtagattttgatttaaccaaattttggcttgatctatgaatatatagtaaaataaaaggatcattttttttcttcaggaaagtaaggatgtaaaatcaaggaggccagctgttccattttgcttttgaacagctcacccaacttgcacttgatgcaacgattcgattttgctgctaaaagacatgttcaattgaatatattttcattctagagctgcaagtacatattcaattaaatgtcattttcttttcattttgctgctagaaagccaggttcaattgaataccctatctaatcaaattttctatttgttcagatgtctgtacctattaactccgaaatgaacatggtaggatggtttaggtttggagactattttttgttcaagacttcatgtacctattaacgtttgcagcaacaaccgtattttctgatttaggccaaaacaaccgtattttctgatttaaacagaaaagcttattttctttgatttaaacagagaacccagtaagaaatcatgcacatgcaaaattacaggccaaaatacccatattctcctatatatttaaatacaactagaaatattggcgcgctacgctgcgcccggttgacgttcccattgactttgaaggaatacccattataagtaatgggtccgacaaatgtctgaatgtcattcacccgaatcacatcgatcgcacaagaacataaacatgtttgcttcggcatgtaatggttgaagtaggatagaagaacttctacgaaatatctttacacaaagtggtgtctgaaatcaatgtcaacttgcaattacgttggtattagaattaggcagaattaactaatgtatggagagctcccatgtttggccatggccaggacaccataaaaacaaaaggtaaatatttgctctattatccttccaatcgtgccaatatcattcagcaaggcatcacctatcatacaattcgatagaacatataccggtgttaccacactaatagattgaggatagtatcaatggagaaaagggaaagatgcaatgcagtgactgattccgtaaagatgggtaaggtaaggtacatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaatggttaaattctttatttgtagtgcagtttggaataaactaatattaatatgaatatataatatggacatgtaactttataaagggttgaataaatatgtttcaggttataacagaatcctgaaatgcaataaaggtaactgagttttagtcaagcaaatatttagagtgaatttattttatttgaacactacaataaaaaatgtgtgtggtaagaaatatctacaactactgcttcaattggttgtgaccaaagcactgttgaagatgaattcagactttatgaattattgcatgtaaaggaattaagaccccattttatatgggcaaccaacgtatctgaagaatacggtacatgcaaattgcgggtttaagtaagtatgttctctgaagtgatgtactagttgtaagccttagttctggcaattaactgttaactgatcttgtcaagtaacaacaactttatagctaagttaatgaccatgtaggtaagcctaattacccacaagccatgtctaactgtactaatgcctatctttttactatttaggtcaaatgaaacacgccaattttggacatttgttatgagtccacatttttcctaccagcaggaaagaatgctgaaatgactgttgttgtttcatacagatgctgtaaaaaaagagtaagaaactataaccagaaatgtgataaattgacattaaagaatgctaagtataaccagaagaacatgagaacctaacactgttagatttgtgctgcagcagaacttgcttcagcgactgatacttgttgaatacatcaatgaggtttgacaaaaagaaattgcagttaggagcaactgcagagaaaaagcattgcagtcaacctaaaacttagtgccactgattgggataccacagttatagcgcgctcactggcaatgctctggccaatatgaaatgaagatgtaattatgagaaatcagttctgataaattgaaaattactttgtcaaatcctaaatcattgtacattgctctagaagaagaatgcacttctatgaacagttgctgaaggcgcttgtttgaatgaaacattgtgttgaatcctctcaaaagtgaaaatttttctctattatgttaatgtaagataataattgacctaagaaaaatggttaacttaaattaataagcaacggactaactgagctttcaacgcattatctccatcatggattaatgataaatagttcatttaaatgtgcccatcttgtagagaaaaaggataggcaaacaatcttgttatgaataagcacaaaccaaggacagtaatgagcatatacaaagaaaagcaattagaaaatctattatcttctacactgctattgggaagcaaaattcaatgtatatagtttagagtttacttaactttgtgcagaattggctacttgtgtagatcatgtgctcgagaagatggcgatctgagtctgtctgcatcctattttctctaacaaaaggaaatagtgtatgagaagctagaaccaaatgtattccatgccaaactaaacaatggagggggaagcagatctcactaaaagatatggctaattgagacagaaaaaagcaggaaacgcgaacacactatagaatcattgatttgaatattatacctgattaccagagcagttaccataccagaaaaggcaaggcagtgatgtattcagcagttacaactgcaattaagaataaaatcatgcacacacaaattagcatagtaaacatagaacattaaagataactaacaaagagatagaataggatgccaacaaaagtaggatgggtgagggtagcatacgaccaaaacagaacaaagacctaatcagcatggcacaagcagaagggagagaagccccactcgtactgacctatggtcctctcgcataatagcagccatggctgttgcttcacctcagattgtgaggctaggtccccgtgccgtgatgcagaccctggtcgtggctattggtcaaagatgcgaggatagcgtccaggaaggtacctaagggtggaggaggtgaggattaccatggtcaccaatggaagaaaggatttctagtgaggagggaggggaaaatcatatcagcggcacaccatattgtggattttggaggaggcgaaggctagatgagagaggtcggatggaaatagggattggagcgatgggatcggaggtaatctagaaggctttcattggatcaccttcgcagataaagtggaggccctagggcctcccgaccgagcacatgcggccgaccaaactgttgaggcaagtagctccgatgggaaggcaatgcgcagccgaacggtgaaggaaaccctggggaagaagaaaaaaaagggagaaatcactggattagactgctactcagcaggaagaaagaggaaaaagaaaggaggagaaatcgccggcgacctcaccaagaaaaccgaagaggagagaatggggagaggagggatgtgcgcagcagccgagaagagacttcaccaagcatcctccactaccacgtacggcggcaggagacggtggccaatccggcgtgcgctgtacacggcaagcggtgtttctagcgccgctccgtgtggaacagaagcacggaaacacggaaacagaacgtgggctgagcaatgagaaagggaaaagcccatgtgcaaggaagggccggcacaggaaaatggcccaatagaaacgcatctaatcctgtgctactaaaaccaattaaaacataatctaatatatcgctgcgcactatcgctgctaattgctaaatgcatatgcgcgttaattatccgaaccaaactgatgacgtggcgcccctaaccttccaaagatcccatggggtttaagtaatctaatataagccagttagaaaccatgaatatgcagtagtaatgtcatgtgataaattcgttgtgggggtaagaatgagtctttccaattggtaatttgtgacctttcacgaatcacgatggtttatattccaatctgctagaacatggtgccactcatatttttacatgatctgggttagaaaattttcccctttgtagttcaatatatgttgagtgcaacctaaatactttttattggaaacaacatggaagaacagttgtgcagatttataattacttcaggcacatatttgttttaatggtctgctggtgctgggtgtatgtattaattattattacctgatgcgtgtatattgttgacctacaggattaaaatttgcgtggactacaaaggcggtaagttcatcttaaccgcttatctctatagtgtgtatcatgctcacttgcagaggtgcttccataaggagcataatacttcagcatattaatgttttcaggctttgtcaattgctcttcctgttgctacacacttcaacagtgttttaatatggtcaatggtcatggctatgctactgttcggagtcacctatgtgattatgaggtttcataaagtttcataaattatttgtgattcaacgcaacaaggtatcgttgtcattaacaggaactcaacttttcctttcatttttgtagaacatcgtcatcttccaagggctataagcattaggaatcttctaaacatgattggtttgggcaaatgaaaaatacaaaattggactcagaggtattgcctccaaatagttgttactacttttaactaggtatgcaaaaccaagttatgaagtcttctaagctttcctgtatatatgttactgttgtgccaatttatgcttgttagggaatcttagaaaactaaactatgtagttatgcccaaatgcttgtagtgcctaatcagcttagatggtcatgtacttgatcttgaacatctacactttctcagacaaccaattttacttttttttttgctttttaatggttgacacaattagccattacggtaagcaatccatccatgatcccagagtgccttatcctttcccatgctatcatcctcgatttattctactgctaactgcccttcgacatgttattggtgatggacttgctatagaagtacattggtgatgaagtgatgaaccagggggctaaaatccaagttgtgatgtgacgatgaatcaacgatgggaattggacaagaacccaagcaggcaagtaggatatgaaagtgatgcaagtaattatgatagcaatcatgtccgatcaggcttctcaatataatccttttaggaaagggatgagattagcagcattttttttactcttttgattgagattttgctgccacaaacaacaattcctaatattgaattgtgccaccacatgctttggatgattctaaaggaatatttggccatgtttttttacacttaggaaaagagaaatattgtttcaaatggattatattgtattaactccatctaagaatataagggattttgcccatgtcatttgaagaaccgtgggataatagatccggcattaaggaatttatccttaaatttatctccatgatattctcgtgaacttctgcatcttgtctcacaaaatgaggttgtaatagacatctctcaattattttttaatctttctggcgtgttgaaatgaatgaattggaaaacatgaaagtgaaaatgaaactcaatttatccttttagatggaaacagaaacaaccaatttcacgtggctctcgagaatatattttgatacaattgagaaattttgcattgaaagaatgtaaattgtgaaaacgtgcattgcacgtgcacgattactagatatatcttgacaattgagaaattttgcattgaaagaatgtaaattgtgaaaacgtgcattgcacgtgcacgattactagtagtggtaagtggcagactgcctgatttggtggcagcagtttgacagtgggtgctttttatttggcgggtactccagctaaggccatgtttagtttctaaaacaaaaattttcatcttgtcacattaaatatttggacacatatataaagtattaaatatataaaaaaccaattatacagttcatcaggaaattgcaagacgaatcttttaagtctaattg

SEQ ID NO: 81055 - DNA, 725 bp, Oryza sativa
ggaaataccagtcggcggcggtcgaggcggccggtcggtgaagatgtagacgcccaacaatggcggtcataataggccagccgtgcaggcgaggacaccagtcggcggcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcataacgtttaagggctgcaggaat

SEQ ID NO: 81056 - DNA, 1968 bp, Oryza sativa
acgaaggaataaggggtaaacaataatcaaggcatggcataatcacaagtaggatgtttatcattgcatgcaattttatttgtaaacaaaacaatttcgcaattgggatcaacatgttcaaagaatagtgatgacttgccttgctcaggataatccttattattgatataatcttgatcaaccttcacctcctggaagttgcagacgttgcctcacgactaaccgatgcacaaggtctataatacgcaagaaaaaccaatattcaaataacaaccaaatatgcacaacaaaatatactattcatgtctactaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttatttatggaagctttactttaattatgaacatattttacttgtcacaataaattataaaaggttaataattatccatgctttgtatgttagagttgtttaggttaatcatattatggttacagattatcctatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaacttttaagtggtccaaatacaactagctctgtgattactctcctaaacaagttaaagattcatctatgtgtgtttatattttagttacaaaatatgaggctaaactttatgtaaacaatttataagtcatggatttagttatatttggacatagactagtaaatggcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatagtgaattatatatcattggaaagcttatgaatttagatgaatttaggttcaagtttcacttaaatccgagttaaaatgaataagttatgctagtgtaaagattcaaatttgaattaatccgagaaattgcgaaaagctactgttcataaacgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacccacatgtaatagacactactaataaagattaagaagagggttactattcaccaattacgtggggcccactaatctctcctctccttcctctctctttcttcttttctctctttctctccctcccggcttcttctccctcctctctccctcggctctctggcgacggcgaccgaacaaggggaggaggcgggcggcttactgac

SEQ ID NO: 81057 - DNA, 1233 bp, Oryza sativa
tgaagtcgggggtcgatggacattctccagggcaaatgaaggctacacgagctgcggcccggtagtcgagatgtcatatggcagagggttggtgccctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggccc

SEQ ID NO: 81058 - DNA, 8850 bp, Oryza sativa
aagccgatggaagtgaccccgagacgggaggaagtccggagtgacgacgcggcgaaccggaggtcgacggcgacggcggagagacaggtggacgtcgcgagcacgtatccgatggcgagagcaagcggcgaacggcggaaacggaggagggaggcacggggagcaaatatatagcgccgagagggggagagcgcggccggagagggaggaaacggccgcggagatctcggctccattgaagacgccggcgacgattgcgggattcaaatcggacgaatccgagggagagagagagggaaaagagggggaaacgggagagggaatcgcggggaatgattcccccctcattatggcgcgcggggacggcgggatgcggcggaatccgcggcggcggcggcgctagggcacgggcgagcggcggacgcggcgcgaggagggagatgacaggtgggtcccacccgtcagcgagagtggcgggcgggcccgcctgtcagcggcgcgcgcgcgcgggggagccgatgggccggaggggaagagagagagagggaggggctgggccgagccggcccaagaaggaagagggggggaaaaaagacttttagggatttttctttttataaaccttttcaactttgtttatttcttctcaattattatttgtgctctgaaaattccactaaaatttatttacacattttaggcttttaggaaatatacaaaaatcctccaagcctcatttgacttttatctttgcacattttaattgttggaggctttcacatgaattttaattattctcggcacaattttgaggatgaattttagagtcgttttgggacgcgacaacggtcccaggatatcgagcccccagacagcaaatggccatgaaagtggtatgatctgcagggcctgggccggttgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgaacacgcacttatcagggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatcctctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggggtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttgaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttat

SEQ ID NO: 81059 - DNA, 4535 bp, Oryza sativa
tttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccaga

SEQ ID NO: 81060 - DNA, 2930 bp, Oryza sativa
taaaagtttgaccaaatcttgtccaaaatgtcaagttttgctggcctagcaaagaaatgtcattttttttatgactggagtggagggagtagtcattagtgaggacatgaactatttatgaccagagggagtagtcattaatggaaaagagcaaaacccataacaccatattcgcaattattactaccaagcaaaaattggttcttttaaagaacagaatcctctacacgatggaatgatgacatgacaagcaagcatgatatgctattttcacccagttggcactagcttcatcagtggctggcggtaacaaccagataaaagtgagactgccagatcagggaaaacagaactctgagcaagacagaattactaaagtggaaagtcccattttggttctccatcttcgcactctgttcctccctaaaaaaaccttattcaaaaccccaagcacctcccaaggtgacactaccatgtgggtctagccatctaggctccgcatatcaatgacagagaaaatcgagaggcttgtaccaattcttactgagcgtgcctttttaggacattgaaacagaggacccttttctgatcatacaaaaaagctggagccaaacttttcccttgctaaattcacacgcctaatttcctattctaggtagtcagttccacttctcaacctcgcaacacaaattcggcaattttttcctcattaaacgcaaacaaattcaggaatttcactggtataaaaacacacaagagacaatgttccgtcagtcacctaccttgaggaagcggcctctcttgttctccccaatatcgaagtagaacacctgcgcgcgagcgtgccgcgaccaaaatcagcaaacatagacagcgccaaaaaaaaaaagaaagaaaaaatcagcgggcggcggaatcaatcgcgaccttggtgtcgaggcggagctccttgctgaaggcgtcgcgctcgtcggtgcggatgtagtagtcgaagaggtcgaggaaccaggcgacgccggcgacggggacgatgatggtggagcgcgtggaggacgtcttctcggagatcttcaggtacctccccctcgggttctccttcagatcgaagtagaacagcttgtgctcgaactgcagcgtcttgctgacgagctccacgtcgcccccaacgccgcctccccctcctcctcctccccctcccgcgacaccgggccccgccatgacgcccccgcctcctcctcctcccccgccgccgcccatcgccgccgccgccgccgcgaactagggttttgagctagggtttgggtttaaactcgctctcaaactcgagtcgtcgagtcggggagaggtggggatgtgaggttgggaattgggattagatctcgcgaggtggagagggggtgtgggggtttacccttttggggattcctccacgtcactgacgggtggggccggggtcaggtggggcccggggttggtgggcgggggtagggaatcggtgggcggggggaagggggggtgctgaccgtgtgcggggggtggtggcgtggcgggatgtgattggtcgggcgaaggacgctgatatgaccggaaagggtaaggtttttgtactggtacgtgtgctgctacagttgcggtttgggggtagaaattgtttggacaatgacaatcgtgctattactggagtatagtccctttgtaaatttcagtttacgtaggatacgagtaaatggtttggacaataactgtcgtgttgttaccaagcatactcccttagcaaattataatttgtgtagactagaagtaaatgatttgaacaataaatgttgtgtcgttattgaggtactccctccgtttcataatataagggattttgaagggatatgagtatacgacacatcctatgacaacgaatctagataaactcctaaccagattcgtcgtcttagaatatgtcacatccctccaaaattccttatattatgggacggggggagtatactcttccgtcccccaagaaataaacctaagaaatagatttttttaacgactcgcaccagacagtgcgaaattcatattgataagtaggaaaaaaattataagattacaacactgggaggtcgtaattaggaaaacaaagaaaattataccaccacccacgcaccaacagcaccaacacacagaccctggagaaggctagcaccgaaccggccgccactaagccaacaaaggatgtacaaccgagattgtccaaaactcaaccctaacaactaacacagaagcctactctatccatgtctttgggattgagtgggagagggtgagagagaagaatggaaccgctctcccccctaggccctccaacatggccaacttgcataagctaaggcgccgatataagagaacaggaatctagagcaagcttgcaacgattgtttgggaggtttcgacaagggagctgcttagacgatgtctctagggagataacgacaaaagcaccgctgccgccgtccgtcaaggtcttcaaagagaacagtgactaggttttcacccggtagccccacaagagaggatgggatagcacgacaacaccctcaagaggaagtgacgctctgaacgcaatcgttgccagctcgaccaaggccggactaggttttcacccaccgtctgccgcttgccaatccatcgctgacacatcaatgctccactgttgtctaacctccgcggacatgtgggcaccgctgcaccgacgccccacgccggctatcctccgcgtgccgccaccctcgtcgcgtcgtgccgaccttcgctactgaccgcacctcgcaccgcgccgacctttgctgccgggccgcgcctcctcgcctttgtcggccgcacatcccacccgactgcagctcccgccgtcgttgtcgcgagctctgccgctgccg

SEQ ID NO: 81061 - DNA, 5162 bp, Oryza sativa
aaacacttaatatttatcttcatcttcatcttcagatgactcaaacaccaccttagggggggattgcaaattcatatttgacacaaaaattgacactatatatattcattcaccaatacctctctatgagtatcaatgctcacataatcttgttgagaacttgtacctgtataattgtaaaagatgagaatatgctttatttcagaaaaatcttgtcgagaacttgtacctatataattgtaaaagatgagaatatgcaatttttttcagaaagaagaacaagatttggatggagagccttcgctccaaacagtttttacgaagaaattatgagtgtgctaaagattgaacatgagatctcatagttaaaaccacacatttcgtaccactgcactgtctaatacatctcaatttgtttttttttccctttacttagtattaaccggtgtgagattgtttgggtagcatctctttcaatttggcttgcgttctccaagacgatattttaattccaaataaaatccagtatactactgcattaacgaatggtatggtcactaccgtcgagtgacgaactctctctcacgcttgtgttcaattcagccacgccacggcacaacgctggtccatttgtacaatgcgagaatcgcttgtttctttgtggacgatgttgctcgttggctagctacatgggtcgccattcgccaatgcgaatgtgcatgcccatccaaaaatccaaccaacatctacctaatctctgcagaccggtaaggagtgcatgtaaagcagtaacctacccaaggctagttcaaaccgtcgtccttttatatacaccaaattaaagaaatggcacgccatcagattgtgtataccctccgttccataaaaaaaaacaattctaacaatgtatatagatatatgtataattaaattcatagctagaattaatattttttttggacggagtagtatatatgaatatcaatcaaataaagtcaactttttcttatgtacatataaattcaggattaaaccatacaaccatacaagcatggttgattctactttctcaatactcgttgttgtttatgctacatatttgtcatcgatgactattctatccattactttcgtagatcagtaatagtataaacaacgatatatgagcctcacttatttgaaaaaaaagagtaaacagacaggagaaggttcagatgaaaagagaccctccgacgtgaaattagagagatgtagtcatggatatatgagccccatcgtttcccgggcctaaatgtactccttccgtcccataaaaaaacaacctgctaccggatgtgacacatactaagagtaggtacaatagcaaactataagccagctaatatacatattttaacgagataaaagaggagagataaaagcagcgggctacagatttgttgctagctgtagcacggactccaagacgcatgtgtgtatgacagatgggaccagatattgattgtgtagtatatgtttataggtaactattgtatgaatcggttattaagttaactatagatgatttggagtcaatagttggctacactattaaatttgctctaatactacaaatacatacatacatacatacatacatacatacatatatatatatatatacatatatatatatatatataaattcatagtacttagatgtagatttgttttttatgagacggaggaagtaagtggttactacctctatcttaaaatatagtaaggctgtgtttagatcaaggggtgaaaaattttgtcgtgtcacatcggatatacaaatacacatttgaagtattaaacgtatagtctaataacaaaacaaattatagaatccgcatgtaaattgcgaaatgaatttattaagcctaattaatatgtcattagcgtcaaatcattgatcaattaggcttaaaagattcgtctcgtaatttacctataatctgtgtaattagtgttttatattatctatatttaatattttatatatgtatccaaacaatgtgagaggttaaaagaagttatggaggatctaaacaggcccaaacaacccatcctacattttgggacggatggagtagtcggaggatttccggtccagaccaccacgtcagcggcgtgccgggtccacctacccgaacgcgcgcgagacgagaagaacatcggaagagtgggagaaggagaagagaacgatagaaaagaggagtactatcatcgaaacgaaagcgaagcggaaaaaaggccccgacgcagaaacagcatccgcaaacgtgcccccgtctatccactcccctcctccccttcccttccctttgtggaggccaggccaagcctcccctcccctccccgctcctcctacgcagcgccgcggcggcggcggtagaaggcggcggagctctccaccctcccctccgccgcggcggcggccgtgttcctctgcggtggagaggccccccctggtcgtttctccgcgccggctcggcatctctccggaggaggaggaggaggaggagggaggagtaaggtgtggggatggagatcgaccgggcggtgcgggggagcagcgaccgccgcctgcggaccaagtacgacaacgccgtctacgtcgtgcagcgagccttcgcgctctacccgtacgcgccccccccctcctccccccctcccctctcactagattcgtgtggtagcggtgatggtggtggtggtgtcttagctcgatgatgatcaacgcgatatttgttggggttgctgctttccgcgatcgggtcgggtttggtttggcgcgtgccccgtaacgagtgggttggtttggctggttcatccagctcggatggatttggggataaatgtggtaatcacagattggagagaggaatatcgacttgggggtttagatcccaaactgcaggtcgctgcagctgtttaatcccgatatgcattctaaatttgtgtgtccttaccaacagaaaattcatccctatttgcctgttcgatttcttaatcccctttgtgcaatggtgtatgctgttatagtttctgaacatcaactagtagcaattttttaggacggtctagactatttggattggctgccgcaacaatcgtctagtctcgatcgattggatttcggctggattgctctgtcgaactgtattttcagttgattcggaccacggattaaagtacctgtgtcttgaatgctgtccaggatacaacgggagtaggtacattgttttcgttgttggctagtcaggttgtatcggctgttcttatgccagttctgatgagctaaatatttatacatccattttgtgagttgtaaactgtttccttttttagtcaacacttaacttaaaatcgagtttctttggatgagaaaggagattctaaatcaaactacatccatacggggagtgaaaacccatgatgcttgtttgtcacgtcatcttaaaccagggaaaggtccatccagtgtttccacatttcctttgcagaggaatacatctgcaaattttgagctaaataatctgagtctgtgatgaaagtatgtgcctgcatgctttaaagtagcttccaaaattacatgcatcgattcataaactttcaattttagtttcagtttctatatctcaagcggctcagaatatgtaattcgagtgaaaatgcaacactgcctaccaatttcttgaggatgtcgagtgtttgaaatcacatagttggagtcaaatttttaccttttctcctaactatactatcaggcacatttatcatgccaactgggttgtgtgactgctatgtttttagcttgtaagtatgatggtgtacatgttctgatccaaatcttcatgctgttccaatgcagagtatattttggtaaggtcataatgacatttctgtaggacactaaagattttttcagtgaatgatgaattataattctaatcatgcaaacttcttgaataactggaatgtgggatgtccagttgtgttgaacatgatataagtaatggctggtggggagtttaaatatcattgcagtgcacggggacttagtcttctttgaaaacttcaaccagttatacctggattatgtgaataaggcacaaggcagatgttccccaaatgcatattgacagttctttttggcaccctatcctttaatttccctatttagtttttttaaatggttctgcacttgtccaggatggatattcaatagagggtggggttggtttgaatgctctcattttatatatacattgaatacaggaacatcctaaatctcattctcagaaatttcattttccaggtttgaggaagttgccttcagctttaatggtgggaaggattcaacagtaatatctttataatctctcttgcttgtcatttttcttctgtatgttaagtgacggttttttctattagcaagtttaacaagatatgaatgctatatatcaataggttctgttgcatttacttcgggctggctactacctccacaaatcaagctctgatggtgaagtcgaaatgaatactatccaaaactgtcctgtgcgcaccatctattttgagagcccttgtgctttccctgaaatcaactcattcacttatgaaactgtctcaacgtaagaaatcactaagattcgttgtctttgtttatttgctaaccttgagaagttaaatgaaatattctttgtcctccgttctccacagttatggtttgccactggaaactatccgctcggattttaagtctggcctagaaggcctattgaaagagaggcctactaaagcaatttttattggtactagaattggcgatccaaatgcagtaattttcttgttcccttgtttagttgctcttcaaatctcgatagacttgttatgtccaatcctcatgcccatagacctttcacttattgatgtccctagactcccgataaacctattacttactacagtttgggattataggttggtcaagagcagttctcgcctagttcacctggctggcctcctttcatgagggtcaatcctatattggactggtcatacaggttttcctcctgatcatgtaaatcaatcaaaaggtgcctcctagtctgctaatattcatgtgctaa

SEQ ID NO: 81062 - DNA, 7051 bp, Oryza sativa
  unsure (1)..(7051): unsure at all n locations
atttccttgtgcctgccattgatatgacttatgaggctgtcagggtcactgttcatatgtaagcagggtatgccacaatgttcatatgcaagcatccattcctaattacaaagaggaaaaggaggaaaaagaaaaaggtgtaccatattattgacttcaagtaacagggtttcctgtacttcatcaggatatatctcataagtcatatcagctgaaaatgttgaaaataatagttttttcctgtaaatatggatagtctgggaaaatgccacaatcatgcagtataatttttgtccctatactgcatataggtgtgacacaaacaacaaacgaaatgaatatggtctatcattttgtagaacccaatattgaaggtttacccctttcaaggatctaaattaaaagatagccctttaatctcaaaaaaagggaaagaagatcctgcaatcattaacttgtgaattgcttgtgttgtccctgaactttaggataatacaggtttaattcgcttttatatatccgtgcacatttataaactttgcatttattgaattaaactattatttattgtttatgtgcatccagcctctccattaaatcagaccctgatggtggcattgagattgaagatctggtagcagttactgtgaatagttttcaagaagtgaaaagattgtatgaaatggggacccgtcttagatcaacagcttccactatggcaaattctacttcaagcagatctcactggtaaatttttattttattgaagaaaagatttcttatatatatctatacaattagaatatcaactatgattgcacctgactgaaagaggattcaatcaaaagttagagagcaaatgttcacagaaacatcttgagtgaataaaatggttgtttttaaattgagaaccatggaataatcactttcctgaaactctgtactttatttgttcatttatgcaacagtttgattcgcatctcattgacttccttgaatgcaactgagagaagaaaagcaacaagtaaattgtggatgattgatctaggtgggagtgaaagacttgtaaagacaaaagcaactgggaaaaggctcaaggaagggaaagccataaatttgtcgttgtcagccctaggcgatgtgattgacgcactacagactaaaaaaccccatgtcccttacaggtaaatgaaactcataatgcacaagtgtatggaaattggtacatggctgccatttcatcagaaaaatatgacaaaacactaacatgtcgcccttccaaatttgcagaaatagtaagcttacacaagtactgagagattctctaggtaaagtagttcatcagtaactatttcaaaagggataacaacatatgtagttgaattattttacacatatttttacagcttaccttgacatattcatgtttaattgttgacaggatgtgaatccaaaacattgatgcttgtccatatcagcccagatgagggtgatttgtgtgagacaatttgcaccttgggttttgcaacaagagtgagaagtattcgcctggaaagtgaagaaccaccagtaagattttgctcttaccattatgatgagtgtatatgcaataactaccagatggctattttattcatttattcattaaaaatagcataaaccaaacattaattaaggtaataagacagttaatgctctcacatttcaatttgcaaagggacaacttcgaaaacaagatcatttttatgaaaaagttgagctctgtgtgatcagccaaaattaaagaatgctcggtttgtatttttacaaaacatgatattggcattcatgcacacataaaaatanacttttatgtgaatttttataaagtcgactaatgagtacacaacatgttttgatctcaaacaggagatgaaagcaaggaaggaaacattattaatagatttaggacagaaggtcaatgatttggaacatgaatgtgaagatattagaagaaaaattaagaatctcgaggagagtatggagcatttgacaggacctcagccaactatttactctaattttgacatgtcacatctatccagtgaagaactgaaaacagatgtatcaagtaatgtgaggaattcaaagaatcgcagagaagcctcttccaggttaccaaggttcatgaagccaactgcttctagccagcacaggataggcttaaataatcgcactcccattattaacaggctaaaaccaccagtaccaccaaggaggcggccttcctcagtttatgctgagtctgtaatggtcccagtaaatgctgccccttggcaatcagaatgcagctccgaatgcagtatgtccttaacaagtgacatgaattggacaccaagcatacgagatggaactgaatgtagccaggatgcatcagaatacgagattaaacaggtgattttctcagaacatgagaaatcatcgcatgatcaagtgacctgctacacagattatccacttgcagaatctagagatatacagattaaaatcgaagagaagggaattgtagacattgacaattggctccaccaacaaatcgttgagaagactagcacatttcgaagcaaaatggtgcttgatattcccggagtaactgaagctgaaatccatgtttctagtattccttcaccaactactatggcatgcactaaagaagatagccaggtaaaggatgaagtaatgggcctacccttcaatcctcaacagactatgtcgaggatataaagcaaagcaagactgataatcaattcacagcaaaagaattatgcactccaccatttaaagaatttagcagcaacaatgaagtgaagggacataaaaacgaacatcctgtgtaccatgggagacccagaaggtcactacaggaagaactggaaaattgcacgctagagaagccaaacatggactcaaaatctcacaggtcacatgatgataaacacaaaacaggtaatgttctgtcttacaccggagaatgagcatctacgagaatttaaattttcctggaaaaaagccactatgcatcccagtatcatctggatttattgaagttgctcctaaatttgaagccacggtaagagaatgcttagcaacaaaacattttagaatatgcctatatagatgcagaaaagttcatgacaccagaattgcacatggaacaacatgaataaattgtatccacataaatctagttgtacttggcaaacaaccacaaatgatccaaatacttataatcacatttttgcaatatctaagacagaaaactccatcatgcaatggtgttcagcctttctgaaaagttactctttggtgtatattagacccaaaaaaactccacaaatcagccatgtagcagacattgtgaaacagcatgtttatgcatgaaagagaaccttaaaatgtaggtagaccttgcaatttactgtaattgttgttagatataggtagtaaatgtaaaatctacaggaaatctttccaaaaaaataatcaaataacgatttttctgtagaatttattcctagagcgaaaatagaataaatattgaaagtaaacttcagtagataaatttttgagagaaaaaacttcagtacatagaaactgaagtttctaaattgacttccacaatgacatgaatatctgtaatttttagctaaatatctcagtaaagcatgtcatgcaaaatttctctgttttggtactatcattttgaacagaatgcacaactagcatacaaatactatcatttatccacttgggatttccgcctgtctacaatctacacatagttcttgttcaataagctatattaccggtttatacttcactgcagggaagttcacaaagttctttcaagctcttcaaacagcatggattggtgctcttctagcactgggaactgtaagcattggattagagcatggcttctttcagagtttgacactctaaagtacctagaatctcatcactttgagatatagtattgaattttaagagaaactactacaggaagtaatgctctcggtgtatattgtaccacgagcacacaatgaaatatgtccagccagtaccacaattgcaggtgaactgttgattgatgctaaaagagctcctttgatttctgatgaattctttcagaaagccaaaaaaattggggtatttgagtaagaatgaaggaatgatcatacaagaaaattggcatcattcaatcatacagtaactgttagtttgttacagtaattagtattgcactgccctaactctgacaaagaattgttttatagttctaaagcatttcagcttatttgcctctgtacacacctaaaataagttaagtgtctcagtaaagcagcaacttaaatcagaatgctagagtatttgtttgagataagttgaaaagggaatggcctatctattctacatacattgctaaaggagaagtctgatgaaacaaccggtcggtcaatatcaagaaaagaaaaaaaaaacttctgtttagatgttgcccgtacctttaactgaagaagaaaggcttggccaacttttatcctataagaagactaaatctcacatcaaacaactagtcaatcaagaatctactcttgagtttcaaccttgtgctgttgtgcatgcaatgagttggcgaaaaactactcctttaaaacattctctaaattatcagctatgttcacttatcacacaaggcaaatatgtttctttctgagtgtaccaaagtatgttgtcctccttcaatacaaacaagtgcttcgtagaatatgagcataatcattggaatctgttttaccatcaaggcattaaggcatagtgatcacttttgttttgctggaaacaatgattcagtatgaagcattgcatcaggtatcttctgtatcagtctgagtctgactggaaggatggggtttaacctctaggagaacttgtaaaccatgccatcaatcttaacaaaacttcaattgtgcacacttggcatgtgatggaacaatgctcacactagatgatgttcatctcacccttcttcaacatcatgcaaactttcagggagcagcgcaatatgaccgacggattttatgttactgttaattgcacatagaacttcacgtatcttatgcaaggaaggatgagagccatctctggaagtgaactcatgaaccatgccatcaacatcaatagaacttgcccctggcacatttcttaatcctctatctctcattgatattcgaagttctctcacagcatcccacctctcctgttctgcgtatatattagataggagaatataattcccactgttgtgaggttcgagctcaattagatgcaacaaggcttgttctccaagctctgtatcaccgtgagtacgagcagcagcaagaagagctccccatattgctgcatttgccttgaaaggcatatcctgaattaaaccacgagcttccatcaaacaacctgcacggccaagtagatcaatcatgcacccgtagtgctcaactcgtggcttaatcttgtactgagacaccatagttttgaagtaccagcggcccaaatcagtcagtccaacatggctacataccgataggactgcaagaaaagtgatatcatttggtgacacattctctttctccatccggcgaaataactccacagcttccaaaccaaggccgtgcaatgcaaatccagcaatcatcgttgtccaagtgacaatactcttctgctccatgccctcaaacacttccaacgctttcttaacactcccacatttgacgtacatgtcgatgatcgcattcatcagcggtatctcctggcataaaccccgtcgcagcacaaacctgtgcacccactctcccaaatcaaccacaccaagatctccacacgccgagagcaccgacagcaacgccaccccatccggttcgatcccctccacctgcatcctccgaaacacctcgatcgcctcctccggttgcttcatctgcgcgtaggccccgatcaccatcgtccacgacaccacgttcctccccggcataacatcgaacagctcgcgcgcacgggccaggtccccggacttcacgtatccatcgatcatgacgttccatgaaacgacgtccgcggaggcggccgtctcgtcgaacaccctccgcgcggaggcgacgctcccgcaggagcagtacgcctggacgaggctggccgaggcgtgcgggtcggcggcgtggcccgcgcggacgagcagggaatgcagctgcgcggcgagccctcccccgccccggccgcggagccgcgcggcggccctgagggacacggaggggtggacgcggcggacgagcgcggccgcgtggtcgcggagcgggaggcggagggaggcgaggaggagcgcggaggcgacgcgcgcgtggcggtggccgccgcgggggaggaggtaggcgtgggcctggaggaggtggcgcggggaggcgaggcgcgggagcagggagagcacccggtggagatccgggggcagagatggcggcggcggcggcggcggcggcatgcgctccgcggtggccggcggcggtgggcggttgggttcgatggagctcgtgcgatcgtgggggcgcgcggtttcacgcgcttccctttcttctcgctgtttgggcctatgggcttcagaaagatcaacgcggtattgggctggaagcctgttgtgagtacagtgttgggctgaatggttgatgtgccgagatctgtttcggcacgggctcgtacatagattaggccctattgggaggtaggagtagtttttttttttcagaaaatgatttaattcgtttagtacggcaccgcctccttttcaaaatgtatgatgccgttgacttttttcacaatgtttgactattcgccttattcaaaagtttaatgtaaatattgaaaagtataagttaaggttatattttattcgatgataaaacaagtcatcacaaaataaatgatatttatataaattttttgaataagacgaatgcttaaacgc

SEQ ID NO: 81063 - DNA, 15069 bp, Oryza sativa
cctgcagccctgcagtgtgtatgacaggtgggaccatatattagtactagagtaagcaactattgtatgaattggctattagattgaatataggtgaattggagctagtagtgggctatactattgaacttgctctaacgaaaccatctttgatcggttgcccaaaatccacaataatcccggtttgaataggaaccgggactaaagaatatctttagtcccggttaaaagacgtgacggcactttttgttaccaaccgggactaaaaatgatctttagtctcggtttaaaagaaggcaggctatgtcagacccctccactatccttagtcctggttggtgttaccaaccgagactaaagatttattattaaacaaccgggacaaaaaatcagcgaaactgcccgtgcacgcgtcccgcctcatccttcctgcccccaaccttatctcttctctcttctcctccttctcacccctcattccttttatctcttctcctccttccccatctcctcctccttctcctcctctcctctcactcctctcctcctcctcattctctctccctcccctctggctcccctctggcgggccgcggctcatggcatacggcaggaggcgacggcggtcacccctccaccggatccaggaggggagacggccgggcggcggcggtggaggccagcgcagagggctgtccctggcggcggcaagcgcgaagggcggtggccgactgcaaggcggcgcatggccgggcggcggtggcccgatgcaagacggcgctcgaccgggtggcggccgggcagaagcgaccggcgagtgtgatttttttttaaattttgtgaattatttgtagtgaatgatttgtatattttgtttgagatttttttttgatttggggatgattttgtgattgatttgtggattgtggatgtgtatgtattgtggatgatttgtgtggatttgggtgggggaatagatacaagcataaaaaaacaataaaagaaaagaaaaaaaaccgggacgtggcccatatctatcttaagtcgatgtatttttagtcccggttattttatccggtactaaagatgcacatctttagtcccggatttgtactctcggttacaaaaccgaaaatacatggggttacaaactaggggtaaagaccatttctccactagtgtaaattgctcatataaaaactttgtatacataagtttttttaaaataaaattatattaactttaagtttaaattaattaatatatatggtaataactcatctcgtttcactgagcagatttgcccaaacaccacttagaactaagtcttatacattatactctactccaacagtcgagacatagctttaatacactaaaaaaagtttaagcaccaatgttttcttatttctcttctcctttgtgtctgcaaatttaccttcttatacccggaaaaattcactactacctccatcccatattacttgtcgcttcaagtttttttaatgtttaatcattcgtcttattaaaaaattattatttattttatttgtaacttgttttattatcaaatatactttaagtacttatcttttttatatttacactaattttgtgaataaaaccgaatggttaaatattgtaagaaaaagttgaagcgacgagtaacaggaaacggaggcattagtagtgattgtacatgcactcgagaatggaatcatatagactgcctctgatggattattgccttttctggtttagacaaatctggccgaaaccaaaaggagcacggatgtgactgcaatcatgcaagccatctcgatcggtggtcgtgccatgttctcaactcaatcatgtgcttacaccgtactccctctctcttacaaaatttaaaagattttaactctacaagatactcccttcgtcttgaaatataattatttttagttatgaatctagataactatgtgtctatatttatagctaaaagttactatattttatgacgaaggtaatatattttaggactgtgaatttgaatatgctctctattcatattagtaatactactccctccatcctataatataagttattttttttaaccattcgacttattcaaaaaaaattggaattattatttattttatttgtgacttactttactatccaaagtactttaagcacaactttttgtttttatatttgtacaaattttttaaataagataagtggacaaacagtacaagcaaaaaagtcaaaatcccttatattatggaacggaggaagtataaaatatcacatccaatcaaaatatctttaaataccactacaaatcaaattttgtaacaattatataacaaatcgtgctccaatgaacgaaccaaccggatagccaagctatccagctagccaagaaacccacaaattttaaacaatcattggagtttatcaccacatcatcgtcctagctcggccttgtcaggccgagccaaggatttcagtcccccatcattgcccccgtcaccagcttagaggtgggagggcggcggcagtgatggcaagtgggaagatggggagagccggagatagccgagaggtgttgccatatagggccaaggaaatttgaaaaatagagaggaaggttaagcacatgataaatataggccttatttagattcaaaaattttcggcaaaaaacgacacatcaaatatttagacacatgcatggagtattaaatgtgagaaaaaatcaattcaacaatttgcatgtaaagcgagatgaatcttttgagcataattacaacatgatttgacaatatgatgctacaataaatatttgttaataccggattaattaggcttaataattcgtctctcaattcacaagcggaatctgtaatttgttttgttattagtctacgtttaatacttaaaatgtgtgtccgtatacttcaaaaactttatacccaaagaactaaacggaatctttttaatagctcaccaaatgtaaatagcagagagtaagactgttagagatgttttaatgttactatctccgtcccaaaatataatatattttagctatgaatctgggcacacagatgtctatattcatagtttaaaatacttacattttaggacggagagagtacatgttcaactcagatattctcatacctcttggtcttgttttgaactgatgcactcaacaacacctcaacttataaatactcatcttataaaatgacaatagctcaacatattaatccagaaaagcaaaaagggtaattaagtactacatacggttcgagaccactgtactaaaaccggaagccggaactgctgttggccctctgcacaaatggatgttttatggagaagtggagaagagttgcccaaactgaattgagtttgtgactgagttcttgttgtttcgttgctgactttcagtgatgctggccatatttccgttcctgacctgagcactgctttccacttatttagctgaaagctgtctgaaagctgtggtatgttcgaagtaggtttcaggcgagttttaatccaaactttttcttcaaattttttacttttcacttttctacacacacaaacttctaatttttccgtcacatcgttttaatttcaactaaactttcaattttagcgtgaaacacaccagtttctttcaaatcaaatttagtccaatatgatacaatttctttcaaatcaaatttagtccaatatgatacaagctcttgtagttcatatttttttatttaaactttcaacttttccattacatcaaaactttctacacacaaacttttaacttttttcaataaacttttaattttagtaacttctaattttaacgtggaactaaacacaccccaatataaggaatttggacaaattattctctttgacgtcatgtttttcaatgtttcactggtttttgtgaaggatcagagtttttcaatatttcactggtttttgtcaaggatcagaccacaacgaaagccacatggttaaaatcttcgcgtcgtcactacgtcatactaatatttactctccagtttgttccctgagagcctgagtgacatcatacttgcctcttttttttggttgcatctggataattttccggacaactgtcaaaactcattaaattccatgagccctgtttgtcaacagcaaaataataataataataataataataataataataataataataaattttaaagaaaaactgccgctgaatcgactacgccaggaggatctcgaaacgaaataaacaaagaaggcaaaaagaaaaaacggaggtgaaataaaaaaaattcgaaaatgtgcggcgaatcacgcgagaagcgaacagggcgaagaagcgcccgcctgctggtaggaagcgtggatagccggcgaaggtttagctctcgcacaccaaggttaggcacccgggtattcaggatcaagaacccggggactctttacatgtgcgttgttgtaaaaaaaattcaaattcaaatccaaattcatagcgcagccattgctcggttcagagaagaaaaacgggaaacagttgaatcgagacgacgcaagaaagcagcaagcaacgcatcaagtcaaatgaaaatatattggattaaacacttatggttgggaagaacacctatcaggatcacaaaccgaatccaaatccggaggaggaggggccttgagcgccgcaacgaagagcgaaggtgaagacggcatgagaggtgagagctattggtagggtttgggtggggatttatagagggaggaatcaacgacagccgtccgatcgagttcttgggctgttttatggcgatcgtacggtgtccgtctcttccacgggcggtccagctgttgcgagggtttcgcaagggcccaaagcccaagcccatgggaatcgcatttggtcccttatctaagattagtttaaatcgtaccctctcttaaccttagtttgttcactttgctatcattttcaaacttaccaagttttggtattgccaaattttgataagattgctaagggcctatttactttgatgcaaaaaaaatcttaccaaattttggcagaatttcttatatagttaccaaaatttagcagcaaactaaatgtagccacttttttagcaactttactaaaacttagtaaggttaaaaatggcattaaagtgaacagaccctaaaattttggtaaggttgccaaattttggcaagattttatatgtacttactaaaatttagcaacaaactaaatatagccactttttttggtaactttgccccaaaaaagataatattgaaaatggtagcaaagtgaacaaacccttgaaacctgttacaatgcaatatctcatctcctaaaaggctaaaaccagttccaggacggtttggatttccaaaatccaaatgcctcacattctcacttggtaaggttgaaaatgacatcaaagtgaacaggccctaaaattttggcaagattttatatgtacttactaaaaaaatatagccacttttttttgtaactttgccaaaaaaagataatattgaaaatggtagcaaagtgaacaaacccttgaaacctgtaacaatgcaatatctcatctcctaaaaggcttaaaaccagttccaggaaccagtcccaggacggtttggataaatccaaatgcctcacattctctggagagacgcatgcacagtttcacacacaccttattaggcatacctctaagctctgaaaccggtatctttcggtgctataaaaccaaaaacgttaactttcaatgctatataaccaattttcccaaatttataagcctgaaaaattgcattggtttaaaacttcaagttttatgaaaagaaacaaaataattcatctaaatgccatcatagctctctagcttcaataaatcttggattttaaattgtgccatgaccttggtccttggttttggtcacccatacggtatctcaaatgcactacaattatataatgcttatacgacatactgaaactacaattatatacgaaaatgcacttttgaatattggtctacacgtacaaattacgattggaccaacaaaatggcccaatcctcagctcgtgtgattgcacagtttcttctttctacgcacattttcttagctgagctaggaccaaagatactactccctcagtttcacaatgtaagtcattctagcattttccacattcatattgatgctatcaatagatagattcattaacatcaatatgaatgtgggtaatgctaaaatgactaacattgtgaaacggatggagtagtaaaatagcgtcgtttcagcatttcttcaaaaaaaaaacaaaaaaaggtgctatggcactcgagcctcatcgcaaaaatgcaactgagccaaacaaaatgcgcctttcttgcaaagctccgggggatgctgacagttcagggaaaattaacctctcttctcctgaccccctgagctacgatgatactgcttactcggcgatcctaaccttcttgttcttcttcttggatttctccacaggcgtctgaggaacctccgaggtcgtgccgctgtcgccaccacgaacctgggatccttcggccgacttgcccgatacattcgagtgccccaaactgctctcatcctttctcttctgattgtgcttgtgcgcgggctcggcactctgttggcccagcgattgcgctgagccttggctgctgcggttcttcgacccgctagtgaaccgagacctcgtcttctttgaagaacctggaagaccggacaaattcagatcagtgagagcaactactgtttaccaaagtgttctgtttatgatagaaaaagagaaaacacttcagctgttggctggaaacctttattaattgaaagtgcataccttaaccaacagaaatagaaactacagagatgagcttagtatttctctctcagaacagttcttccatcttataatacaagagcatgcattgcatcattggcatgagtcttcaataatatatatcaggaatttggctaatgtcaactttcaatggtgcccaaaaatcttaagacaaatagtatgttcatcacctcattactgtcaatgtgaaaagattgaacagtaatatgcacttacaaagttaaatctggtgatactggatttctagttaaaacaggaggctaaacctacacaagtctaagttattgactagttcaaatggaatggcatatcatgcttgtcaagtctatataatacattcaccatagacagcagaagagtggcatcattataaaaagatgcctgagaaaatgtactcacctgcagatttcttactgctaggagtgagactccccaaacctggcttctccagttcttcagggtcaggataacgaactaagctaactcgacgtgcaatcttcccaactggaatttttttaggattaaaagaacaatatgcatacagtaagttaaaagaacaatattagctgcctcccaggaaaggaagaaatgatagatgtgttctaccgattgtgctatcaagcacgaccaaaatcacaaaatcaaataggtcaacaaacagctcaatttaacaagaccgataacaagtaaaaacaacatccatgcaaaatagtaaaatactgcagaaataaactgcaaagttggtatttcagcataccagcttttgcttctggtccggatggaaggaaaacagttgcatctggttgctgagcagcaaagctgacaagatcataagacttccctgccaaattaagtataacaagtacagctcaaacttttgggagaactttaaaatttaaattgttattgccacaataatttaaaagcgacgaactgacgatcttaaccaagaaaaagaagttagaaaacctagtagcctactgctagtagtcttactgatgaatgttatcattctagcttcaaatcacggattattatacgaggaagctgagagcagatttcacttcaccaatcaaacttctgaacatacactaaacataaaaacttctatatgtaaactaaattatagcaccttaattccatttgttcatttgttgcctaaagatctgcaaaacactactagtcatcaatgaaccagcattgacttcatcttcatacaaaaatgagaggcaagcttgaccatagaaatggaagcagttccattgataggattaacattgtttgggattagtaatgagaagtctaggtgcccactttgggaaaaactaatcaataaggtcaaagtgtgattgcatgagcaaatacaggttgcatccaatccgactgtacagaaagctgaaaaaccttcaaaagacataatcgatcaggtgcaacatagttcatcgaatatatcttacccgaggaactctccaaactgctcaattttccatcacggtgcaacttaagagtaagttcttgaccatgaaaatcagacgcatctaactgcatgcaacacagaaaaacgttaaattcgagatcccttgtgcagcatgccacctggcacataatgaaaataatatccgcataacctgatttagaggccactgtattagccaaagttccgttgactctgtttgtgatatgtcaagcatagcctcttcgctgttctcctcaaatgctggtccaggctcatagctacaatggttggttgcagcaaagttaaaaataaattacagacaatgcaaaaacttaccaacaagtgtataattgaaacaaaatgagctactgaattcaatccaaaaatccacaactataattttccaacctctcttatctcatatttgaggcataactgttaatctgttattcagagaggaatcagaactaccaaatccacaaattcgatataccattaaaagttgcaaatccacctaataagtttcgttctgaacaaatattgcatagctttactgtagataaatgcaatgctcaaacaaaagcattcctgcttttaaaattgttattcagatgtggctttgactatcaaacacgttctcctattgtgccccttcgcaactgctgtgtgggacgaagtgagatcaactttcccgattagtttatgcagggacgaactaacaagtatgagacagtggatttcagatttcatgaagaggagttagtgcctccaaaacacagtgttagcagtcaccctttgggacatttgggaggcgaggaatgattcaaggaacaagtcctcctccttgcatctgcgtaaagtgggacagaagacagtggcatatgtcaacatgattgtgcagcactgctacaaggtgacgatctgtccgagaagactaaccgctaaatgtcttagcctgctatttaaaacgctgctgcccaggcaattttcctcatcaacgtcattcgagatgtaattcttggagtgtatccgggatgtcctctgtacagatgctacttacttaatcaatgaagtgccatggttcatctcaaaataagcacgatactgctacacgcctacactgcgtcagaaaatgagaaaaaaaaaacgaacaaacctcctcatcgtggtcggcgaggcgacgtttttttttttttttgaggagcggtgtcgccggagagccggagtaggatcagaggtggagaggcgaggcgactcaaagccgagtcggcgagggcaccggccaccggccaccgcccgcgccgcgccgctgcgccgagagcaaaagcgagcccgcgaagatgagctggcgacggcgagcagcggctggactccggaatccgggtcagggaggcgtgcggcggcgaaggccacgaggtggcgtggcgccggcgtgcagcggcgacggccaacggcgcgcttgtgtgtgggtggcggctggggattgggacttgggaggacagggagtgagaaggtagcaatggggggggcttaggttttcttaagtgggccaagcccatcgcaacttgcaaatgggctaggcagcttacgtaggtgggaaaaagtacactgaaggtctctcaacttgtcatcgggataccaaaaacatcctcgaaccgcaaaaccagatatacggggtcccttaactatacaaaacaggtcacctgagatccttgggtgtttttgaccccggttttggtctacgtggcggctgagtcaacgtgggacccacgtgggccccacatgtcagctggccacgtcaccaccctctcccctcctctccctttctcctctctctctctcactcctctcttatcttctctgggcgactgggcgagcacggctgcggagaggcggcgtcggcgggcgagagcggtgtggcgtcggcgggagagagcggtggcggtgcggcggcggcggcggcggcggcggcgggcgagcgcggctgcggatggggagaggcggcgccgacaagtccgcgccacccggccttgtcatcggcggcggctccgggcgcgagggatgaggacgcgggcctcgtcggcggcgttggcggcgagggtggcacgggagaggccggcgcgagggcacggagtaggaggaggcagataggacaggagcgagggcatatggggaggaaggcgccgtccgtggtttgctgttgcttccctttcaccgttgccgagctcgtcgtcctcgcggtcgtctgcgtccctgccgcgctctgccacctcgccgtccgaggtggccaccgccgccgcgtctgctctgcgaagcagaaggagatgggcgagctcctcaccctggacgtcacctccccgaggtcgctggccgctgcggccgccaaggccaggaaggtggaggtcgagttcccggccacgcccatggccgaacacctcggggaggcggaggtggcgcgatggaagtcgggactgcaggcggcgctgcactgggtggcacgcttgctctccagcgccggggaagacgcccggcccgccgccgacctccgcgtgctgctccccgtcctcgcttgcccgctctcccccgtgcccatcctcccccgcctcccccgccatgtacgttctttatcgtgttctctgcctcgcaaactcgcctcaattctttccatcccattccaacgaaagggaagaaatcaagatagccggaaacacacaactgaggggaacaaaatcaaagaaagaagagaaaattcgatcatagcacaggaaaaaacctggtaccaaaaaatagcacaacaaatttttcacttcgactaaaagcacatggcatcaattttcttgcgattcatagcacttccgtcacatttgccatccaaacatgtgagttgacatgaaaaaagacacatttgcccttcttccccgacctagcgctcttctcccttggtgatgttgccgcgcccgtgtcgccgacgcttggtgagctgacggagccgcgcttccctcccacccgcccgctcagccgctcccgatcggcacccgccaccatgcctcccaccgttgctcgcgccagatccgccacgccgccgaacgattcgcgcgtgtggggtggagcaccggccagatccgcacgggaggaaggcggtggaggaggaggtggagacgccgcgcttccggcctgccggctcctggccgcctattcgttagcggcgtcgccgcccaaggtcacggagccgacaaagcccgcagtccgcccactcacgaatcatcccaacatccgccagcgcgcgccacagccccgctgcaggtcatcgtccccgtcgctgtcatcgtcgtcattgtcacgtggaagtagtggcaagccagcgcgctgcggcaccgtggcgagggagaggttgttctggcgccgagtacggcaactacgggccacatccatccatgccgaagctagggccgcccacgtcatcgtcgtcgtcctcgtcgtcaagctgccgccggcgcgggaggcttgccctcgatcaacagcgccgagtgccagacagggtccacctcaccgtcggcggtgacggcgagccggtctccaggcaagccgatggctgccgcgctgccattcacgagggagcgaaagaggagccctgttggggaatgtggggaacgaagggcaaatgtgtccgacaaaaaatttctccacactgatctaacaccgttacttcaaaatgtgacagaagtgctatagggcgaagaaaaatcggtggcctatgctatggatcgaaagtggaaactttttgtgctattttttggtaccgctttctttcctgtgctatggatcgaattttctcaagaaagaaagggtcaaaaattttatccccaaagcgacgagacgactcgcttccgccctctcagtcgaggaatccagtgcggcacaggacggcgttgcggacgtggtggaggtcgcagcccttgagcatcctcccggcgccctccagcaccgagctgtgcgccgcggcgcgccgcgcgacaaccttgtgcggcgagacgaccatggcggcgtccccatcctcgccgccgacggaggactgcgtcgcccacctccccctcctcctcaccgtcgccgccgcctccgaaggtatcctcacgtgcggctggcgatgctgtaggagcccaccgtcggtgacaacctcaccgtcccgctccgctgcgcctgccccttgctgccgcaggtcgccgtggtggtggccgcggcgcttgacatggcctgcccaagaggagagaagtgagagagggagagagaggaggaagggagagagatgaagtggacacctaacatgtggggcccacgtgggttccactctgactcagccgtcacgtagaccaaaaccggagtcaaaaccaccgaagaacctcgggtgaccggttttgtacagttaagggaccccgcatatctgttttgcggttcgaggacgttttttatcccgatgacaagttgagggacctttgatatactttttccacgtaggtgtggtaatgggtcagggcccatagaacgttttttcgcaactcttaaatgtttggaaaaagtacaccagagatcccgtcacttaattacaaaatcatcctttaaccacaaaaacaggtacaatccatcccctaacttataaaaccagtgcaaacaaggtccctcggcagtattgttactggttttgattggcatggcatctatgtggctcctttgactatgtttttatctcatgtggtattaatgtgacgtttacgtggcaatttgataaaaataaaataaaaatgtgagacccatgtgtcagttatactagaaaatgattaaaaaaatgatggccccatgtgagactcacatgtcatcttcattctctcctccctcctctcttcttcctctcttctcgccacacaacatcggcacgctcgtcgtcggcttatttcacgattaagccaaacgatggggccgtaaatgtccaaaccacctttacatttataacgacacgcatattagggaaacacctaatatcaaataactagaaggggtgaagcttcgaactcaggtcatctagcccaccacattgtggagctagccgaaaaacccctgggcgtttctccgcctttacatttatcattaaaaatataaaaaaagacaaaaggattgacccaaccccaacgttattgtatccgtgctgtctttatttttttcatttgttttatttttctttcttttcttctttgttcttttattttttaaaaaaataatggtatatctaagggtagattggacatttaacggcttgctgatgtggcttgctaatgtattgtttcctgtgggttcaaggactagccgtgtgacaattttttaaaaatgttatggactagattggcctcaaagggaaaacttcagagactgttttgactattctcctttgcaaattatactttccattgtccattgttcaggttcgaggaaattgctttcagcttcaacggtggcaaatattcaactgtaaacacctttacatttccttctacctattgtttcaattatttagcatatatagttagttccaaattccaaccaacaagatgacaacgttttggtgagaatcaccttaccgtttgggaagattaaaattttaagaagcaaccagtaagaatccagctagtgagaatttggaaaatttaggtttttcagtttttggcttgtcattttctagaataggaatctaagtgagaatattaactgtttaaaagagcttaagattttaggagaagttgtggaggttaaaaattcctcaaatatggccatagaagccttcccaaagaagaagcctaccaaagcaatttttaggcactagaaacggcgatccgaatgcggtgagtcccttgattgattcttttgcagtagtgcaatttgaggttggtcaaaaacaattcccctgtctgtccttctctcaagagggtgaatccattcctgaattggtcttgcaggattgtctcctgatcatgcgagtcaatcggactttcattctcttttcagaggagccaattctaatgctttgctgtgacaatgatgtactgcacggtcaagtactgcagccttttatgattttcaatagtcacacctttttggtagacgttaggtttaggcccggtttagtcccaacaacttttccaaaaaacatcacattgaatctttgctttgcgtctcttgataaaaaaaatcacattgaatctttggatacatatatgaagcattaaatatagataaaaaactaattgcacagtttgcatgtaaatcgcgagacgaattttttgagtctaattagggcacccacaatggttatctataggctctctaccagagatccatgtcagcatattttcctacatagaagatattaaatgaagagagagagcaaaactatctaccaacttagagatagtctatagagaaaaacgagacaatgcatgagagagctatagatacccatgtagacatactattgaggtggtttactattaatctagtctattgctgagatgtacatgttttatagagagcaccttactttaccattgcgggtgctcttaggtcatgattagccataagtgctacagtaacccacatgtgctaatgacgg

SEQ ID NO: 81064 - DNA, 2316 bp, Oryza sativa
tcgcttgtacagaggagtggttcctggagcaagatctatccggaactcaatctctcgcttgggcggcataccaggtagttcttccggaaacacgtctccgaactccctgactatggggatttctgacagtcctatctgatgaagttctgaacttctgacagaggctgggggtgcaaagaaaacaaccggttgttccggccctcggtacagagtgacagtgcgtctcgcgcaaaccactactccttggaattgagccaaccaattcatcccaaggatcacatccaacttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacgaccccgaatgacgtccttgccaccgttgttggagcggggaggcgcttggccttgctgacgccttggcttcgggcatttatccgcaaagtgcccgggctcaaagcagttgaagcacagacgctgctgaccttgagcgtccctgtggccttgaccaggctgcacggctggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttgagggccacgactccggcgagcacatgggttctccggaaagcggcggtgaagcgagcccatgtaataggctgtccctctggctgcgtagcttggaagtggtcccaccatagagatgcgggtccctgcagctggtgggcggcgaagatgactttctcttcatcactgcactgcacagtgtccagcttcttccccacggcatgcaaccaatccaacgcatccacggggttgttggagctagagaaggtaggtgggcggatgcggaggaactcggcgagtttagagtgttggggaggtggaggtggagcattctgttgtggcggattttggaggtggtggaggaaagtagtcatcatgttggcttgctgggcgaggatttgggtgagaatggcgttggtgtctggtggtggtggcggaggcggaggaggaggtggaggtgggttgccctggtggttgtggttgctgccttcaggttgattgccatcaccggtaacagcatttctcctggtcgtcaccatctgaaaaccccacacagaaccagcaaacagagagagagaagctaacaattaaaactaaccacccacgactaccataattcttaaatttattactgctattaaattggttcattaaagttcaagttgcttaggcaaataaaataagacaggctccgacacagttatgccacacaccggcataaccatgccccacacgactcaacaagaagacaaacgaggaagaacacacgcgcaagcctactaactgctcgtctactgctgcgacgggccagggcggaaggtgagcaacagcgcatcctccgtgctaccaacgccggaggcttccccctcctggggaaccacgggcgcgggctcggcacgaggggtctcgacgaagcaggtccacgccagggactgacgaacaagctcaggcctggaggtgctcttgcgggcggtgatcttctggctgcggcagacgcggcgacgcttggggcggcagacctctccctgggcgatcttgagctgatgcagctgcgcctccaccgcgtcgaggtccttcttgagctgcaggttctcctgccgcagctccaggatcttcatgttgttctcgaccatacc

SEQ ID NO: 81065 - DNA, 2778 bp, Oryza sativa
cttttcttaagagccacgactccagcgggcacatgggttctccggaaagcggcggtgaagcgagcccaagtaatcggctgtccctctggctgcgtagcctggaagtggtcccaccagagagatgcgggtccctgcagctgatgggcggcgaagacgactttctcctcatcgctgcactgcaccgtgtctaactttttccccacggcatgcaaccaatccaaagcatccacggggttgttggagctggagaaggtaggtgggcggatgcggaggaactcggcgagtttagagtgttggggaggtggtggtggagcattctgttgtggcgggttttggaggtggtggaggaaagcggtcatcatgttggcttgctgggcgaggatttgggtgagaatggcgttggtgtctggtggtggtggcggaggcggaggaggaggtggaggtgggttgccctggtggttgtggttgctgccttcaggttggttgccatcaccggtagcagcatttctcctggtcgtcaccatctgaaaaccccacacagaaccagcaaacagagaaggagctaacaattaaaactatccacccacgactaccattattcttaaatttatcactgctattaaattggttcattaatgttcaagttgcttaggcaaataaaataagacaggctccgacatagttacaccacacaccggcataaccatgccccacacgactccaaaaaagacaaacgagaaagaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacggacaagctcaggcctggaggtgctcttgcgggcggtgatcttctggctgcggcagacacggcgacgcttggggcggcagatctctccctgggcgatcttgagctgatgcagctgcgcctccactgcgtcgaggtccttcttgagctgcaggttctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtaatccactccatgtggataccccaagaccacgcacatgccccgcagctccaagacgaagccagtcatgtgcaaaccacgacgggtgacgctgccggccatctacaaacaaaaacaaaaagaaaacaacatttaaaagatcagattttggcgataaatgaagcagcaaggcagagagagactagacaattttcacaaataaccaaagatttttatttttgaaaatatagctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagctgatacaattcagagtttaacaagcggaagcgtaaatagaattattacacgggcagcgaaggcccagcacacaaagacaaacgaaaaacagcggaagactagggcgacgaccacaggcgcttgacagcaggcacgagctagacaccaaagccttcatcttcaaggaactcctcttctggacttgggaaaaattgagcaagactgagtacatccaccgtactcaacaagacacacccacaaatgcagaataaatgcaagggagtacaagggaattataatataaagggttagggttgcagtaaacagcatttaaagacatttagttgctcaaggctattttgtaaacgcgatcctagcactaaacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcgggttttaagaattaaaacactaacttgggtacattgctcggcttgcccataaccgagggcgcggctattcgaatagattaaactctgatcagaggtgtacatctttacccacaagacacgtctttctcacgtgtaaccacgtgccacataccaccacggtatacagacggaagacgtgacatagtttccaacccatcctagccatagacaagagtaccgacccaatcccgcctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataactagactg

SEQ ID NO: 81066 - DNA, 2493 bp, Oryza sativa
ggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcgcgcggggaggccgatgggccgcgggggaggagagagagagagggagggagaagtgggccgagccggcccaagagggaaggggggggggaaaaagaacttcttttaggattttctttttttttataaaccttttccactttgtttatttcttttcaattattatttgtgctctgaaaattccactaaaatttgtttaagcattttaggcttttaggaaatatacaaaaatcctccaagcctcatttgacttttacatttgcacattttaattgttggaggctttcacatgaattttaattattctttgcacaatttcgaggatagattttagagtcgatttgggacgcgacacaagctaacacaacgatctaagacaacgacttaacaagtcattctagttcttccgagcataggaggtcgattgaaggctcgttcggctcatcttcctcatctttgatagctacccactcaaacttggaattgttgcgcttgggttcttcttcttcatcactacttatgatgatgaccggaggatttgctggggcaacttctttctccaccacgcggacctttggcgccaattgatagcgagggacaaacaaagctctcttccttgcggtaagacgaatcctagccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcggccaactgatcactgtagcgatcacgaagctctcctatggcaatccttgccacctcctgacatgcatggatgtagtttcttcctccagcttcaaacatcactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccttcaactccaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttagggctgcag

SEQ ID NO: 81067 - DNA, 10204 bp, Oryza sativa
cccaccgtcttggcctcgtcgaccatggagatggtctcgcgcatgagtgggacggaggggagctgccgcgacgcgggcgggcgggcgtcggggctcagggagaacctgtccttggatgcggcgacggcgcccagctcgcgcctgagggacctcagcctgtgcgccatggcgaacgagcgcggcgtgaggccgccgcacacggagcagtcgcccccgccctcgccgcggcggaggtcggtgtggcaggcgtcgaggaagtcgtcgatgtcgtgggcgacgtccctgagcctgcggagccagtcgcggacggcggcgtcggcgagcacggcgcggatggtggcgaactgggcctccatggccgcgaggtccgccctgaaggtacagaggagcgcgagctcgtcccagacggaggagccgaacttggtcagcacctgcctcacgatggtcgaggcgagagcaccctccgccatggctgcgcgctagagtgtctctctctctctctctctctctctcacaactcgctcaaatcacaatggattggaaagtcaaattgggtggacgaagctaacgctgtggagtagctaataatcattcggggaatggcgcctgcctaattccatttcgctctaaataatactccaacaagtattttttttcttaacatccttataaataatatactatatctgtttcatattataactcgttttgacttttttctatgccttcgtacttttaaatttaactaagtttatagcaatgtttttttaacataagacaaacataacatcaaaatatatctaatgatacatttatatatttttatcataaacttaataaaatttaaagaaatttaacttaaaaggtcaaaacaacttatattacagtataatataatgaaacaaggggagtagtactactcgctagagtgtctctctctttctcacaactcgctcaaatcacaatgcattggaaagtcaaattgggtggacgaagctaacgctgtggagtagctaataatcatgagatatttaactattcattgcgggaatggcgcctgcctaattccatctctctaaataatactcctcctctttttcttcctaaacttccctgaaaataatatactacctccgtcccatccctttgagtttttttaatgtttgattatttatcttattaaaaaatagaactattatttattttgtttgtgatttgctttattatcaaacatactttaagtatgacttatcatgttttatatttgcactaatttttcaaacaaaacgaatggtcaaacgttgcaaacaaaaaatcaaaacatctattataggatggaggtagtactcgataactcgttttgactttttttcatgtcttagtacctttgaaatttaacaactttatatgaaaaaatagcaatgttttttttaacataagataaacataacatcaaaatatatctaatggtatatttagtgaggttaatttggtgatgcagatgttgttatatttttttcataaacttaataaaacttaaagaatttaacgacttataatataatgaaacgaggagagagtactgctcctactctacatacaaaataggaagtgcttttataaatatatacatcgttttttttcttaagaaatgcattggtttttaattatatggaagattcgatggagatggagaccggccacaaatgatttggctcactaaactgctattgaaagataactaattatatggaagactcgacggagatggagaccggccataactcatttggctcactaaactgctattgaaagataactcacggccgggcgagaaatgattcattgtgtcgacgtttgatgtctcgactacggtatttggatagtatggggatcgccgatgctaggatatacgcgagactgaggtaaaagagatagagacaaggatttttatacaggttcgggcccctgagttgtcaggtaataactctacatcctgttagccgaagccggtattgctcttattcaccataatcacaccagtacaatatgtgggtagcctatctaagtgttgtcgacatatcggtctgaaggtctgactcgtagtcgacaacagggtagtcttcctcctcgaatccgtgctcggcgagatcagagatagcgctttcgtatctcctgacggtatccggaaacaccataggggaatagccatgcctatccctgaaatcgatatccggcggcgtgtcttggcgcatgtaggcttgtatgttgtggtagcctatctaagtgttgtcgacatatcggtctgaaggtctgacttgtagtcgacaacagggtagtcttcctcctcgaatccgtgctcggcgagatcagagatagcgctttcgtatctcctgacggtatccggacaccgtaggggaatagccatgcctatccctgaaatcgatatccggcggcgtgtcttggcgtatgtaggcttgtatgttgtggcttctggtgggcgtgtgttgattgtcatgggtgtcttccatggtcgttctcctctctcctcctagggggtcttgtatttatacccatatgtgtccccttatccaagtagaactagagaaatcaatatggatacaatccaagtagtccttgtcgtttccatgtagaactctggttgtctttccttattcggaactcccacctatatccgtaggttgtttccgtataggacatagtatgtggtgggtcctgccgagatttagtcaactactattaggtatgtggtatccataaccatgacacattggtataccacatcaccggagctttcgcttattggttccaattttttaagtgtagtcaactactccttaagtatgtaataatgcaactaacgtgacagtacagtcatccaaaaaataatgaaaaaaatagtgggattcatctgtcggttccctttctttctttcttaaacctcgtttcccttccatctctctttctctacccctaaggccccaacaggagagggaggaggtggcaggcggccaactaactagaggagaaagagggcggtggtggacctcgggcgtgaaaggcgtagtacgacctccgaacagatgtggcggaggcaccgcggccatctcctggccttcagctctaagctcttcgatcgggcaaccacctctcagacggcggcacgaccaacaagcgagggcgagtaagggaacaacgacgacgatggggagctagatgccaagaggcattctgcgagcccattcttcgtcgatgtggcattggtatgttttccttgtggtcaatggtcgatcttgctgagaagatgtccattggctcaacatatgttggaatgatcttaaacatgtccgtcatggtcaggaacgcgaccacagcttggttgctgccaccattgacgttgagtgcagccatcaaacacttggcgtgcgtctctttggaacagtccgtggtatcgatgcagggtgtgtgggccttgtcctcaccatatcccagctccaaggtgaccgtaggaataggtaccttattggtgtggcttgagctcgctgccatgcgtgcacaaccatcattgaagcttgccgtcgagcacttggttggcatcataggcagcgatgtcttgggtgttggaggatgccgccttaaggtcagtggtggctgccttggtggcatccgctgtctcctaggaaagccttcccccttagagcttcgatatcttcaaacttctctaatgcccgatcaagcttatcctccatcttgcacctggcatctatccattcctcaagaaacagccttagtgcttcatccctgaatattttctcctctttcatcacaggcataacatcttccttgtacacttcgaacgggcatgacattcaatcaaacatgtggtgagcgctgctctgaagaacagtactactccccatgcctaatcctttctccctcgcgctgttgagtgatacaggtgttcctcctctcttccatgctaagacaccacgaatccaacagccagattattagcaaccttcttcactcaaaacaagcagtagcaactagcaagacatacaagcttctgattgtagaaagtataaaccctcttcactcaacaagtagcagcaaagagacacaagctcctgtttggtaccgagaaaattaaggaagacgaaggagtggctcaaagtgtactaaacttggtaggaagaaggggaaggagagagagagatcgacaagggtccattgccggttcggtcgacctgttcgattacctggaagtgcaacatttttttttcttttgtctctctcccttcagcttgcttgggctgatatttaggtgagctattgaattggccccatagtgcagcttacttgggccctaacatgtatatgatgtcacaactcgaattgagatcatacacacctgtgaacgacgggtggatgattttttttccaaagaagggtttttttttttatcatgcctctacatccaactaaatatatgtagtatttttaaatcatgaacttagctctcaaacaacccaatctaaaattcgcttttataaagatttgaattcagtagcttgggtgctaacgaccggtggatgacattcgaccgaatatatcatacgtaggcacatgagacgtacgttcctctcatgtgatcccaattgctgcgccacctccacctccacatcacattcactcgactcatgcgtcgacgccgcacgatccccatcccgttttaaaccctatcacgagcgcccgcgccaacctcctccgatccacgtacacgcgtacacgcctaattaagcttatatacttttctccaaccaaacctgacatggcgtcgatcgatcccctcttctatctcgattagtgtctacaccatgcggcgccgcagcggcatacgcagcttctgccacggcgtcgactccacgtcgaccacgatgcagcgccggctggtcggcgccgacgcggcgtcgtcgtctttcctcaccgtgccgacgtcgacggcgtcgtccgtgggcgtcgctgagagcgaggcggcggcggcggtgacgctggagcagatgatcctgcagcttgacctcgaggaggcggcggcgaggaaggcccagcagcagcagcagccgcggcgcgcgtcgtgcgtgaacagctcggacgggcgcgtgctccggtcggcgagggacgcgctcagccagtacccgcgcttctccctcgacggcggccgcgacgccatgtaccgcgcctccttcagcgaccaccaccactactactaccacgacgccgccctcgcctcctcctcctccggccaccggagatcgccgccgccgtgccgcgggatgccgccgacggtggccggcgagagcgtggtgtggtgcaagcccggtgtggtggccaagctcatgggcctggacgctgtgccggtgccggtcaggggaggagggcaacggaggggcggcgccgccgccaccgccggcgggaggaggaaggcgagcggggcaccgccgctggcctcggtgatcgccggcggcggcggaaggaagcggagggggaggaggacggggagagaggaggaggagctcgagaaggagaggctcttcatggcgctgcatggctatgacgtggcagtggcccgcgcgtgccacgctggcgcccttcaccccagcgtggcccccaacgtcagtgggatgggcaggggtgcggaagatggctggggatttcgacttcctcactgaaattaatttgataatgataataataataaaataatggttattatttttatgtagtatatatatatatatagcaagttgttatagacacatatttcctacagtatatcctaattctcacatgaattttcatgtaaaatcgtcaacattactagcgaatagctctatattttcaaaagagctaaaatgatggtatgtactgctgggttttgcttctcagtttatggtctgtttttttaggaaaaaaatatatttataacctagcttacgtatctgtaaacttatgagtagttgttactctgtttataaatgtttgattcccctgcatgtcttgttcacattgtatgtcttgttcacattgtgttcgtgcagctaaactagctaatttttctagatgttttagtgatatttgttaattggtgtacatgaatacatggtgtatacccgtgagtaggggtggatgtcgagctagctcggctcggctcgttatcctaacgagctagaaacctagctcggctcggctcgtcaacaagctcgagccagctcgttaagctcgcgagctaggggcaagagacatagccggcgagcacggggaggaggggaggagcttgacggtggaggaaaagagctcgagctcgccgccgaccatagggaggagctcaacggtggaggggatgaactcgacgcagctccgccggcacttggaggagacgagctcgagctcgccggtggcgtcgggcgctaggggcgggcgccagcggcaggggcgctggatcgctgggggagaggtggagatcggcggcagcgggcgcttgatctcccggcggcggtgggcgttgggggataggcggagaccggcggcggcgggcgctcgatctctcatcggcggctggcgctggtgggggagaggaggagaccggagccggcgggcgctggcgggggagaggcagagaccgccggcggcgggcattcgatcttcccgcggcggcagcggcggcggctgggggagaggtggaccggcggctggcggttaggggagaggcggatcgcgcgctgctacttggataaaggcggagtggcggcggctgggggagaggcagagtggcggcggcggctgaggagagtggggaattgagtgaagagtgaggactagggtttgcagtgtcttgggcttgggcctttttgttgtattgggcttttgggctatgatggagtcctagctcattaaggctcgcgagccagctcaagctggctcattatctctaaccagctcggctcgttagaaaattcaaacgagccgagccgagccaagcgagctaacgagccacgagctttctggccacccctacccgtgagggcttatgtgtccaagttaactagctcatatatgtttgcggtttgcactaatatgcagtcattgatatagctgacaagctaaaagtccaagattaacttgccctgccattttttattagacgaccctgttcctctattagtaccaacatttaacgaggttaaagtgcataattactccttttatggctaagagtccagatgaatatttttcacctggcagtccagatgcataaccatttcttcttgagcaatgaacgtgctaaaacttcattatcttcgtcacctaaactgcatcgcttaattcattccgtcattaactttacccaaaagtgtcaataatcaattaatggatcaagacagaataatcttaaactttatgaatcaataatcaattattgctgacatgaaggctctcaacagcatatgtttgtttattctagtgccggtgcctgtaactctcaacatatatgcgtgcacctacctttggcccgtcgtcgttggcttaaatattcctattaagatgagatatagatcctgcagatacactggtgattaatgaagttaactaattaaggtggttgacagaaagatgaaagcttgtcagctagctagcatatatagatgaaactttctaatcgctaatcaccttgtcggtgagaaaacagagatatactctttaggccttctagaatctagaggctgggactgggatatattcataagggtctagcccatttttgcggttgggataaagggagtaaatttctttttagaaaaaaaaggaattttttattggtctcggacaataatattaagtgatagaactatactgacaaaactcctggataaagggagtaaatacatttcaatgcggattgatcagtccttgcagcttccgtggctggctgtttgtttgaacctatttgttctcatcttgttggcctctatatattctcatcaaagttctaaaaatgtgggtcgtgctacattcatgaagcagttattacttgttggttaggctgttttgcatactcctgtgggtctcttatcatgcattatactcccatcttatcattcatgaagtattacattattgtcaagtggccactggctagtgtaactaatgtcttgatcccatctcatcttttgagtagtacttcctctaactacgataatctattacacctcctaattcttgaatcaaacgggaaatttctattactactgctgtattacattttgaccttcctttaatgattttacagtttgtgattctaattgaaaaggtgtagtgcttctataccacattgacattgactatttccttttcttctaccagtacttgctttgctctctgtaactttgtttctaatatttttctaacttaccttccactcctgaaatggccatcaaatgaacatctccactccttctccttttgcttaaaaggaagaaaaaaaggaggagaagaaatatgttactcttaggctctactcacctgagctcaaaaggtgctttgccagcgagagaaaatgcaagcagggagattgcagctatacatagggggagcagtgtgtactcatgatcatccaattcttatggcccataggcaatagctcctccatatcttatctgcccagatcaataaagagatcctcttatcatctttctgtgctctggaaagagggaatttgatcaggcatatcactgagaaatcttcacatatataaacaatacaaatgtatcaaatgcatactctttaacagctgagatttttataacgaatagagctaatctttttctataaggtaaatataaatttcaaatacagtggcctttgttgtcaaacgaaaagaagagaatattcagtgttccttgttggatttgaacgcctatagttttttccgttcaaaaaaaaatagacattcacttctccttttcattggacagcaaagagtacagcaagatccattacttgctaactaaaatagggacaggcaatatccctacaaaaggccaatgggtccctggttttattagtccacagtttgtcactgccttactggtgaaacttacctgttgagacccacttatcaatacaatcatgtacccccttgcttgaatgccacactggactgtcttgtgaataacaaatgcatttctggaataaattttattttatccgcaggcttctaattacacataaaaatgttgtagcttgtaagataaccttagcaacttcagttctaccctacaaccattgaagtcactgttaaatgcacaaatggttgcactgtcgaaagtaaaagagtccacttaagatgaataccacaccgaataaaaaaggatcaggcaacagatacagactttaacatacatttatcatgaaaatacctggatatctgcaaagattgaagggatcatctcatgaacgaatcagtacaacagaatgtacaagcagtacttgccctgctgacctcaccatgctcagataaagaaatattacgagcccaaaattgacggggaacagtgtccgtcagtaagaaaccactgaaaaaatagcaaggcattttgttttgagcgataatcacaagattgattagaatccagcatttttcaggctacagtcccacctgttgcttcactgaaaagctcagcatggcacatggtaggtgagccttttcttatgacagcagaacgagaatggttttcattagccaagcaccgcatccacccattaaacgttgtcgccatgtgccacggaatataatctatcattagctctgccatccaataatccatacttaattaccatcaccactcccaccctgcttcactctgtgtccctgtgacagacaaaaaaaaaaacactgagggagttacagctgttgtggttctgactgatctcgagctcccttgaccaaagaatcccaagcaacggaaagcatatgctgctttgctttgtcagcttccttgggtatgtacatatggcacagctgaaacagcaagctccattccatagctaggtgtcccaaggtctatttgatctgcagttataaggacagttttggaggtagcagctacggcagattgtactgtca

SEQ ID NO: 81068 - DNA, 5631 bp, Oryza sativa
ctgcagccctgttcggcctgtaccttttgcacaaacaagcagtggcgcccgaaagcatatatatgatggatgtttaggttaagtcattggaacctttctattgattaatcggttgattgaggagcaagattaacgccaacttttagcatatatatatcggccagacaaatttgaaaagtaaacttttaactctgaaaaacatttcttaattatggggcgttcatttttctgccgtacaacacaaccaaaacaggcctcgattaaacaaatgtgtgccaaattttagggacagacgtgcaccaatattatcacaaagggaacgaacacaataaccaaattaatgcgccattgcgtgcgcactatgggaataattttgttacatatatatataaatagatgtggtattctaagataaaccaaaatctttttaaattttctgcagaagatgctagcttgagcttgtcaatcaatatagctagagctataaaaattaaagaaaaaaattatgtcctgccgtacacaaaatatatacttgacaatgagctaggagaatcggttttgttcctgataaaaggtgatcttagctctgtcgatcggccagaattcactttcactagaaaaaaaaaattgttcgaaaagagatgggcatgcacgtacagctgaaattctcttgtgtgatggctaagtaaagtagtaaactatgggaagtgaatcatattcccttctttgataaatagaccccttttgttttcgagaaaagaaagtaggtaggattcctcgcacagcatcacaagttattttcgttaccatatgaaaattcttatctatctatatatcaatccattgtgaaatcaattagctttatgggatatataacactaatttatcattgtggtccaagtaagatgcatggatattaggatttaaccgattaatcatgcattttatatacacaacccatatggtttttatctctctttttctacgcgtcatggtcacacgataacatgtgttgataatcgagaacccttgatgtcatgcatgcatgtatatatttcaatcgactttggtttgtcccaaaaattagagaataaatactagtttatttttcttctttttagagattgtacgatcactagctagctaggtatagctagctgacggatttttccaattaggtatatatccatgcacacacaccgatcttttcattcattcttttctttcttttcacagatatattccaggtagcttatcaagcacataatgttggaaaattaaacaaggaatccttaactaacaaatgaaacacggggagggaggaagagagggggcagagctagagagctagctagctattgctacagcacatcttcgatatcatgacctaacctaactacgaccccacgtatactcgatactaaactactatagacgaacgaacgatcgttcgttcgtttcgcatatatctataaatcctttatgatatcgatatctctatttcttagtatatctaatagcatagtagtaggttagtatatctgctatagctagctagcagtacatgcatgcatgcacacatgtacatactaccatatctctgtcttgtctccctttcacatgtcacctctgacccacaaacaaaccctttccaagctcctaacactagctttaccttcttcttcctcctcctctgtatatatacaccccctcacctccctatcttgcacccatccatccacccatagctatctctagctagcttgcacattcttcattcttcttgcaatcagagctagagaaaaagagtttgagagagatctaagagatgtcaggggtttgggtgttcaagaacggggtggtgagattggtggagaagcagcaggcgacggcggggacggcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaaattgacctatgtataggctcgcatgcatgcaaggtagacgaccatccaccttgcatgcatgcaggctatcattctctcttcgtctccgtcttcgtctttcatctttgttgtggtgtgtgtgaatttattatacttcttatgactgtgtgtgtgactgtgtgagagttcatggagagtgatgagtagtggtatacatatgtgtcgtcgctgatcgatttggtttattaccttgtgggtgggtattaattatcagcagtgtgttatatcaattgcttacttgtatgtgtatcatgtacatgagtgagtgtggctgatgcatatatatagaggtctttaataattatgtactatatatttgtgtagctagatatatgtactacctgctctgctatatgtaataatgtacgcatgtttttgcttataattaatcatatgttgatctgtatatgcttatatgcaggtgcgagttaattgccatcgatttgaattgttcttaagttgcctaaatatatgtgaacatgttgatagagcattaataaacctaaatatatgggagttcttgtcacctgtctcggctctcgagtaaccaacaaggcgatgggggattacaagtgggccggagacctctgtactgctgaaaaatgggccggaaataaactacacaccgctatacaagccgggagttgttctttgttaggcccatgatctattggcttcatcaagcaacgttgcattccttgatggaataagttttactttggatcccccatcttcacgtgcagtttaaatcgcatcatttgaaccataatatcatatatataacacatctctcaactctcaaaatcagtgcaaaagatgtcccaaaatagtttgaatggcggttttgactgacatgccatcggcgtgactagtttgactttgtcctcgtcccacatagcgctcacatggcactaggagcataattaaaaaatatatgggcccatatgttagtcaaacgaagaatataaaataaacagtgggtcccattttcctccacatcaccctctctcctctctatctcctctggtcggcggcgcctcattggctcattcccctgcccttctctccctctggactttctctcctccctccttgaaggtaagcagcgatggaggatagaaagcacgaagaccgctgcggtgcgggtgtggctggtgggggagaagctggaggggcgcgcgaaggaaggccagcgagctacgtgcccttcccttgttcccctccctctccaagcgctgttggcagtggtgaacacgacgacaatgatgacaatggcgccggtagatcctgctcgccattgtttggttcgatttttgctaaggtttgggtgcgggctttcgttgtgggtcttaccgggggctaggggatttgtgcacagcaaggaggaggaaggcgagtgcaagtacatccgattgaagcgccacgcattgccaaggtcgttcgcacacaagttctgtctgccagaggactcggacaccggcgacatctccacacattgtgagaatggcctgctcatggtcatcgtcaagaaatggatgctgcctgagaagaagaccacgtctgcagcccttctccccatcggccgccaccttggaggcctagacaaagatggggaagagagaaagagagagggggaagaagattggtttgctgacgtatgagctccatgtgggtctcacgctgactcggccatgttgagcgtagtcaactcaccatatcagctaaagctgggcacattactactattagaccttgggtaccttgatattacagataaccggatgcgatatatctaatattacagtttaaggacactatttaaactcgacgtcgagcgacggatctaaagtaaacttattccttccttgatagcagagttgatgtgaaaaacaaatttgtgtcatgtgattggaaagagtagagtgtgttgacagagtatttatgcctttatggagacatttttcattagaaaaccagtcatttttatgatactgtaaattatttacatttatattgtaattacagtataagttttaaagcttacactataaattccaatacaaatattttattcaatttaatacacggtataagagaactaggataaaaatgattgattacctacttgaaatagtagataggagtgacaaaaacatatttacatataaaagagagggggatagcaatcctataagaaaaaaatgactaaaaccgagtaaaaagtgtgatgacatatttttagcaaaaccaatgactatattatgctgggctaaattaactacatgatattctctctttttctttactttttagaaaatattgtaaactcgtagtttgttgtagtacgaaaaaaaaacttgtgaatatttctcccttacatctcctgctgaactaggagagggtttaagttgctaggaaccaataatgggtactgggtgtttaacttggtcaaacgtatctaatctgcaagacaatatgtatcagccctaatctgcaagactaacacatcgcctaaacaactaattattggcagaaatttgtgtctgcttagccttcatccatagtatacaagtataataatacatgatgtccctgttgcgaccaaccgcgtacaaaggtgacctctcactttcattttcagtttctctttttttaaaaaaaaaaaacgaattgaccgaacacgaaattaaacaacagctgatcatcaaaacagatgctatgacgatctctcaattagtcgattgatggcgacgtatgatccaatattagctcgcaaaaagatcacccaaatcttggtcctaaaaagattatcagtgtaatctgcaacaattagtaattaattttctcgtgtatatatgaagggacactgcaacgacagaaccggatacagaacaatagaacattgtttagactgacaattttcttgcgttgatgctagtgcgaccccaagtcacccaacagctagcatttgtttagacgacaagatgatattaattaattatagatgcgattaattatacaaaccagaacggtttgagtttttcaatctcgagagtgcatggtgtagggtaggccttccaaggtagtatcatgggatatcttaaggtttgtagttcagtttatggtacctattgcttagggaaatgatagattttaggtcactgagatttggggaaatcttagtcacctactagctagccgtaggagtcgtttttaacctctagctaaggaaagaagaggggaaggcagtagccatggcttacatgcaatggcgacaatgacaacaacgagcttcttgccgatcctttcatgtttttttttttatcaccgatgaaaccggctccgttagaggacctacggattagagtcagggctcaggtaggggttggaaacagcatcagaggatgaggtgagggaatgggaacattttctct

SEQ ID NO: 81069 - DNA, 1271 bp, Oryza sativa
ccaattccttattcctcatttcttgggtggaactgaaagcctaaggaatctcccatgggtcaaagttgtaaatgtcaatattggtggtgatgtgtatgaggaatgacaaccccgtgccattcctcttaggtaattaacaatcgattcctcgtctgtcggatggaactggaaccctgttgacaagctgaccaatgacatgagccacatagccatacatggtgtatggttagtacttgtgtgacttgggttcagatagaatccaccatccccgtggagtattgataaggactcatcaatttgtttgtcttctttctttctagtatctgttctttttatgtgtagtaatccatggtcttatttgtaaagtcattgcacaaaatcacttatgacaccttgttgtacattgtgttggggagactcaatggtcatgcaatgtcctctattattattttaggcagtgtgaaaaagttgaaaccctactctttaacacacataagatggaataaggaaagatgtaacgagatagagcattagagctaaccacatagtcctagctaccactgacacaatccttcgcaagtttaagtttatgtaaagaagatctaattgtctcaagaaaaaaaaagcccctagtgtagaggcactccctagaaacactatgaaatcacctaaatatttgtagtatagaacacattgtagagatggttttatagacatgtgcaaaattatgtggtagacattttttagacaatttctaatttttttctatatgtgtacagacattttctcgatacatttttgtctctctagaggcattgtttagagggtcgatttatgttgagtaagcagctaaggatatatctttgtttgcctttaaaagtttaccatgtcccttatttgtccctcattctctcgatggtatgtgggtcaacatgccatgggtaaattagggataatgtaaaacacatgaagattaaccatgatgtgaggataaaatggttaattagtccggtgaataccgagattgtgttctttatctgttcaaaagaaggtagtggttttttaggaaaaaaaagtattgagtttaagtattggtcataccaagatagacacatgattattatttatctcagtttcatcatgatcttttattacagtagtagcacaattaatctagtgttattataaaatgcttccactccttggaaactagaaaacaaagagtatttaggcattttgtctctctggttgtaccaacgatgcaagaaaag

SEQ ID NO: 81070 - DNA, 944 bp, Oryza sativa
gtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacccagctgctcgccgagatgcgcgcgcggatcgacgaggaggtccgcaagctcgacgagaagtgagtggggctgcaggaat

SEQ ID NO: 81071 - DNA, 1699 bp, Oryza sativa
ccatcttagctctgtggtgttcatatacaacagtatgaattggggagacagaggatacactaccatcctgcttttgacatcggactctccagtcttgtcgaagtgtcacagagttcagaattgattgaagtaatctcttcacttggccagttgttgcttgatgggctgaataaatattatcaattatttgtaatcttgtcaaggacgacttcagtgcaggatggatggtgataaatctttgaaactttcttagcatcgcactgccgtacctcagatgatcaatgtaatttctaagtgacttgtcaagatgcctaaaaaggcctggccatttaccacctacctcatactctggaagaacgtcagtagcaactctaagaaaatcatgtgcctctgttttacatgccgcttgataagtacatggcaaatcgatcttaacatccaacgagtcactgaccataacatgatccaaatcccaatggccattccaagatctacctcccttatgagaccttgttatcattgtcaacagattggttaaaatgattctccaatctgggtggtatctatcactggcaggaaaaaaccatcacatctaatatggcggggcttggtcagatgatacccacgtagcttcagaaatgtcctcaacggaatccatctgcaaatatagtactctattatttattcctaataatgttaacatcaagccattgttattgaccaaatttaaatggactcaagtaaaatacctatccggtttgggcatgtcacatatgcatattactggattttcacaatgaaaacctggtaagttcaaatcatgaataaatgtgcgcacagcattttcaagattcttctgaatcctgcaaaaaatatagaaattaagacactgactctcatatgaagatgatctaggacaagaaagtcaccttgggtagcattggcacaagtcatgtgcgagttcaggagcataactccaaatatgatcgaaatgtatgtgcatctcaggagagctcagggtcttcatagaatcaacaattgctccataatatggtatattgttccgctcgaagctgattaaaaaacagatcagatgctgctttgatttcataagccataaaacatatttcctaagaatgatagatttttaccttcttaaaaagtcgaggaacatgtgttccagcttttggtcttttccactcatgaaataagacgcaaaatctgctctcactgttccaggagagggaggcctggtttctagctgcgcattggtgggtgatggccttggcttaacactggagctgctaccatgttctcctgccatacgggaatgccgtactggaggaggaccttggcttgactcaagtgacgagcttacgctctagaacagagaaaaaaaatgatgaaggcattttgctagatcaaatcaactagatgaatatattacatggttatagcaatatgagtgtttacaggtaacatcaaaaagaccgtgacaatagaagtggctttgaacacagtagatttgccactaaaatcctacaatcaaaggaatgcatatttctagcaacatgctgaagtaacatggcaattctacatttagaacaacaatgtgctaagcatgggatagcagttaacatttaaggcaacaaaaacgtacatgatgctgggtttgcctggcactgtgaggcttcttctt

SEQ ID NO: 81072 - DNA, 10837 bp, Oryza sativa
atagcaatatgagtgtttacaggtaacatcaaaaagaccgtgacaatagaagtggctttgaacacagtagatttgccactaaaatcctacaatcaaaggaatgcatatttctagcaacatgctgaagtaacatggcaattctacatttagaacaacaatgtgctaagcatgggatagcagttaacatttaaggcaacaaaaacgtacatgatgctgggtttgcctggcactgtgaggcttcttcttaaagctttgcttagcaccttcaaaataattgccacttttcaacacagaatgttggtcccttgagattgtgatatcatgaaccaacacaccgctttcaccaggctaattatttttaaacaaaaaaggtcagtaattaaaaaaatgcactgcttaatcaaagaaagtggcagaattactaagggcttacagaatcaacagatcgccaaatattttggtagttccggaagcccacatctgattccagaacaaaaaatcttccatggtactgaaaagaagaaaatagaatgaaaactagcataccaagcttatttaaaaaaaggcaggtatcacaactcgtaaattacaataccttgtatacaacgttgaagtgctcgttttgaaagaaaatgaacaacttcctatcaggagttgctgctttcaaagtgtgtaaactgtgattttaaaaaaaaatgtcaatagaagaaacaaaatgacaattgtatttacctatagctagcatgcatacccaaactctgtgacttgtccaggattatctttcaagaacgtgtgaatcaactcatctacaaataaacaatttaaaaacagagcattagcgatcaaagaaagaaacatatttgcatccgtaaatagttgacaggtgaaaaatgtaagatcgttacatcttctagtttcagcagcatctatcataaaatcagcatctttctttgagttgtatttagccctatcgatattcagctgattgtatgaacgtccatcaactgcattcaataaaatggtgtcttcctgttcacaaacataccacagaagaaaaaattaggcaaaacccaagaaaaaaaatattaacatgactacaacactaaattaatccatgtaataagtagccatggttcaatcatactaaaagacatctccagtagcatacctgattgttcatgtctagtacccaggcatgatataaagggatatccaggattctaaaaagcccatactgaggggtgtcctcaaacccgtcgacactgcgcataccaattacacatcaaaatatacaaatggaggctatattattgcttaagaactcgcttaaccacaaaccttgtgcaataaatatcaatatctagtcctgtagccgtttgttccaccgttgcctgtgcagttttatagctgtcatcctacacattgcaatgtgattaataatcttcaattaaaaaaatggaatatattgttttgataagtggatcagatcgaaccttcattttgctgaaaacttgactaaacacacggtcaactaaataatctaggtaaacaattgtcatggatggtggcaaggagagtttcctggtaaggattagataattgcctgcaaaacagagtagttaagctacatgggacagtttatcagcgggtatagtataaacaacaaacaaaatctcacatatggctatcaaggagcagggtccattcttggactggaggatgatcttatacccccggcccagaaaggatatgagttttgtttcacaaaaatctctgggcacacgaggcacttgcggtggaggcaaagtgctctcccctccttcatccttctgtacacactcctcttcggtctcctcctcctcgccctcctcgtcctcctcatcaccctcctctgcggagtcaccagcggtctcctcctcctcgccctcctcgtcctcctcatcaccctcctctgcggagtcaccagcggtagagaaggacagcgagcggtcaacctcgaagagctgcgaagctagccggccgaacaactgcgggccggccaacatccggctgacggacacctgaccgatcggcttgaaggcctgaccggtgctcagcctctgacctatgtcgcggaagggagtgatcagaagccgcggcggtacccgctgccgaccgggcggaggatctccccgcggtggaacctgccgctgccgaccgggcggaggatctccccgcggtggaacctgcccctgccgatcgggcggaggatctcgccgcggatagttggatcccatcgtagagaaggtcttctaggggagcggtgggaactgaggctccaccctcgccgtcaacctcgacgcaagcgcgcgccgacgctcccccgtccgaccgagcggaggacctcgccgcgaccgatcttggcggcggatctcgcgaatgtttttttttttctttttcttttttttcgagaggaactcgcatgaaccctaaaccctaggaggcggcggcgtttggtttgaatggtggagttggctcgagtggaatggcatgacctattagggtagtaggtgcgaggaggcgactgcagtctactgaagtcggcctgtgggctgtggtccgaacggaccaagacggcccgcgtcttggactacggagtgttcagttgagctgcaagttttacaggatttttttattattgtttttctaaagatttataaaaattactctaatataaattatcgttccaaagttttgcaaaaatactctccttcggcatataaatcaccctacaataagaccatctatgtgacgtggcaccccgtagaaggggcacatcgcgacaattttgcaggcctcccgttgggcgatttatcgtcgggaggggccacctgcaaaattgtgaaactttgaaatgattttttttacaatagggtgggaggagtatatttctataaaacttcaaaatgaaataaatataaatattaaaaaaatgttttacaaagagtaaattttacctagactcatgtattattatactttaagttacacaagaccacactattgatcatttcgacttttatttatcacagttttgaattctacaataacatctcaaatttatgtgttctttattcatcatataaatgatctacatccatgtaactatagccttttaaaattttgatatgtgaatatgtcaaactgattagtgacgtggttttatggaacttggaccattaatatcttaagttatatgtcacgtgccaaattttatgtggttttgtgcaactttgaccattataggtgaggttttgtaaaatttactcttacaatctagccttctaagaaaaacttactccgtatttcatgaaaataccattagtaagacttatttctggaaatgtgttgatacctcggtgccaacgttggtatcttttacattagatgataccccacacgctgctacaggtttattattataatttaaaatacacatattagtatgatctattaaaatactaagctgcataaatgttataatttgaacacaaaagcggtaggaacacgctgctacgggtttattataacaactagttgggtgcccgcgcaattgcgcggctagcacccatacaaaagtaaatatttttatatgattttacttaaaatttattaaatatttgtctcgttgtcttaagactttgaaagaccaaaccttatcatccatgtgtttctaattttataatttttaaaagtcacaccagttgctaccccttacttctgtcatatcattttttatttgcttgcttgatctaccattgtttatatttctttctccttgaaacctttacaaattggatcttatagcttttagagtttattgtccagttgggtcctctatggtccgcccgctaccccttatttttattgccaataggattttaacaatcgaacaaaattatcattggggttctttttctttactttctagaagttcggtcaaacagtcatcagctccaccactgtgatcctctatggcccacccgctaactcccctcgattttaaaaatcgaacgtaattatcattggggtttacttttttactttttaaaagtccagccaactgtagtgaccgtgctatttaagtatttaacgccatgctcgtcgtccctcatcttaattgtcattggatttctatttgagattttgtttatagtttttatatgtctcatcatgcatcatcaccctactcctctattaacttattgtttttccctctttattatcatttatcattgttgtgttctatatggacctttttttaaagaaaaatcatatttttcattccgatgttctgttatttataaattttattcatacttgcactcttatataattattttatattttcaaattttattttatttttattttgatttttaatttatctcgtgatgggttctagatgatcttttctttcaacaatcttttctttaatttcgaattttggttatttataaattatattcctatttgtactcttctttttcttttttaattgtgaaatttattttattttctattaatctcatactatgtctatatgaattattcttctaatattttttattttttattcctaatttcagttgtttgtaaaatgtatttttacttgaactcttatatttgatttttctaatttctaaatttattttattttttattatggattttaattaatctttaattgtgttcggcatgaactcttctttcattttttattgtgttatttcaaaatcaaataaaaaatccgtgcacatgccgtcatgcttttctggttgctgacgtgcatcacccaaatccggctcattgtgcagccgcacggcttgacccgctgcttcggatttccgtcgctcgttgctagcatctatcttcatatcaacaaaaacgcatccaaattacggttctacagtggttcgttgtctgctacttcattaatatatatgtattatagcctaatttatctagaacctaactctggttaattggtttaggaaatcggacaaaactcttttgagaccgtttgcatgtaaaggtcctagctagagattgattctaattctgcacgcgtataataagatagatagattgatagatttcaaatacacatattgaacacgctgctacgggtttagtatatatgaacgatcttcttggcaaagatgatcgttttgattggaggatgacgtaagatataatgtacatagctgaagatataaatgtcaactgttcataggacgatggtgtaaaaggagacaacctggacgaaagcaacaagcaaaaaacttcaaagaaattataccgcttgctcaaatgtgttcactcttttatttttcttcggtggatatccttactgacacgtgtgaataattatatgaactgttcaaaggagaggatggtgtaaaatgaggcaaacctggatatgaaaacgacaaacaaaagttagaggtagccgtctgaatgtgctagctctttattgttctttcgtggaactcctcgcttttacctatttacgataaatctgatgatgttttgagtgggagggacaatggaaggaaccagaactccttttccgggtcggccaaatattggcaggccaatctcattatgattggaggaaataaagttttaattataactatatgaaggatgtcgcgctggtctcaaacaaacttaaagacggtaaggaaatagaaaacaatgtggcaagccccgcctctgagtgggattactcgccaggctgggaaaagatccctgctgccctccaaactacgatttccttattgatgccgtttgctagcaaatcaaccgacttggcgatgtgctgaaagatcctaacattccgctctctccaaataagccaacaaatgagcatgaacaaactatcgaaatctgtcctgtagccgttctgaaaatgccgtcttgtcgcgatccaagtggcctgccatcctccgcaggaattgcaatgttaatgttgcaccaaagtcttagcttacaccagaaaccagaaaattgggctgctagcttagctcaattttgtttactcttttatgttactcatggaactgctcactaacgctcaattttatgttagtatgttagctgtaaataagttcttaactacctctgatgagtatgatgaaaaaatactattgctgagtaattttcatccaacaacatagcatatcatgtgcgttgaggaatgaggtggtaatggataatcccatcccattcctcaaaccaaacaactcatcaagaatcaagtgatgaattaaattcattatctcactcaaactaaatgctaggccgacattccaaaaaaatgacttttgtgttgaactcaaagcaaacaatcactggcaatgtgcccaaatactcgacaattgccgagtacacaacggatgcaaaggtaagtcaagatacataaataactcacattgcatctgtacctttattatagatagattcatcaaccctccctccagcaagcttgtataatgcaacaaagcaacccccaaaggttttgatcacaaaactatatatgcccatcaacagtacaactccttaaaatcccatcaagataacaaattattgggcctataatactcatccgggcccactgcaatccaggtcactggtggacactggggttcacaccttctacttggtggtttctgcctactccttaggttgtccaactcttgtatctaaatcaaataaagtagccagtaaagcaagagttagtacccttttcaatgaaggggaagagcattcatgttgtccgcaatgagtacaatagagaaagcaaaaacctaaggctaatactagtacataaaactattcaagttggctttggttaatgccttattacttgttgtattctcttgtttggaaattggcatggtcccaatgtactttgattattactactttatatttaaatacatgctagcaaaatatatagaagcataattaatgataaggaaatagaggtggagatgactatattccgttgacaaagttcaggcctcattttccaactatggttagataccgaagggtttttcttaaactcacaccgaacagtatactgtgtaatgtctcttggtactgctctggcattgtattatatcaacatataaagcttaacgtcctaaacgaagttcactaagttactgtgttctaatcttagtttggttgacgtatatatcattcataccatgctaaacaaagattgagctatggcaatttactgcccatatgcacatgatgctgaatttgtcagggatctgcaaataccatttcttggatgcatgtatatcctctataggttagtaaattgtcaagaaaaaaaaacatttccatacatttaagccgttttacaaaactgaaagttatggattgtggtctattttatactgcaaattagcagccttcctattctctggataaacaaccgacattatatttttttaaagaaattaaaaaaataaccaatagctgcattaaattactgcaactgttcaatttttttggtgttgctttgcactatcatgatcatcaagagttaaatcacagtgcagcactgcagctaataaaaacccctatgatcccaccttactataacttgagaccggcttgcaaataacattttatcgatgtattaatctttgtcatatagtataaacatatacaattgacaagtaccagagcacatgcatatgatagcaaggagaggtaaattaagtacctgcagtaggagtgggatgtttggagatggcagttgcgagatagcatctcatggagaagagggtgttcttttttccgtcaagcttggccgctccttgaatctccttcttcctgacatcaagggcgatcatcactcctcccatatcacaatccctgttggcagaattgcacaagaggtaaacaacatcatcgtcgtcgatgctcaaggcggggtaagacatagccaggcatcctagggacaagctggaccctttggcttcctcatcatcgctggtgctgagcatgagtgtggagattatgggtaccccatacccacacggcatggttatccgactagtcataggggatagcttatatctatggaatatttaaccgatcatgacttgggtattacgtttccttttatattatgaagcggcctaaagtcctgatttgataatattgtaaaatagatttaggaaaccgataccgtattggttaaggtttctatcttgtaatcctgccccccatcctatataaggtggacaggaggccctctagggggcatgacacaaactgatcgtcagatcaatatacacccggcgaattcaaatccccaaacaggagtagggtattacctctcatcgagagggcctgaacctgtctaaatcctttgtctccgcatccatccacttttaggtctcgtatgctacccccttttcatattgccgaaaatttgtttcgacagttggcgcgccaggtaggggtgacgccgagtttcctatcaacgagtgcgatggaaatcaacttcagaaagaaaaaagatcaatgtcgatccaattagcaacgtcgccgggcgtttgcacgttcagcgctgatgatcatcttggcatgcatggatgcactggtccctggattctcgctcacaagatgtgtgtgcgtgctgcacgccgtgaagccgccgactgcttgccagggcaaccaatcatgagtgtgcatgcagaccggtggaacgataaagaagcttgagatcaagatcaaccggctagctcgtggccataatatttggcatcatcacatatatcgatctatacaactattacctggtttggctttccactttaattttatttagattgatccctaatcacatgttactctacgttgttttctctccttgatttcatgcatgtactgctgagtgcgtggtgatgtcatactgccatcatgctatcacggtgatgatcatatcgaggctgaagcggagtacaggacacaagtcgctgcgcaactcgccggctgcatgtcttgatccatgcattttggacgtcacgttactctatacggccgtcgcacgttcgcatggtgtcatgatctccaccaattgcggcctcacgcgctcatcaatggatctaacaccgatgactggattggattgtcgaccatacccactgacggccatatccgtcattgtcgaccgggcagatcacacccctattaaattgttcagatatcgggttagctgttccaattcatagattattaaaattaatctttgatttatttatttttttacagatcaatctattatctgtatatatttcctgtcgtcgattcggccgagtcctttgaccatgcagttgtacgtcgaactactcgctgaacaagtcgatggttatacaagtcctgtacagggacggcagctgccggacagaacgaggagccaatgaaccacatgcaatcgtgcatgcgcttttgtgcttatggttatgcaggcctctctatcaagtgccaatcaagccatgtgtttggatctattgattattatatcagttatttttttttacaaatatctaaccacaggttgatgtgcaatttcttgtctttgcatgtatcatcgcctgtacttcatcactgaccggctggcctttgccaccgccaactggtgtttccgcctgcacggctggcctattatgccgtcgttgttgggcgtctacgacttcaccggcggcttgcctccgtcgccgccgattggtgtcctcgcctatacggttggttggtcacaccaccgttcatgggcgtccacatcttcaccgaccggctggccttcgccgccgccgactagcgtttctgcctgcacggctggcctattatgccgctgttgttgggcttttacgacttcaccgccggcctgcctccgtcgctgccgactggtgtcctcgcctatacggctggtcggccacaccaccgttcatgggcgtccacactttcaccgtcgatcgccttcgtcgccgccgacgggtgtcttcattattattgatggacgactttgttcccacattggccacctctgccataatcaaggggaatatgacaaagctaagtcatcatttattttattctttatatgatattttgccttttcctttgcctcactacatcaactggttcgccgttgactagtgagtcgggggctacagatgttatatcatattttttaaacaattttcataatatttatcttgattgcttgcgacatattctgaatacaaaagtgcctatcgagttatggagttccatcttcctatgctttccgtttggtttgccaatggatagttgcctttgggccgattcctagcacctaggggcttgttggatggaccgaataacgcaaggtgctaagtattattcggaataaatcaaaagcatagagataagataatttattttctgctcttaataattgcaaaagtacccgagtagtaaactccgacccatgaaactttgttccattaatgacgaactcatgtcactcatatgcatgtttgggaagtgcttaggccgactcccggtgcttgatggctatgactagtcgggcagagtgtttaaacgtaatgagtcatctgctcgggggaatcaaaattgacaagagaagaaatacatatttataaatattttaaaatacttgaatttttctcgaagtattatatttacatcagatactactcatcctatatgttcgttctgcaggatccagatccagatatgcataaaagggattcatggcttt

SEQ ID NO: 81073 - DNA, 64693 bp, Oryza sativa
accccatcaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagagaaaaaaaggatgccatcttgcattcttgcctcttgtcctggtccaggtccaggtgcagtgttccatcagatttaagacaatttgttaccattatcatactagatgacatatcattaatttcatgaaattactccaagcagatgcaactcgtagtatggccttgtttagttggagaaaatttttggctttgattatcatatcggatatacggacacacatttgaagtattaaacatagtgtaataacaaaacaaattatagattccaccaggaaactacgaaacgaatttattaagcctaattaatatgtcattagcaaatatttacggtagcaccacattgtcaaatcatggtgcaattagacttaaacgattcgtctcacaatttacacattcgatgtgatggttgaaaagtttttgtcttgggacctaaagcagtcctatgtatactaagtgatgttcacttgtttgttagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcaaaacaacaatagttattgtcgattctagaaatcgacaccgagaaaaagggtagcatatgagatctaaagtggatgagtacaaagacaaagatttcgacatattcagaccttctcgatgagaaataatacattatttttattttggggattgtatccaccggatgttgtattggtctgataatcttggtgttcctatgccctcaggggactccctccctaggttcgggggcaaggttacaaaggggaaaacctagtcagacacgatatggattttcttattcagttattcaattgcataagactaatactacggactatgccttaaaacaacttttaacactcaagacttatcctaaaatataataacttctccaccaacattctgttccaaccaatcaccactatccatcattcgctttttccacctacctccatttcttaaccaatcacgacctctccctatttaattctacctactttcttaaaaatcatgtctaactctaaaacttcttatattctgggacggatgtagtaatatacaaatctggtccacctcctaccttcagtcggataagctgtccgtgtagatatatattacccaaaatctccacagctatgtaacccgagggagaactagcatacagctgcgtgtgttgtctcgtcatctaggtggtgtttggttgcaaggatgggatgggacgaacccactttgaggagtatttggtttatgggttagtgggttgggttggtccctaaagaggaatattcctctcaaaatctaggaccaagccatccggtaaaatcaaccggacgagctcgtcctacctagacggagtacacgacgtcagcttgtctctacatccgctggcgctcatccgtgatgtctgccacctccgcaactgccgacgcctctctgcaagcggctgccacctctcctccacgaccctccgccacctctcctccacgagcggtcgacgaccctccgcgacccactgctgccgaccctccgcgacatgttgccgcttctcctctgcgagaggccaacgctcctccgcgacccgtcgtcaccttgtctccgccgcctctcctccgcgagcggccgcctcgcctctcctccacgactggtcatctgccttctcgctcgtccgcccgtctgcctgttggtcgccaccactcctccttccgcctgctcgctcgtgcgctcgtcgagtcatcggccacgccgtccctcctccgcttgctcgctcgccgagttgctggccgcaccgctcccaccagcttgccgccgggatcgaacgtgggttgacggtagccacaaatggcgtccatcccatacctccctcatcctttctaccaaacaaagaactgggatggtctcatcctatgaaccaaacatgcgagtagaatcatcccatcctaaaaatcagggatggtttcatcccaccccatctaatcccagaaccaaacaagtgttgttcttggctttgatgatgtgccgattaattttccaacgactttcggtactccaaatactccatcaatgcactggcacgccatatcgggggtgtttagatccaggggtgtaaagttttggcgtgtcacatcgggtattatatagggtgtcgtatggggtgctcggacactaataaaaaaactaattacagaatccattagtaaaccgcgagacgaatttattaagcctaattaatccgtcattagcatatgtttactgtagcaccacattgtcaaatcatgaagcaattaggcttaaaatattcgtctcgcaaattaatcgcaatctatgcaattagttatttttttagcctatatttaatacttcatgcaggtattaaaatgttcgatgtgtcagggtaaaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagggaaaaaacaaggatgcaatcttgcattcttgcttcttgtccttgtccaggtccaggtccaggtgcagtgatccatcagatttaagacattttgttaccattatcatactagatgccataccattgttttcatgaaattactccaagcagatgcaactagtactagactactagtatgtataccaagtgatgttcacttgttcgtcagccatctccaacaacatttacggcagttgaaccagcttcagaatcactactcctacctgcagtagatgccatttcagatagattggcaatcaattaagatggccttttggccgctcaagaaactgtgtactaccaatgaattgaatgcagatggaatttctcgcaagatcttcagggatatgttcagtctgcatcggaggggagctgatcctgcacagtttctcaattcttggcatattagtagaagtagattactagcagcggcatcgacgatcaatgcctttgttggcttttttttttaatacgcaaggagcgcatctttgtattaagaaggaataaatatatgtacaaagcgggaaaaaaaacaaagcgaaggggacagggtacaggaggagaaccaagaaataaaagcctaatctccaactaaattttgcgacccttctccactaacatgagctaccaaaacggggattgcagctctagctagccgccacagctccgcttcacccgtcataacccttgcaacctccgcccaagttctgctcttctggttgaagactcgattgtttctttccttccagatcgtccatgcaaccaacgtcacgatggtgtcgaaaccccggcaatgttccttgaccatcttcttgcgacagtcgcacaaccatgagaggaaagagtgttcattgagcggtaagcactctgaatgcccgatagctctgagcgcaacccaccacagttgccacgactccgggcatgcgaccaagagatgatcaattgtctcttcgcattgatcacacaaaacacatcgatccgggtgcgacaaaccacgactccggagacggtctgctgtccagcaacggttaagagctacttcctccgtttcataatgtaagtcattctagcatttctcacattcatattgatgttaatgaatatatatatatatatatatatatatatatatatatatatgtctagattcattaacatcaatatgaatgtggaaaatgctagaatgacttacattgtgaaacggagggagtaccaaccaaaggaagtagcgacagcgagggggtgccaaagattgccaaattagcttgtgctggagacgagttcttccaaaaaagagaacacgagaagccgagcgggaagagtattctcctgaggtctcccaccgccaagatagagagtccggctcttcggaaagccgcactgaccgaaggcaatcccaaagcttgaaatactccaggatcgcttgaatacccaacgccgaactgatgtcctggatccatcttctgttagtcattgcctcggccaccgtgcgtcgattccggagatgggcagggattgcagcatagacagccggcgctagcaaccgaatggaggaaccctgcagccagcaatcctcccagaacagcaccgaattcccatcccctaccaagcataccatagaaatcgatactagattgcgctccttctgcgagaccagaatactaagcccttgccacggcttttccggtgaagttctctgctgccagagccatcgcgacctcaaggcgattcccaacctctctagatcaggaatccccaaaccaccatactccttgggcgagcaaactcgagcccatgcgacccgacagacgccgccgtttgcataagctttgccagcccaaagaaagctgtggcggatcttgtcagcctttgttggcttttcaccatctgctcatgaactggtcaagaagcgagcactggttggcacatcatctctgaactctctgaatcttctctcccgcataatcgaaacatcaaataattgagttcaccctaacctcaaaaggcttaaaaaggtggtctgaccgtaaaactgaagactgcttcgataacgtttctgtagaaactcgttttgtccaaaaccaaccgttagatcaagtttactttattagaataaattagataaactaagaagcaacttcaccagatgaatttgttcataatgtgcaaccacaacacccctcatgagtttcttataagaccataatacaaagagatccaaactctcgaatttctcgattgtggcttaccctcaggggttaacctctctcgctatttatatccatggatgtgatgtccaaagtcacgaatttaactagtactactaggaatcctaatcacaaagttgggagtgcaccagcaggaagagaagcataagcaatgagtcatctgtattctgtcttgtaaaagaaaatgataagtgtgatatctgagaaactggtttcataatcgaacctgcccacatatttcacctacgctactgcagtttttggcaatcttgcacttttctccttctgtcactgaattgtgggtccttagcctcacgtgtcaatgagacagacaagaagtgcaaataaaggattaagggtgtgtttgagaagaaggggattgaggagattgagaagatacgcaaaacgaggtgagccattagctcatgattaattgagtattaattattttaaattttaaaaatggattaatatgatttttttaaagcaactttcctatagaaaatttttacaaaaaatacaccgtttagtagtttggaaagcgtgcgtgcggaaaacgaggtgctctccctcaatgtcctccaaacgaacgctgcctaaattgttgtagtgtaaaacaaggaaattcttcagcatgttgaaattttggttgatgtttgtgctattggctgttaatgtttctttttgaagatggaaagtacaacgcaccatcaagaagagaagcattagtatttggagacattttgggtttcctatcttgtaaataatcgatatatagtctcgaagaggtcgttgcaaattgtttcgatatatataaactgcctatcgtttcttagagctaggaccgagcacagtcctactcctagcaattaacataactacgaattttaccaactcttcttttaccataaaaagaactgaggcggcaaagacgctctgtacaatcttcgtacccattcctttgtaaaacccgtgcaatccttcataccggatcatctttatgatcgcgtcaatcgtacctggagaaaacaggcagtcagcattatattacttgcacaatgagtagcaaatattccctccgtcccaaaatatctatatccgtagctaaaagtagctacattttataacggaagaggtatagctaaatgtctgacacacaagacataggagcagcgcggaaaaacaatgatcccaacaaatatggaaatgaaacagtgttttctgctagtaagttaaaatggtaggaaatgatttacctgtgtatctggacatcacattcctgccaatttcttgttttgcttgcaacctagactgcattagttcaatacaacaatcaggatagcacaaacaaacatgacactattttgataatgtaaaccattcatacactcaacccagatagactggcattgcctgcaactacttgcacccgtggcaggtctagatattgtcgttgttgagtaaagtctcacaagattaaattatattctgaaggagagcaaaaatgtggtgcagcatattcatggggttgttgtatgcaacaatgcaggacagctattagtactgtagttgttttgctgaaagcatttgttttaacaacatcagagaaacagagtagagaaatggaaaagaaatctctagcatcgatgtggacttccgggtttctattcaggcctattttggcaatcctgagtggcccatcactggctgatctgacaagccagtaattcctcatttcttaaaaaaaattgagcttaaacagatgtacaagtgagaaatgcatcagttttaacactttgcacaagataagatgatttacatgtatataatattaagtttaccttaaccactagcaatgggtatgtcacaacagtagctccgagctttgctattgcacctaataagaatacctgctcaaagagaaaatggtaaggataggacatataaatgcatcaaaggaaatttcaaagagcttaagatgttatttagctctggatctgaagaataaagaaacaaatatatggtctgtgctatggacataattaaacaaagggaagtaataatgatgaatattctttagtgcattcatagaatcataaattgactgcatagctaattgtagtatgaaattactctgtcctggcgctttatgtggccaaattatctggtttgctcaaataaccgtagcatgcatctttaaatataataatttatggagtacaagaattatagacgaatgatttgaaggtaattatagcaatcccaacgatgattctttttacattgaaccaaatattattgatcatgatcaatgtagctttatttgcatcaaagcggataaacggtgaacaggtttataggattgaaagatacaatacaaatttctagaaataaaaaagaaacatgaagttcctaggaaggcagcacatgcaaatagctgatgccatctaactgttaaaaactcatatatccacagacacagatacatgcaaatttctaatgcagagctaaatcgaaaaaacaaatccatacctccatagcagtaaggttcttttttgggagttcctttccagatctctttgaccggagacgctttgccaatgtttcatagatcataaattgaattgatggattacatacctaacaatttaaatggttcattctctatagtcactcttacataaccactaatttcagctcaaatgttttgagaaacataaactaaccataattagtgttggaataagtcctttccagaatcctcttatgcctgattcacggtagacctcccggacctacatactactgataaaagtaagaaaaatcatgtctgaccagtgacaaatacatttgattagttaaaagcaagtttgtagagcccaaaacttgaaatgcaattgcagctactattcattgtagttttttgcaaacagaattttaaaatctgtaagtgcagcaattagttctagaaggaagaaagcaattcgataaaaaaatcaagaattcttgtactatctaaatagtacaagtgagaaatctatctaaatatctagatgtggtcacaactctcaacaaaaaatagagaggagcagggttgggtgtgggggattcacgtactatcttattttatgtgctgcataattgttaagaaatggattatatatacaaaataatgtatagcaacttaaggaatgtgagtgtgctcaattactcaccgcttgaattgtcccatatggacgaggcttttcagaatcaagtttatacaacctgtccttaagaattgagacctctattgaattggccctagcaacatccttcagcaaaagctcctttttagactccatgatcttcttttctgcttgtgtatgtgtctgaaaaatggaataaagttaatttccaaactgatgataaaaaaacttacagatattttgaataatattagaatgttccaatttaatagtagttgcatagttaatacaagcttggttacaaccgaccatggtcttccaactaatttcacaaaggatgtcatggaccaataatccttgtgattcggcgcctcctgaagtttcatggatcattgtcatcataaaaacaaagctaatgcttggagtcaggcaggtacaaagaaggtaagtatgctaccagaaagtgggggcaaaagcaacagtaattaaattcaatgggtgcaataccaatgttaatattctaacatattagaagatttcttctctttttttgaattttgacaggacatacagtatagtaactcattaaccccatcatcgacgatcttttttggtgttatatgtcattttaaaatatagactgttaaacaaaatttacctgcatacgagtcacgagaacccatattggattggtaagaagaacattgattgacctgcagcagagaaaagtgtccatcagaatgcctgaggatcaatgttgcaatattacattcaaagtgcaatcttcgccatactggtgactctatttcacagcgctatggttttccagaacaaaaaccatcttaactggaaaggattacacgcttcaaattcaaagttaatcaccgccttcagtcagttctaaggaggcaaggccatacgaacaatcatggcaaccatacattaccatgaattacattttcttatctccctttccgaaacaatttaaggtttcaacgctctgttagcctttgcaagctcagtcaaattcatcagaactctattacaattcgtttgacaggatactatggagatgccctattggaccactaccaactgataatgtcccggttgtccagactgaattgttcattccagcattaaatggagacaagcattcgatttgttttgggtgaatgttggggctccaggttgacttgacatataaatgatgtttagcaatttcagtgcgagagtagatggcttacccagcaacagctgcaataccaagccaggagaacatcccaacagtaccatcccctagacccttcttaccgcgagcaactgctagatcttccaccttgtttttgagaatctggtaaaagtagtaatagattccctacaaccacaaacaggatgaaccataaatcctgaataccaccgtacagactcatccaagtatcatcacattgacaaacagggaaatacaattgttacagaaaaaaatgatgtgagtagcaccaaattactaaaccagtggaatttacctgtgaagcagcggtgccaataagagagggtttaaggccgctatacaaccctccccatccttctgtttggaacagctgcagtaactcgattccacacttggccattataacattagaggaggcaattccaaataaactaaaagtccaggaggaactacctggagcatctggaagagggtggaagtattggcgatggctgcgccattggccttcttcttttttgctgacctctctgtctgctgccgggtgttcacctgctcaggccatcatcatgatgaggaaggattgagcagactataaaggaacagcagagctacataagatggtagggggagaatgattgtacagtctggagggggtaggtgatgatctgggcgatgatgccaccaccggcaccagccaatccattcaccgccgcactcgacatgcgccaacctgaaaaacccatgcgcaatcagaaagcaacgcaatgaattcctataagctacttgtttggtggagcagcatgaggaagacggacgtgtgcgttgatgcagaggcaatggacacatggtgccgaggcaaggtccgcacgcgccatgcagaggccactaggtattgccactaagaagctactaaaatacatttcataatgtaaaagcctttcctttcgcattcatctaatgatgtcaatttgaatcaaattagcaactaacaattcaattggactattttgatcaacgaaataacccaatatcgttatttgctttgtttcagccactggtagttgatcatgaagaccggcctagagaaagccatacttggcctatgaggttgtgagttgtgactccttacgtcgttgcgagagatacataggtagtgtttggtttgaaagcaagcttggatgggttttaggcatccatgtttttgggggatgatccaagttgcctgtctggttggatggattggatgaaccgattttttgtttgggatacatgttggatgggattggacgacaactaaaaagtttacaaatgcgaaaggaggaggctctattaagtaggggtgaaaacggtacggaaactttccggattccgggcctgttttcggaaacggaatcagccggtcggaatttctcggaaacagaatcgaaaacggaaacattttctcggaaacggaatcgaatatgataatagcagtttctgtcggaactcggaatcggtcggaaaaattccggaaaaaatatcggaatttccgaagttaaaaaggcccatagaatcaatagtctataactcgtccccaagttttaagcccaacccaaatcgcggcatctacccaaatagtggctaaccctagaggagagagacagccacacggcatcgcaactttgcgagaccgcgagccggcggcggagcatcgcgctccgcccaccgctagcgcccaccgcccggcgcccgcgccaccgctggtccgccatcctcggctcctcgcaacctcacccccaccgtcttcgccgtctcgtaccgccgccatctcgcgacgctgtcccgccgtttcgcagcgccgtctcgcggccgcggcgccgtcccgccgtttcaccgccgctaccaccactgacgacgacgccacagccacaccaaggagccgacgacgcctcgcctcgcagtcgcagcagccagcagcccagcggcagtagccaacagcccagcggcagcagccagcagcccagctacgagccgacgagcctaaaccattgatttgatttcttttgtgctgtagatttatgatggaatcatcaaatgcaagtagctgttttgtgattgatccaagtactgtactgatggattgatgtgtgctgctgttgtgtgatgaccgaaacaattgatgaactatgtactgatgatggagtgatagctcatagcagattagcagtagctcatagcagattagcactatagcactgaataatagtgtatactatatatcttatacaagggtgttttgctgtaattttttttaaatatttgttatgcaaattatatgaagttatagaagaatatattttgctgttgagacgatttcatataattgtgttttatgatgaattgttgactgttgagacttgagaattggacttgacaaaagtttgaagctcagtttgaggggttgttgtattccgataaattttcgttaccgtatccgcgccggttcgtttttgctccgttttcggtttcgataatattcgtttccgttttcgtttccggggtttccgattccgaaaaaaatatgaaaacgaaaacgataaaggttgtttccgtccgtttccgtaccgttttcacccctactattaagtccaagcatgtttacacaagttcaatcattcttacatattttagtgtttagataattcccatcctatccctttcattcattgacctatttctaatggcttgcctcatcgcatccttttcctttttctagacgcatatgccctgcagccctataatacaaaaaagcttggtcctcttgtccatctataacatagcgaggcaaacaagaacacactacagtgtcatacaacatagcgggccatcgacaccgtctccaatgcacatgtttcatccttattttttttcaaactacatatttaaaggaaatattaaaagtataaccatatgaacgtgttttttcacgacaaatctatcaataattcaatatcgttttcctgtcaaatcctaatattttttagtttgtttaattagttaattaaccagttattaatatcttcgcatttccattccaggaacgaacgacaacttcacaagtaaataaataagcagttcagatttatgtaagggcacaaataccaaatagatcatgtacaaattcacgagcatgaaaaatcatcactaataaacaacatcgctccatgaagactcgatcctcacctgcccgaggttgcggtgcgtggaaggaggagggacgacgcggccgcccgccgcccgccgccggctgtgagcgccgccctcgccgcgcctcctgatttcgtggataaggaggagggaagtgagtgaagggatgaacgggagatgtggagtggaaattttcgacagattaaaaatgtttttctgactttcggtttatttaatctgttacgtgaagcctcggttttcagaaaatatcagttctgtaagaaaaagccgaattaaccggaccggtttttcagacctgttttttttttcttcacatcaaaattgaaagtttgattgaaattggaacgatatgataggaaagttagaagtttatatgtgtaaaaaaaagttttaatggaacggaaaagtcggatgtttggtgaaaaattttgcaactgaacagggccagaagcggagcacctgcacgaggcgaggacagaggaatggccggaggtgcgcctgcttgcaccgccgatgtggtcgccgccgcagttcgctgggcattgggttgggttgggacacgtaaaagtcacttcggtgtctcctccacaagccctaatgtaggtgagaaatttgggattataccatcccacagttcgtccaaatgcgtttccctccggtttcataattatttattttatggtttgaacatcaatacggtcttcgaaatatatatatatatagttttcgcactaaacgcaccgtttagcagtttaaaaagcgtgtcacgaaaattttaatcttcatcaaactcttattggagaaaagaacgggacctagatactacacgtcagagtgcttaataactaggataaaatacaatttgtgcttgcttgcgccgagctcatggaggagggagggcgatcaagctcgaggcgacataggtgaatggtgagcaactgagcacagggcaggcagcagggttcacaattatggtctaactcgatttgcaaaatctttctgaaccggggcaaaaacacaaaccacacggttattgggtcaagctaaaaaaaacaaactgaatttaaaaatttggacaaaatttatcaggatcttatcggtttttgtggtttatcaatgtattccataaaatccgatgatattgctcgtgagcggattatagttgagttgggtaattcgtatgttttataaatatagtagcatagataagtaagagagaaattagactaaacataaactcaatcgtataaaaagaactactccctatatctagatatagatgtatttaacattgaaatattgtgaatattcctcaccttagccaatcaaactatccgtgtatttaacattgaaatattgtcaatattcctcaccttagccaatcaaactatccttgtatttaacattgaaatattgtcaatattcctcaccttagccaatcaaactatcctttatttaaattgtatctgaaccttaatccctccaaaaaaaaacctattatttaaattgtatctgaaccttaatccctccaaaaaaaacctattatattttggggtatatgtatcattcactcctccagccatgaatatagccaaaaccagccatgaacatagccaaaccaatctcaacgaacagtactgcacaacggcgtggctgcatatgcaattgtttggttccacttccactcagacgtaatcaagcaacatcagacaggagacgaggacgttgccgcatatacaattgaaccattgcgcacagatggcagaacaatagaaatggaattaacagagcagcttccgagctccgtacaagaacacagttagcagtgtatttatttggacaaaatgcactagttgaccaaacatttataatgttttaagtgcttcaaacaaccgctagttccagacacattgaagtgattgctcgacacatacgaaaccgagttcacaaagcagcataagagtatacatgcgataacaacaggaaacaaatgaagttacgctcgtactagattctacatatcgtttattctagcagtgttctactggtaattcctcccttgtccgtccctctcataagccggcacaccggcattgtagttatcgccgccttgctggtagctagggttgcctccttggccatggtagcctggtgcatagccagggttgccaccttggtaaggaggcgggttgccgccctggtaacctggccctcctccctggtatccagggttgttgccttggtaagcagatggtgggggtgggggtggaccttggtagccctggttgctaccttgatagccagggggtccaccttggtagccaggcgcaccgccctgctgatagtttgtatagccttgcggatttggtgcatggggctggtagtttggaggacctgcatttggtggtggaggtggaggaacattaccctgagcatggtgcatcggaggagcatcacgaggcgggactgggccctgacctggtgggggagggctgttgaatccctggccaggaggcacatctctgttctggaagttctgcatgttctcccttctcctctcaaaattccttgacctgtcaaagtttctaggcctatcattgcgccggcttctttcattggcacgcgcattgtttctcacccactcctcgtggtacttagggtcataaggaacggcttccccatttataaaaggttctcctgcaataaaagacaaggtgtcaaatacacaccaaatgctcatagatcacatctctatgattccatcacatggataaagacattacaaaacagataaaaataactatgaactcataaaactctgctagatataattatgaactaagcaacaaacagcacactaaaaataacatatgtattcaaattctcaaccacagaagatggtaactgccacggacagtccgcaatcactaccactaccatgacatatatacaactacaaacagaaggtccaagttaccatttactccctcaaaactagataactaaatagatattactgactcaagtttataaagtttgcttgaactagttgatttcactgcgatgactactgataatcaagcaatccaacttatcagatggtctagggaagaaatagcaaactaaatttcaagatatcctagtactaggagatttcacaggatacagactccaaataaaaagttcagtggtatgctagaatacaaggtgacaccagagcaatcagcagaagagttccatggtaaaacatatacttgacgcagaaaaaacataacctctataaaacaagagccagaaattatcagttcaaagcattgcacagggacattagaattaatcagtttgatcataatatggcatcatacacatagagagcaattatcacagaggatctatataactaacacggaaatgatataaaaacagttcagaaaagaaagtgatgatatgtaattcaataggaagagaatgaacatttacctccgtagtccttatttctgacatccaggtatgagtctggaagaacccagcggaccttgggcaactctggcaaaataatttaatagcacagcgttaaagcaagaacacaagtgacccccataaaacatcccctacaaagaatttcatacaaccataaatacctttgagtttgtaggagagttcctcagatacaagagctccaaaagcaaagtaatgccgagttgacactgagtagatcttatgccttgcttcttcctcactggaagaaaggacacatttggttaaaaagaattatgagcaatttatataatggccaatacccagggcatatatcaagaaaataaatgaataaactaagcaaataaattgttatacagtaggacttacatgatgcgataattaaagagaaaccagaaaaactagcacatgctaccatgaagatggacgcctaaatatgtcagtggttgacagaattaatagaacacaatcaattttcaaaacagggcatgaagcatgattaaaaaacatcgtgttgataacaggagggcatgacctcccttctaatttacaaatcatccccatagaaataccaatttattcccccataataactaactacatgcaacaccatgagaccagattaatatggaaaccgtagcgaatcaaaagaaaatgacaaatacatgtggaatctataaataaaatcccagtcacatttgtgaaaataaaataaaatatgcatcaacagtacagaatacactatcactgaaacaggtatttatcagccaatccaccacagatgaagttaacaaataataccatggaaaaacttcacatatcacctaactataaatatccccaaatccacttcctccgtcccatttcctcacccccaatcacgacccaatcacgaactaacagattaaatcgagtgtttccacgaaatcccacggatgcgagatgcgcgtgagagggagaagggggggaggatcgttcaagacggccatatatacctcccaaccacctgtgcgagggttttgatgtagccgtcgataatctcgtcgcgggtgggctccgggttggagggatcgccggggggcggctccacgacgaccagccagtgctcgaagtcgcacccgtcgaggaggatcgtctccttggggggccggttgctccagttcggcgacgagtcccgcagcgaggaggtcgcgggctgcgtggcgaagcacctcgccgccgccgccgccgcgcgcggggcggagggggcgagcgccgccgggaggaggctccccgcggcggagagcgggcggaggaggcgggaggtggaggaggcggcggcggcggggagcctggagaggaggaggaagcgcgacgccgacgccatgggggaaaaccctagattgggaatgaggggggctgagggtttaagcctaatccgggcaatcggctcccatttttatagccgcatattatatattcctcgggttgataatatttttagttttggattagggataatttccaaaacatttgctttacacacttttcggttaattaatcactctactatttagagaatgagagatgttcgaaaaggatttattaaagatgttcaaaaagaatttattaagtgaattatgtatgatgatgatttaatatgtttgtatttaaatctcttaaatttacaatctaataaattatagaatcatagataatataacatgctttgcctctagaccgcctccggcagcatgccccgccggaccttgtcggtggcggcgtggaggtaggtgatcccatcagcgtcggcggggcggagcccgatgttctcccagatcgagatctagccgcgcggccggaagcgggggtcggccagcgtggggtcccgcgggtcggcggtggatgcgctccagcgggagcacacggcgtggaacgctttgtactccctcacgccggcggcgagcagccgctccgcgatgtggttagcgacctcgtcgtggagcgacgtccagtcccgctcctccacctccacgacggccgccgcttcccgccgccaccgaggcaacacgcacccgccttgcgcttgccttgtacgttcatcccccctcttcctccgctgtcatcgcctcccgccccgccggaacaaaacaagggtttatatagcaactccggggaacccgcctccgatccaacactcgatgcaactcaatcgatctccgaatccgattcataatacaacagtgagcttggaggacaagggtgtgtaggaggagggaaaggcggtggtcgccaatctcgccgctcgccggggtctaccacaaccggcggccatggatgacggcgtggtagggaatgaagtggagacgagagagtgctggactggtgtattatatgtttttagttttggactatgaataattttcaaaatatttgctttattacaccttgttcagttaatccctctcacaaaagaattaagagatatttcaaaatgatttattccacacctattatagtgtggaattatgctcctcaatcttcttcaatccctctagtttgattgttaactgaacaagactttagaaatatgaaccataggatataggcatagattaatcttaaaaagtaatataataaaattatatatttttgataattctatatagaaaattatataatggttaaagttgctttttaaaaacatgttattgtctgaaataacgagtattattaagagagtaatctttttttatggaaatatctctaccaaataatagtccttttagcgaaaataagtgctcctaattttagggatagagtacccacagatgttggtcaccttactaatcttgagaaaattgcaaaattttcaaatgaatattttgctgataataatccatatttgatgctttggtttatatttaactccaagagacaaattattctgttcagaataagcatcacacaaaaatcggccccttacaccattaagtcaagtcaggcatgggctttggcccagacaagtcaagaaaacggtccactagtctctggcccaaatgaagaaaataccgcagctcgtttcagtaggaataagttcatctgaggcccttaacttgttaacggatccgattttcatccttcaaccgaaaaaccaaatccaacgagtccttctactgttaaaatcggtgcaaaataagtctcaaagcggtttggacggcggtttcagatgacgtggcacctacatgactaaactcagtcttcatttgacgtgacacatgaatcaaaatttaacaattagaaaaagaaaacaaaataaagtctcacccgcttctgtaacagtagccatcatgttgctgatgctgtgttgcaagatcaaagggatttatgacttgtgaggaagaaaagagtaagttcgtcgtctctctcaagggcatgataatgagatggtgttcacctatgatcctcagtttaaaattatgagtactagcttattctgaatttgcatcgtatgaatatagtaattcacaagaattttcttaaaatatcttgcatttagcagatgatctagagtattgtcttgtcttgcagaagaaatattactactactacttatggctagtgcagatgaggaacttgtgatccaagttagcaatggtcgggagtgaagctaatcattctgttttatacttcctactctctcttaagacccaagggattactgtgctccagatctgcatttgcgtgctgcaatacaatgtgcagccagcagcagcagcagccttcagcacatggagttcagtagtactgtacttcatgctcatggccctcagctgctgccaaacaaacagctgaaggagcaagcaacttagaatgaaagctaaccctggtttaccatcatcataatcatcatcatcaagagcttgcacgcatgcattgcatggacatgtgccatgcatgtgaccaagcaaagaccttaatcttctcctggaaacaagtccctccaaaagtgagacacatcacatcaatgttatcaagcaatgcaacaatgttttgttaccctgatcaaacaatgcaacaattaaagctaacatctctgcatttaggacaggaatcacaggcaggatgtttcagtgctaatctctgaaaacttctgaaactttagaccagtgggagacctgctggattgaaaggagaatcactgaataggtcagcagctttctgaccagtaaaaggagtgagaatgttcaggctttggccaaaactaagatgagaaagaaagctaatttaaggccacttgcacacaaatcaacttatcaaggcaaaagaaaccctgcctaacctgccaaacatactgtcaaagttgagtaatttatactcaatacatgttcagaaaataacctactactaattgaaaaataattacctctagctttgagaagtttacatgtcctgatcactaaaagtgactaggtcctaactcctaattaaccaagccgagcttgaggcggccaaagcggatgaaatcattgggcatgcagtttccggggtcctagctgcttatctggggacagaaggcatcaacccaagcaagatcatttccttttcttcaataatatttgcctactagatgctatgaccctagccatcttttcaggccaagatagtactagtaatcaactcaaagatcagtattaattaaggttggcaattgcagtgtttgcttcagttcatgggcaagggtctcaccacgcacaagtcagaggcacccgcactccaaaggcattgacaatctgccacacaaggagaaagcaacccccaagtacccaaccacaatatgatttagagatcgttcagtagcagtagcagtagtgtattaattagtcttaagctttcagaaataactccagaaaacgagcgatgaacacaccactgttcacacctgcacacacacgacatgatcgatcatgatcatggcgacatggatcgatcgatcgatcggttcatcgatatgccggtttccgggttcctaagttaacaccgggagaaatggaaatggcttgtgttagaggaaatgtaggacactctagctgattgatctgtctctgcttactgctactactcatatgattggtctgtacctactgctgatagatagctttttctggcttgctctctgcagctatctaactctaagcctcagtttaaaacaaattattgagtggattgttactacgaattatctacttgataaataaacttggtctaaacaatacagcaacacaaggttttttaagaaaatttatttttcggagcagaacaaataatccgtttcaatgttccggtaaaaaatctgaaaagataagcctaaactagcagtacctgaaactgcacttgctgtttgtttaaggaaatgggagcaatgacatcaggtgagacagacaattgtgtgagttgcaaattgcattgctctctctctcccctgagccacactgatccagctagataggtctgaaccctgaaagaaccctcaggacacactcaatgtttcatggaattcggtcgggattcgctcgaggacgatgccgactcgcgacagcaagtcgacgaatgagggtcgtggagagaaatgagattggtggggggtgttctcatcaggattcctatttctggtccagcatcacctgctctcctggtgcccagccatgtgttgtttgtggccattctgtcaacaatttgcattattgaaagatatagtgcttggaggagttgaaggggacctgttgcttgggcacttcaacttgagcctaatttctgtccccatttctcctcaagtgtaatcctgaataataaagattcgtactagtctccctctcatgcacttggtttggtttcatgtgctacttagttacatgcaccgaaacatcgtcgataattcatgaatggtggaacataggtaaattgtgcacgagagaaggtgattccacgccactaacttagagccagtaaggtccctgcgccaagaaaagcttagatgactggtttggaaaatttctgaaatagttgcatgtttatgcctaacaacgttatagagacaaggatattgttctcttaaacaggcattccccaaccatttatcttcccaaaaccgaacttgagagccatctttgatgttggaggagccaaacctgagaaaatcaggcttggacttcattagactagcccaaaagtgtgagtctcctgctttccactgagcttgagacaaaggttgtgacctcaaatatttgttccttagcatttgttgtcacacaccatctgtagtgagtagtttatgcaaccactttctaaggagagccttgttcttaattttaagatcttgaattcccaaccccccttggtctttaggacgacatatgatgtcccaccttgctagtctatatttccttttgtgtccatccccttgccaaaagaaccttgatcagaaataatcaatcttcttgatcactcctttaggtatttccaaaaaggacatcatatatattggtaggctggtaagcactgaattgattagtgttagtcgccctccaagtgataaaagtttgtctttccaacttgccaaccgtttttcaagccgttcaatcacttccttccactccaaattacgaagtctcctatgatgtataggaatgccaaggtaacggaatggaaaagaaccaacctcacattgaaaaaggttagtatattgatcatgagctgtttgggcttcaccaaagcagtaaagctcgctcttatgaaaattaatctttaagccagataattcttcgaaaacgttcaacaacattttcagattacaagctttctctagatcatgttccataaagagtacagtatcatcagcatattggaggatggacaatccaccatcaatgagatgaggcaccactccaacaagctgtcatgcattatttgctctctggatcataaccactagcatgtccagattatattatctcacgaccaagatgagtttaaatggaatctaaccactgatggcagattctcggttaaatctctttatcttgcgttggtgcagaccgatgttcccaatataaacaaaagaatctggaagatcaaagccctcctaaagattaagatcttcttatggtacttacgtcgtggagtagtcttaacaaaagataatcttattaaaaggaattggagaggaaacaagtcttgttctttctgccacaaagatgaaactattaatcatttgttctttgattgtcgttttgcccatgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgcaaaaatgatgtggtttttgaaagaaaaaacatatcttctcctttgcaggttatctttttgattacacattggctccgctcatgggctatccttcagaaggtcaatttgcggggaactatcgttgtggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgagtgcagaagccggaggtgctctcagaataattgtatcacttgatagaattttactgagattaataaagcttccattatctaaaaaaggtaaattgtgcgcgcttcctcatcgtcttatgcttttaggttgaactggttggttgtaactaagtatggtataaaagccagagcttttaagttcaaaaacctcatttttctcaccggtttaagcttttgggtaattgggttgaactggttagtgcatgaaattcgataataaaagacacgtagttatcgttgttgacgtcataggttcgaaacccgggtttgacagcgttggcaacattgcatcgtcacatagactggtagacatctagatgcaatgaaaggtaataacactgagcaagttacctcttggggggtaaaaatgatccccttttggcacaccaaaaagtcgccgaatttgattggagcaaggcaagcaattccattccacaagcctctcctcccgctggagttattccaatccaagcctgctgtatttgtcacggtaatggcgacaggggagcccggagtttttcaccctgttgcttgcacggagttgctctgtgagctatgcttggacgtcatcttccccggcatggtgcgatgctgtgacgtcaccaactcaccattctgtttaacctgctgttgttaaatactccatccgtttcaggttataagatggtttaactttggtcaaaatcaaactactttaaatttgactaagtttataaacaaatataataatatttataataccaaattagtttcattagatcaataattaaatatattcttataataaatttatcttggttgaaaatgttattattttttctataaacttagtcaaacttaaaacagtttgactttgaccaaagtcaagatatcttataacctaaaacggatgtagtatttaaatgtggctttgcggttaatattctcacttttttttgaagagaaaaatagcatgagagtgtgtctttttcattaaatatagcggaagaacaatacaatcctaagagcgaagaaatataaaaggccaagaaattatgacactatacgaggtgcgattaatattctcactcgtttcgtgtagattatgccctgctaatgctgatgaattgagaggagaaaaaagagtgtgtctgaaccaatgggcattggatgagacttcatgagacagttatttcttcctgtgcataatcacacaaagaaaaaaaatatccatttcttcagaaaattcaaagagaaaccagtacaagttacttcctctgtcccagtttactagtcgttctaggaaagagatgacaaaatatggtgttggaaaaatgaccaacgtgcccctacattaatcatttcaatgcttaaaaattaacacaaaactagtactgcgtctgttattccgatatatctgcaaccagcatggggaagaaaattaatagaagtactcataatagtggctagcctgctagctgccctacgcctaaacgaccttctttctgggacaataactctacaccccaatgacaactaaaccggaacggagggagtagttatactaggaagtcagatgctgatgcagatgaatcttaagtcagataaaatgttttttttacagtgcccttgaaatatctgccaggtgtgtgggcccaggaggccctaagattcagacattggagatgcttggttgcttggaaggagggggcaggaagcaactcggcatattaagcaacggccaaaagagtgacatgattacaattagaagcaagaaaaggcgctaatgattcctcctaatccacacgaagtaccacggaagcacgcacaacacatggcgataatcagctctgccaattaagccagttgattagctcacaaggcaatcactgacaagaacatctgcacctgtgtgcgtgtgttcctcctgtcagtcacttgcaagctgcagtttgcatagggcacatcagggtcgaatccgatgtgcaaaaacgagcaaagtgccaatcctgaagtttgcttcatgatttttatcagaaaaaatgtttttaaaatgaataaccagacaaaaatgtccctaaaaacatggaatcatatagcaatcatagaaacaatagtactcaattttttttgtgcaatggccaatgggcatataaatccaagccatcgagtcaagtgaattgcttacatggcatgattaacaattgaccataaaccctctagtctatcttaaaaccaaaataaacaattaattaaatctctgtcaagcgctacttggattttttttctccactttctgaaaaaagagggaggagaagaaaaagtttttgtatcaatcagaatttaggagacatgtttagggtgaaacaagattggatcatgtcaaatcggagaaggaatcatactatttaagcaacaatggtggcaggattggagtctgctccacgccacatggatcctataaattccccgcccttttcttctccactccactcatcatcaaactctctctctctctctctctctctctgaatctctggatctctgaaaactctgaacattccaagaactcataagttacctgtgatctgtgaagcttgagctgaagctgtgacagtgtctcactgatcgttgatcactcagcttggctgctactgtgcattcactgcgtggttagctagctaactgagcagaagagctttagcaatggcgacgccggggcagcagctgccgccggggttcaggttccacccgacggacgaggagctggtggtgcagtacctccggcggagggcgctgtgccggccgctccccgccgccgtcatcccggacgtccacgacgccaccgtgctcgacccctgggacctccccggtgcggttttcttgatccgttttggtttcgaggaggtgcggcgccattgccaagctcgaccgagcgggagactgatcgtgaactctctccttctgtgcaggcgccggcgatggtgaggcctacttcttcagcttccggcagctcgcggcggcgagcggcggcggcgggtggcggaggaggagggcggggagtgggtactggaaggcgacgggggcggagaagccggtgttcctgcgtggcttcgggtgcggcggcggcggcggcggcggcggccagcacctcgtcggcgtcaagacgacgctgctcttcctccgcgcgaagccgccgtcgcgcacccactgggtcatgcacgagtaccgcctcgccgccgccggcgctgtcgccgtcgccgccgccggacagacaaagcgcgggaaccatgtgagtctgaattctccaattcttcagtaataacactaatagtactgatacatgtgattaagtctaatgtcattctgaatcatcattaggttttgcttcaaaggttcaaattaattaaccccagttttagttcaaacttttattagaacaaacttagcatatgtatgtgaaatttttgggtaaattaactgaagagaagtttgcagcttttgcaaaaggctttccacagcgcacggcagcatctcaatcatgcagacatgagagaatctttgcctcctttcaaagtaacttaacctgcttggctacgtggattaggacacttcactgtgtgcggccacttgtcttgcattgtgttccatcaaaaaatttaattgaacctctttgtcactcacatctcatctactagcatgcacccgtcgctgtaaatttaaacacgaattcagttcagttcagacttgagagctcaatttgatcatctggaatctgatgaatggtatcattatgtttttctttgcagagttgcatggctcagccaggagaatgggtggtgtgccggatttttctgaagaacaacaggtcatcaagaaggcgagccggcgacgccgacggcgaaacgccggtcaccggtgtccacggtcaccgtcggcggcagccgtcgccgtcgccgtcgtcgtcgagctgtgtcacggctgaggtttcagacggagaaggagaagaagaagtcagcagtggcagcatcaatggtgctccatctgcctctcaaagagaggcctagacatgctgaaaatctccttaattaattactagtactagtgattttttttcttcttcttcttgttctcttttgtccctccattgcttttcctgtacttctccttgtaccataatgattagtaggagtttaagtttaagcagcaggttgaagagagaagccccagcttaagaaagctcctaagtaaagattactgagcagcagctgtgacatctgtatcaattgtaacttgtaagtttctcttgatcatttattaagataaggaacctcaattaagcaggaacatcagatcgatcaccagttgctagctaccaccagctaccattattcagctgtcatttctgcagcagtcagattaactttagtccaaaatttttctctgcctcctctagctcccaacaaaagcctgtcaactctctgtttgaagaaaaaacgcatgtatacactgttttagatcagctgaaaattaacttctctacagaaatgaaatcatatatctgtgtaccaaaaggtgtgtttagttcacgctaaaattgaaagtttaattgaaattggaacgatgtgacggaaaagttggaagtatatgtagaaattttttttttgatgtgatggaaaagttggaagtttgaagaaaaagttgggaactaaaccaaaccaaaatggtcaaatgcctcctccacgatatgagcccgatcggttgaccaatgatggattatatgctagaatggctttagtagcgatacaaaataatttatgagtaaaacttttatatgtgtctctagcgacttaaagatcaatgctgaaaagaaaacaaagtccaaaataccttaaaatcaactccacaatcaagctttaaattttaaattttggccgcgactgattcgttgtaagataaacgatgatgcttgagacaaatggcctccctgaactggagagagagaaaaaaaacttttgcagctttcaagaggcgaaatgagaagtttgatcagcggaaggaaggaagggaggaaagaaggacgggtccccctggctcgagcgagtcaagtgagagtgagtgacagacacctgcgaatccaccgcgagatcctggcgttgaatcgcggggcgctctgccgatcacgtcgccaacagtgtgacagttcagcaaagatggcgatctttcttttgctctcgagtggcctcggtactctgaactcttctgaagtctgaagtctgaactccttcaagtggcgatctgcatatagatactagaggttgtctcattatttatttgctcccgattactgtgaatagtaacaagaagtagtattatagtagtatgaatatatttttctgaagaattgtgacatctagtatagaaaagaacgcagtaaaagttgagaaaccagaagtttgcaggcattattttttatccagaggcaaatgcatataaggaagtgagggagaaggtttggtctgtacagttaaactgattccgctccctttgtcgtgaaaatacaatctcaaagacatgtttatgttcttacattaaaaaaaacctcaaaaacttgtttatgttcttaagacaaaaattactcgtccctacacaaaagtcaatccacgaattactcctttaaatattccttatggtggttttctaaatgtatagttgtagcggtagagtcacgagtgcatgattctactcaccagagtttaattccttgtgtccataaatatggttatgttcatcctcgttgatgtagagatgggagttatacatttttcccctttttttttgggatatacagttcccctcgcaaaattcaggtcgttaattggaaaaacatttatgctaaacaggccgtcattacggtgatagcaatacgaaagcccatcacagcagtctcccctttgacgggccggcccaattactcccacaaaccaggctgggcctttgggccaatatgtaattacagtaattattccttatactaataataaatgcgcattaagctggggggctttcctgcaaaagagcgcggaaaataaaaatctcgcacagaggcgtatccacgctttccttctcccctcccaccaactaatcgatctcctctctctctctctctctccctctctatcccattcgcgaggcggcgtctcctcctcctccccgtctctctcgcttcccccccaaatccggcggcgaatccagggccccgcgccgcgccgacgaccaccgccgatcgcgaccaggagggaggatgctgggcgccgcgaggaggcagctcggatccggccccgtgagtgccgacgacctcctcggttttttttcctcgctcgctcgcccgcccgccatccctcggatttcccggggtttggtgcggttgggtttcgatctgtgatttggggggtcgctgacgggtaatggatggcgtgtgtgggggttgcagatgctggggcaggtgctgcggaggctccggccggcgacggcggctgcagcggatgcggcgagggcgtactccgcggcggcgaaggaggtgagggcctgggtgaaccctagtttttttttaattattttcattcgtgctcgctgcattggtgtggaatgaataatgatctggtctggcccgcggaattgcgttgttctgtttgttgacgggaaattgggttttggtggttggttgtatcattgatgtcgtgtattttgttgtttcggtagtattaacggagcgaattgtttctagtttggtgttgaggtggttggggatggttattggaagtggctgacggttcatggagataatgtgatgttttaatgtgtacctatttttttggttgagatcaacttaggattggttttgatgtcagttcttatgtatagcacaatggaattaggttatcccgattgaagaatagaatgttgtcatgttttgatgactgctgatttgtagccacatgtagactcgatgtcggagtgaactgatatctaaactgcctatagatgtgggtcgcgtgtccaaatttcccacagacagtcaggctacagggttaacagtttgtattgattcatttggcagtcactatactagacgtggagatacagtctcttcggatggtattgtgcggtttttctttagatgtatcgttgtggagatgtagacagttgacttcaaaactggtgactactatatctgcatagttcgattacttcctttggggcgtactgtactgtacttgtgttggtggtttgtggtgatttaatttgtatatgctggaaggtcctatttatattcctaattattttgttggtaagccggtaatgatttttctttgtttgataaagatgtattgttgtctggtaatcatgtctaacatgtttgatctacattgcttgctcaccttggttgttatggcgcactaggcggccatggcccatggcacttgctaaatgaagcaatttctatcgcatcatatatctacatgcttattcctttgcattgttcttgcccttctcattggcgtttattttttcctcaattacttatcaagttagtagcacagtgaatgaatgcaataagtgaagtatctgctggcttgctctttgcactgaaaggatcttcatagtttgttgagtgggcaaaggggaaaaatgacatttctatattaaaatttgtttttctttgttgggcaccttgatatggcaattggcaagttatctgcaacatattttacttattcagatgactgtccgtgaagcgctgaactctgcactcgatgaagaaatgtctgctgatccttctgtttttctgatgggtgaagaggtacacttggaactcactcactttctctccctgatttgtgtgtttttctaaggccttctctttcgtggcaggtgggagagtatcaaggtgcatacaaggtgtgtgaagttaaaaaatattagtagttgtgcctttcctcaggtccgctgtaaacgtattagctcttatcgttgttcatgaagtgtattctgttgcagatttcaaagggcttgcttgacaagtatggtcctgagagggttctggatacaccaatcacagaggtgattctaaaaaccttcttacctacctttcttttctgcccattcacatttttttcacactaaggtatcatgcgttcatgttctagtacttatctgcttcagttctgcttttccaggctgggtttactggcattgctgttggtgcagcgtatcaaggtcttcgacctgttgtagagttcatgacattcaatttctcaatgcaggttggtaatgcacgaattatcaatatgctactatgatagtggaatcagtttatattgttgcttgcagcaacggattgctgttgaattttatattagtttttgtctatgtaaagcaatgtaacacttaggtaagtatgttgtacaactagtttgttaatttgctagtatagattatctttcctgcattttagttaaaccatactctaatccatattgtacacatgcttgataaagtgttcgtcactcaggatctagtgttcggaggtccaccttctttgataagaaaccctcttttttttttctgaagcttaataattgacatatatttatcaggtgtacctcattagtgtttacttctgcattatttgtaccaatgacatatttcagtttttgtatgctgtgatttcgttttaattatttatattacacattcaggcaattgatcatatcatcaattcagctgccaagtcaaactacatgtcagcgggtcagatatctgtccctattgttttcagaggacctaatggagctgctgctggagttggcgctcaacactcgcaggtttgtgatcagggaatggcttatgaattagtttatcatcctaggaccccattgaactttgtaaaagttcattgtttccttttgttgtgttgttctacccagaaactgtcctggatgatctggcaacctctttgctaatgctgaaatacttaatatccccctctccccaaaatgctggtctttaggtgtagaaaagaaaccaaagattaattatgagagttctttacagcatgtgaagctgcagtgagctgagcaggaagtttgactgtttaagatcagtttgccactagcttttatattctggctttttaggcatcacttgtttttgataaatcatggtagaattattttgccacttaaatatgtcattataattgcaattattcatttacaaactgaattggtttgcagtgttatgcggcttggtatgcacatgttccgggtcttaaggttctggttccatattctgcagaagatgctcgtggcttgctcaaagctgcgattagggatccggaccctgttgttttcttggaaaatgaactgctgtatggaacatgatcttgttatgctatactgactagccgtcatttccccaagatgctgatatactattttctgcagctatggagaatcattccctatttctgctgaagtgcttgattctagtttcgctctgccaattggcaaagcaaaggtatgttgtactagctgtgtacacatgtttgggaaagaaacatacttgcatagaattaccttgattatttcacaggagtcccttttaatgaacaccttgttttctagataagtgtataccagatacatgctgatatatatttctgttatacagtcagtgaagtttgatgtacttacctgtgggtcttctctctgtagatagagcgtgagggtaaagatgttacaattactgcatactccaagatggttggatatgctcttcaggtgcgtcattttgtaattggtaaacaatatggatgatgagtatgttacgtcgataactttatatgttttggctcatcatttgcgcagttttctatggtgtggcatatcatatctctgtaaattctgattactgtatgtctgtagcggcacttgtgagctatgccttttgggaatagcaatttatttttcattttgtgcggatagagggatcgtttatcaaacagatggttggtacgtccataagtctgatagttaaattgatctgccatattgttcctcagaaagtgtatgtttctttcagtttatgctatttgaggttttaagtagtaccagcggtacttaaaatctttcacatttatgattgcaatattacttttctatgttcttatgctcaatttttttcaggccgcagatatattgtccaaagaaggaatcagtgctgaggtgatcacttgttaaacaatttatgttcagtataataatctataatgcatcaatcttttcaaccacatactgcaaaagtttccttattttttactgctatttgccaataggtgataaaccttcgttcaattagaccacttgatagagctactatcaatgcatctgttagaaaaacaaatagattggtgaccattgaggaaagcttcccacagcatgggattggtgctgagatatggtacgctctctctccacatgcattggcacacctgtgtgtggataaggacttttagttctgacactcgttttctttgcagcatgtctgttgttgaggaaagctttgaatatcttgatgcaccagttgagagaattgctggagctgatgtacccatgccctatgctgccaatcttgagaggatggctgtcccacaggtccttttctgtttctatccaaaattttatgttgtgtcttgtacacatgttttgtttatgattcttttctccaccgatgcattttgtgccaaggacttgcacagagtagcactgtttgggtggaattcctagttttattggttgcatatatttatttctgttgacataattgagtagtagttacttccattcaacctttacattgtggggtggacatgtgctcctatttcgtgaagttgtgctgaatttaatgggagtgatgatttgttttcttcaagttgctctgtttttatttatgcctaaagccatttgattggtgcttctgaagggaatgaatatagtgaatctgatattagcagggaataaagaaatatcagttctatttcgtagttgtagtggcggtgttgaacaggatagtgtgcatatagtgttgattactggctgaccttgagggtcattccgatccaggagactctgaattatgaagatggaacctttttttaataaacagttaccatcattgtcataaccttatttgttaaaacaaatcgatttgtgtgggccatcctatgtgtctggattacaaaaatatttgcaggagcaatgtttcagtagagtaaggaaaaaagtgtggggctattgacctattgtagtttttatagtgtataatgtagaggttgctatacgtgcatacacactcataaatagaagtatttccttgattgccctttccactcaacaacttgagcaatagatatttgatcataagctggaaagcatatggcacacttgtcatgggatattacctaactgtactatggcttttagttaagactttctggtggatgttgtctgccacccagttatccctggaggtgctcactattaagaagttggtaattctgtcctattgtcggtttgtgtgttccgggtgaccactgtgatcagggtggtcatcagcatttcttcgactctttatggtttgcagaatggtggaagtacttgcggtactctttagacactggttcagaatcacatttgatttctgcactagcaatattattaaatatacctttaatgtaaatgaaatgtgaagtctaaactccgcttgcatgtttttttgtttttagctgtacctacagttttaaactggatctacgaggctatgcaattgtgaaatgcatggacctgcatcatttattatcccttatatggatcaactatgctgatcatttctttatcttcatttatattaacgacgttattgttgtgcttgcaggttgacgatattgtccgtgcagcgaagcgtgcgtgctacagagcggtgcccatggcagcaactgcctgataggagagacctcttttacatcatctttcttttcccgtccggccaacatatgattcataatggtgtccaacaattgcccaaactcaaagcgagctaattttgcaagatatttccatgacccccacctattcttttagctgcagttgcatcactgcgttcgttggtggtgacccaaatttccctctttttttttggtgtgtatgcgagaattatgcagcttatggtgattggttcacagtacacactggcgctagttacataaatgaaagaaaaatctgagctcttgatggacacatttgttgcaaaagacaacgagggcaatgaataatcccaacttaagacaacgattgcgcatgtcgcatgttgctattcgcccaaaatccggggtctaaactctcacgatagtcaacattttgaactgtctaaaacctctcgctgttgatgtcgatgcctctctctgatcaattagttttcaagtttttttttaatcttttcccaaaatcgacttaattagccgttatctccaatccaatcttgtatcgccgcaattactaacgatgtgatccccaccgaattgctggtataatagtgacaaccttttctttttagtacaacggtacagctaactaggaagacctaaatgattttttggtcaaacggtccgtgctaattgatcacggatctggtgcacgtaaccatcaatcgctataacaattattgtaacatctctcatcacctaacagaaaatcacgttccattacattatactccctccgtttttaaatatttggcaatgttgatttttagcacatgtttgactgttcgtcttatctgtgaaatatgtaaaactatatgtatacatataagtatatttaacaatgaatcaaatgataagaaaataattaataattacttatttttttaataagacgaacggtcaaacatattttaaaaagtcaacggcgtcgaatatttagaaacggagggagtattaaataagaaaacagcaataaaattcagctggaaaaaggtacttggttgatccacgcacacttgcggtcgtgcagaaaatgtatttttcttagtagtactatctcatcttttttgcccttttttccaaatctctccctttgactggaccatggactgcaacaagcaacaactaaagaaagaaaagacattaataaagcagcaaagaaaagaacagtccaattagaaaaaagattaaagtgcaaataccaaagccaaatcatccctattattatatataaaaaggattagaaatattattatttgtactaccaaaccgagcaggaatgtgtgcaagcaaggcataaccaaaaccaaccgctttccttttgtccaccgattgctctctctttgaccaaacaaagaccggggcagcttaaataaacagacaaagcaatcgaaaatactaaaataaaaaaaaacgaggcactaattaatgtcctgttcacatctaagaatttccaaagctagatattcctcgcttcacaaattcatgaatataaaatttgcaatcacttgataacatttgtatcaatcattttatttctactttaaataaaatacatatttaaatcactataattaaacaaacaaacttcaaattcaaattcagcgtgaatctaaaatctaaagctgtgccaagcatggtttggcagtcttgcctacaattactccttaattaagtcaccataaacacggcgcgccattaggggattaaagaaagcgcaacagtacgccactcgcactcgagcccggaaagaaagaggcaaaaaaaaaaaaaagaattccccatttccttctctctctctctctcatctctctcagtgaggagtggtggtgtagctaagctagggtttcgctcggaatcagggttcggtttcctccaccggaattggcggcgatctggagctcggcacggcggcgcgcggcgtgatccggacgctcgggtaggtgagggagggagggaggagatgaagtcgtcgctgcggaagctgcggggcttcgcgctgcagcgccacgagcagcgggtggaccgccgcgggggccactccccggccgccgccgccgccgcgaacgagctcctcgccgcctcgcaggtgagggggcacctgctccgtacctcccgttctccgtgtgggcgcgtgggtgagcgtgcgtgtgagtgagtgagacttggcgtgtggagatctctctctgcgggagcggttctccgcttctctgtgcgtgtggttggctggctcttgggagtccgcgaaatcggttcccgaatcccgattggttgtttgtttgtgcaaattgtttttgggaattttcgttgccgatggagtactatgggatgatgtgttcggatctgtgctccatgttctgtagggagattgttgaggaggcagacgtatggagtaagttccatggcgcggtgtgcttgaactgtttgtttcctgggtggacactgggaacactcgaatttcgcagtcttatctgctcacatttgccttaacgagcagagtttcatgtaatttgagagaaacattcctttgatcttctactcttgagtatggagttagcaaaaaaaaagaaagatcaaaacaatttagaagtttagttgcactaccatcgtagccgccgacataattcacggctaagctgaatgccttgtagtaatgatggccttgtcaattctagttggatctgacaaggtagtgccccattacctagtggcgattgcttcattagtgtttgatactagttgaaaaccaaaatgctgaatgagggaggttgtctgaataggtggaaacattgatgacatatgagaaagcatgtggtacatttttttttactacagtttagtcttatcaaatctaattggatatgacaagggagtcgctgctcaccattacctagtgtccttttctaattgttgaaaatcaaaatgctggaggagggtggtttttggaataggtgcaaacagtggtgacatatgagaagcatgctttttttttaaccaacagtagagcttaatccagattccaccaagtttcctctgttaaaactttcccttgttaggttcttactaaatttgttttaaactgcaatttcactttcaacaggatatggcagatatgaggagctgttatgacaatctgctttctgttgcagcagcgattgcaaatagtgcatatggtatgtttattccccaatagtacattttgtcttttgagatcagttaagtatgtgttcaatcctgtaaaaatatttttttgtgtattgttgccatttcattttacacatgccctgcaatagaactaacaactgcccattttcaaatggataaaaaacctcaatgtttcttggttaatcgagaaagcatttaagacgaatatttcatagttttaatctaaagtacagactacagagggtgcagaaacttaggtgttttatgagttgttcaccaattcttctcgtgtatagcctcagttcatttgctcttttttcatatgctagcagctttattagttcttatgctaattgtttataaggttatagcagctagaaatataggtgtcttgactcttttttgcatatcaatgatcattttatcctttcatgcatgcagagttctcagaagcactgcaggaaatggggacttgtttacttaaaagagtcacaccaaacaaggacgggattaatggtaattatgttctgttgtgattaatggttctcactcccttgcataaacacatatcttgcaaattaagctcttcatgaaaacgacaaattgagccaagggaagttgtttgtgcccattctcatctgctagttgatagtcactatctcaaattgtgaggaaaatgaataaaaataggataatgaggccatcttaatgttattgatcattccatgtaacttttgcctattatacactttgctgcttaatgcttacattgaacagtatcccccagataaagttttgctgttgcttggaaaggcccagtttgaactgcggaagcttgtagatagttatgtaagttttaagttgtttatcggtggagtcacttatttaccataatcttctactgctaatcaagtcactatatttttcccagcgtgtgcatgttcttaataccatcaccactccatcacagtcccttctcaatgaacttcaaactgtagaggtatgttctcccattctaataattttagccattatgtacaattttttgtgcatattccctcttatgctcatgctcttttctctggggcctattccttccttgttctatgtcgttttactatttccccccctgccctttttaccctgctgatcatatgtacaatacatgaactcgctaaaaacaaaagtttggctagtaaacactggtctgtggcatgaaggaactcaaatcaactctgtagtccacttcattaatttgggttacattttattataaagtgtattgctgatcattcaaatgtggttttacataaactcattgcaactccaatggatatacatgataatctgaaattgtgtgtgtgcgtgtgtgtttttttccttttgccattcagtacaatccctgtttaaagggagcattcatttacttaaaatatagtatacatattttttttgttttgtctactcctatgcagattaacacttcacagctttgttttgtcatgttcttcttgttgcatttgttcttattttttgagtatttattatgtatttgatgcttgattacctaatcgtagtgaactgttcaatagataactatgatttattccactcagaactgcaattaagcaatagtgtttttttattacaggaaatgaagcaccagtgtgatgaaaaaaggtatgctgactgtacagaatgtggcttatatttttccctgttgacacaatttttgagtttccaaatgcttctttcagagagttgttcgaatttctgctgaatgcacagaaagaaaagggaagatctaagaatgccaaaagtgacattggtgcgtcagagcaattgaaacaagctcaggacgattatcaagaagaagcaactctttttctattccggttaaagtcattgaagcaaggacagttcagaagtcttttcacacaagctgctcggcaccatgctgctcaggtgcacattctgtcatttggaaataccccacttccttttttttttctgtggcaatctgtacaaaagctaattttgtgtaaatttgtttatattttactccaaccagctaaatttattcagaaaggggctcaaatctcttgaggctgtagagccacatgttaggcttgctgctgagcagcaacacattgaccatcagttcagtgcacttgacgaggaggattactctgtggatgaagaaaatgaggatgattacaatgacagtcatgaagatttatcctttgattatggagaaaataaggaaggcacagaagctggtcatgcttccaggagccctacagaggtaacaatgtggattttaatttgagcataattaactatcctacagaaggatactctagaattttgcatggtctcttactattagcaatcatagttcaccgcgcaggtgtaaagttgcattgctttaatgagtttaatgcatgactttgtatttctcacctttttaagaaatgatgttacattttcaaaattccatagctactacaaagtacaaactgaataattatgatgacataaccagtaagaatggtatatcgttattccatctgttaggaaagaaagatctaagcagataaatggcattccatatgttcaattacaagacattgtgcttccatgtacttaatttgttaagttgaatttgtatacggctacgcatttcttttccttttttagttggcttccttttcttgtcccaaaatatacctgtttctttacaatcatgtttttcttttcatgtctttggaggccttaattttctggatttgcaggaacttcttgacagaagcaaagcagagtattcctcttttcctggtgaaaggcagagatctggaagtcagtcagccccactttttcctgaaaaaaaacttgaggcagcagagagaataaaagagttgcggcgttctgctacgaggaagctatatacttatgttttgcctactccaaatgatgttagagacacctctcagacagttacagcaaatcctactagtggatctcctcttggaaacaaaggtgcattctattcatctccactccagccaagtacaaatgtgggagatttgagagacaataagctaccaagtcctaccagattatctaatgcacattcagttttgaaagagagcaataccaatactacagacaccaggacaatgcttgtgctccctttgggtgatctctctttacctggttatcatgactcgaaggcttctgacaacaaaaaggtgaagagaggatccttttctggtcctattgttcccaggtcaaggtcaacagagaatattgatgttgtttctgtaccacctaggcacagctcttcacatcagccgtcaatacatgtcagagtttctcccaatacctcgccaccactgttgtcctcacctaaaatcaaggagcttcatgagcttcctcggccacctgctaatgcatcaaaacatacaacatttcccagtttagtcgcccactctgcaccgttggtgccaaattctgctcctttggcacccagaggccaggatcattttaggccgaggcaaacaccaccaagtgctccccaaactgcatcacctttaccgacaccacctgggcctatatcccgcagtttttcgataccttctaggggcatgagaacatcaggtatttcagatggtaaagagacagaagatcttcaggataaagggcctgccagaatgagcctttctagtcttccttcagcacaaacatcgttggaggatcatcggccattgtcaggagctaccgagtcagttagcaaaacatagggtgagtctagttttctgtaatacaacgccaattttggtagaaacttccttataagcaatttattgtttttagtccatccttagtagttcatgtaagaacatcaagtttgggttaccccttgaagattttttttttctgtgttagttcggagcttactatcatacatgagggcgaaaacatcagtgatgctgtttggactatagaagttttttcatttgcatttatttggttgccatcactactggccgcataacacaatatggatgtatatgcacacatacattaatagatgtggatacaaatgtattatggcattatttcaagtgattttagttccttttgagagttaagatgaactagaacaggtccaagtagaaggtagtttgtcaagcaccttcattttattgttgtgacatgtaatacaatggctctatatcagactaatcctttttctcaattaccttcccttggcagaatatttggtgttgaggtgaaagtttatttatcaaggggctcagctatctcgccatggaagaatattgtacatattagtatgtgaactcggccaatattgcaaattagttggtgtttcgtttgtatcccccatggttaagatgtaattgtgcaaataacgagttgtggaataaaatctccatttttctctccgattaattgatgtaagatttgtttgttgtgcccttgagatgacttgaatgccacctgttttccactgctcatgtaagcatcctccatcttaatttttaacatgagggagtcaattttgccaaaaaagaaaaacactagtgctgttattcatggaatctgcatgtatcatttatcaccttatgacaatctttaccatctgtgtgaactgctgggcaataattggctgtggcaagagaatgaagatgtttcatgagagttaatctacttctgtccaaatatacaggcagtttgttatacttttgagtgtattctgcaccaacatttctggttgcaaaatcaatagcgtagaacctgaacaaaatcaacatttaccatgtgcagtactttttctaagctgaagttaactccataattctgtactgtcagttagattgatcacattacgacatgggacgtaccaggttgtaccgatgaatagcttcagaagtacgaaaggtgtagtttcttcaactgggtcgtatttgaagaaacgatcaattaattgtaaagtctaacaggtgcggtcagtacatggaccagcaagcaattgtgtagctgtcacatgcctcaatcatgaacgccaaggacaatgctagatcagaagctggaactacctgacaatcttggatctgtatttgatggttttaattcaatctgtttgcttctcagacagggttatttccagctatttgtttttattctagttgttacaaatggcaggaggagtggactgactgaattgatcaaaaagattattattcagagcaaaactgaattacatgaagctgtccaagaccaagcttggcagcttgggttgttcgttttaggagaatggaatggcatcacgcttcctgatctgttaaacacttaaacggtatgatttagaaatatattatatatgaaattcttataatattggtttaaattcatttttaactttataatagttaattcattcatttgtacacttgcataattatattcagtattgcattccattcaacccaaatgaacactcaattataaatagacgattataaggataaaatgcatatcatgatgttaacaaatagctttgaaaaaaagttacccaaacaataccaataataaaagtttttttgagaaatattaccacccttttatataagtagttcaaaattgaactaatcaacgttaaacaaagaaaattgagaggggaggaaagaagaagattgtgaagatacgtaaaatcagacgaaccattagtacataattaatttagtactaattattttaaatttgggaaaatggatttgtatgatttttaaactgacttttatatataaagtttttttaaaaacgaactgtttagtagtttgagaatcgtacacgtggaaaataagttaaatcttctctcaatctctaaccaaaccaaagaacacagtcttaacagggttggtgatattaatgtgaactgaattgaagatgttcaactggtcactgcaatctcatcaattgatgatgtctttgatgccgagtaaaaaaaaaagagtgaagcatatctttgccttcttttgccaatctggacaaagaaccgacggcgtcagcggcagggagagaccggagagacgtagctgccgaggcacgcaacgaaaaacacaaaaagaaaagcctttggttttcacgtgcctggtcggtggccttgcattggctgcgcctgcacatctttgacgttccttttccattggttttccctgtgcagccagtacggctgctctccctttttctttcatgccaaaagttgggttggggaggaccagaagcattgagcagccacccaacaacgtactgtatgaatgatgcggcagcggcagcagcgacgtaatccctccgtcttaaaaaataattcgttaatccacctaaaataacgaattggataatcttttattcagatttgttgttttaaatgaagtcacatttttatctatgttagattttttttagactagggagattagccgtgcttctttcttttttttttttatgtatgtatgcttctaaagaactgtacgggattccatcctgcttgattttctcttataagtttggtactacattgcatactgagacttgtgcatcaggttaggctgcctagcatgtccatttgaaatcgggacagagctagaatgaaacagcaaagtgggactcacgtattttactctagtttgaactgagtttaggttgatacgtgtgtttgaatttgaacccaattggatgcacatatacgatgaaaatagataaactataagttgtaaaaaaaattagaccgaattcatgagcacctcctaacctaatgtagctcttccacagtttggaatactccctccgtactcgtaaataaagtcgtttaggacaaggttgaaaacaaacattgggaatataaatcatgaataactctcaagttgttgagtttgaaaatgtaaaaaatatatgaatagatttgtcttgaaaaatactttcataaaagtatacatatatcacttttcaataaatatttttatagaaataataagtcaaagttgtgttttgaagaccgtgtcgctatccaaaacgacttcctttacgagtacggagggagtatatttttctttatataataataaattaaaaaacccagcatctatgtatagtataccaaatccacttgaaatacacggttgttctctgttcgtccaaaaacaaagagaatatgaacacttccttgggatgtttattgaaaaaactgtaaaattcatgcgtcgcaaactagctccaatttgaactctgcttcaattttttgtgattcaaggatgatgatgcttggttgtctagttgtaattagacaagcaaataagtttagtagatactaatatacctttccaaaaaaatgtactagctatctaggagtggatttgacaccatctagaactaccaatgtggattactgatagctatatttcaggaggtagtatatattaccagtattgctacattgctatgtctcaaatcgtcggtctaatatctcaatttcacacgatccgatctaaatcctcttaataactcaatccaacagtgagatatctatcgctcattggttcaacttctacatcaaaaaattaccattaggtgccccctatatctataaattcatgataacttcaatcagacctaaccttcacaaatatcaaaaatcagggccctccatctctctttatctacggtcaggatcgcaaaaaaaaaaaaaaaacaaaaacaaaaatactgcttcaaaaggagaccttcagttaaaaaaaaaaagaaaaattgccggaggggagagaaaatccatggaatccgcctatttaaccatgagaagggagaagcgaagataggagagagaagaacaccaccaccaatccaccatcacgaggaggaggagaagagaagacgcgcaagcgaaatccaggggaggagggcgagcgagagagagagagattctcgcggcaggaaatggcccattccgcttgctgctggtaattttgcctctctaggcagatgagatgagatgagacccccgcgtgattttttttttgtggagatgatcggatcgagctcgcccccctcagattgtagagatggcaaaccgcgcgatttggcggttattgggagccacgattgttgtttttttgcgcccgatttcgtgattttggttcgcgatggccattcgtttgcgcttttctgttttgttttgagatggttggggggtgggggatctcggggggggggggggggggtagatgcgattctgtttcttcgtgtgttctgatcatcgacgccgcgatcgctctgggattgcggttgatttgtccgatttggggcgcgtcgggtgatagctgccaagggattttgtatgaacagcggtagatttcagacaatgtagttctgtagcacttcttaggagcttgggataactttatggttagcgcattgatgcctcatttatcaaatcttcattgcgccacaactcaatgttgatgtgaaatggatgtcttattttttgctctgcattgcatcatgttgatatgctgatagcctgtttgctcttttgtggttgatagttaatgctgtcatgttcattgtgctagagaaattattgaaaagcttatttaacagtgtgcggtgacatcctccgatttgtgcttgcaggactctgatctgatctattggaatggttcatcccaggttccttgttgcttgttcaggctccaaattgtgcttcatctccaattgttgcagtaactattggaacatgattggtggtgggatggtgaaatcattagtgctgatggggttcgattcagaagccacattgtagttttagccttcttgtgtcatcatagtttagctgattattactggaacaattgctagagactttgttgctgaaaataagaggctgaaatggatcatggtaaaatctgaataggaacaaagtgtgggcaagaggaaaattggtttccttttgctggagtaactctagtgagatgggtttgcctcaggttcctgcaatcaaggaggaagtgcttcctacaatgagtgcatctcttattgttcgtcctcattttgcggggaatagcacctgtcatttgggtaagcttcctgcagaaagctcaagtaacagggcatctccatgctcatacatcagtgatttcaagagaaatgatgttttagattctttgaatggatttgatggcaattttagagccagccatgctgcttatgggcctgcaggcttccaaggtctaaaacctgatacaggggatgtaggttccagatcaggccctaaattgggatcaaatgttcagatgcctgcaatgaggattgttggctttgaatcaggttttgctaattccactggaggtcctgatacgatggtagctgacaatacggattcacctttagttattgataattgccattcattgattgaacagcatgggcctcatgcgaggaaaagggtgttgtcgcctttgaacaatgcgctccctggacatttccgaggtgatgccctgaatattggttctggtgatgccaaaattcagcattctgattgtgctaggagactttatacttctggctttcaagatcgtaaaaaggcaaatactgcaattcttgattcttttgaggcacctacatggccagcttcgagatactccaactggagtacagagcagggtgtcgataaatttagtggtagtacattcactgatggtcctttgcttgagagcagggagtcatttccttgttcagatcacctggaagctcttgaaagtgttgctgttccacttgcaaaattggcacatcctcctctgcttaatctgtctcctcttggcccaacatggatgcatggaacaaatactgtaggatctcatggagaatcattgagagaaactgaaggttcaacctgtgaagggtattcagaaggtcatggtaggtcaaggataagagatgcgtttgaaaaaactaatatcttacatgatgactttgatatgaggatccctaagaagagttcagatagaaaatctcaaaactggggcccggaatctgcctctgtatccccacgcattggatgtattcggagtattggtctccttcctgtacgaaggtcgttaattggctcttttgaggaatctcttttatctggtcgctattcctgtggaaaagacaatcaggtccgtagaatttatacgctcctaatttagcttttagtggtgtaccataagttgatatttttcgagtgatgccagttgatatttctcctaaagtgcagaatattgacggtttccttgctgtcctgaatgtgactggtggtaacttctctcccccaactcagaagcttccattttcagctaccagcattgatgagaacagctccttactctactattcatcgatcgatcttgtggggaggctgcctatgagcagtagcaaaagcccaaagctcaaaagaagcctgagtaatcatgattcacgatcagcgaagagtcggttacgtatcccagttaaagggcgtgtgcagctggtaccatattcttgactttgagatttgcattaattcactgtattttgctcgattgttcatgatgcattggtgtgtatatatgttagtgcatatgcatgtgggcgacatgcatatgcatgtaccaattatgcaccacaagtctagttatttatcatgggatatttactctcataccattatgggtactggggaagctatatttgtaatgatacttttactactctgcatcatgtctcattttatgccctcctgtcatggatagctttctttggacttaattgcttattctcaaatggttcttccattatttagtcttttaaaagatttgttgaattgtcatatgcttcgatgatgtgtctatttcaccagaagcataactcttgactttgacaggttgtcagtaacccagagaagacaccgctacataccttcttctgcaactatgatttgagtgacatgcctgctggaaccaaggtatgagaaattgagaattgttatattacttttctttttgcctcatagacttatacgctggtggtaactgcaaatgtttctgcattgtcttggagttcctatgatggcatatttataattgcctatatggacaatgctgccagccatctaattcatgctggacacatagatgtgctttacaccatccatgaacttcttatttctggttgtaaaggtctgaccatttcatgccattggtcttacctggaggtgataatagaagtggaaaaatagaagtcatctattagtttgtactgaagcaacactaagcatttagtaattaatgatcctgtttgtagccacaccaccgggtacatgtgatttttctagccgcacaattttgctattcgcaatatattttttgactggtttgcaaagtttggagggatttctggtgttcttaagcagttaccagcaaaaaaaaaaaagggagaacgggcagtggaatggttcttattgttggatagtataggagaggggaatactgcgtaacatgggacgatagtattgagcctcagggggccggtatatataggagtacatggggaggagataaggaaggattacagatatggaaggagtctacacaaatcaatcctatcataatatgactctaactagtaactaccatatactctaacacttatttgtcctaaatggtttcttgaaccctgcttggaacagtactgcttcacttggcaggataagaactatctcatcgtgcatgaaagatgccattcaaaagtaatgccagatgcacgtacggtattgtctgtttagaaggaacaaacataagatgtctacgtttacggttcagattttatcgttttatttctttattttttttctcctgaggtcatcttatttctgttattgtaaaatgggacagactttcatgcggcaaaaggtcactctgttccctgtttctccctctaatcaaaagaaagaaggaagcaaggccaatgaaacaaaggtcgagtcagtccagtttgggagtgaacttagagaatgcggcactctattttctgaatgtaatgtagccattacctgtgatagctaaatccaaattttagagtttataaatactgacaaattgttgttgactatgcaggctgtagaccagggcagaactgcaacttgatcgatgactcggaaaagggcggccgcaagaacatgacatgttgctctatggagtgtgacattagagaatcaaatgactctagctctctagaaacttcagaaaatggcagtagtaccaatgtttgctgttgtcaatcagacacatttcccttaggtgaaaagaaatactgctgtagatcgtccaagatcaatgatccagctggaggtgctcttcgttatgctttgcacctacgatttctgagcccatttgccaagaaaccgtcaagatctatgcagcgtagcaaatctgatgtatcatcagaaccatacaaccatagttcagggcctgaggaacacagacgattctatctctacaatgatgttagagttgtctttcctcaaagacactcagatgcagatgaaggcgaggtatgcagccctacagcagctaccctgttcttgtttctttctacatcagtaggcttaagtaattctgaccaatagcattgctagcatgtaggtttcagtaattctgaccaataacatagatagcatgtaggtttcagtatttcatatagataaagtttctcagaactgttttccttatcctaatactatgatgcataactctttcgcatgttcccaagaaaaaaaagactttcttgtgccctttctagaggagagttagtttatttgtttatttatttatatatttattttccctcaactctgttttctctaaaggacattttttttccctgcagctgcgggtcgagcacgacttccctgctgatcccaagtacttcgacataagcaactgatatttactcgcgcacttcacatgaaatctgtatatatcataccctcattaacccgtccatcaatcccttgtgttcataaacattcacccatttgtataggactaaaatcttccaatgaaatacctcatttcgttcagaatcttgtgcatagtctctaaataatgttttcaccatacatggtgatgttgtcatctctgtcatgaatgtatagtttttttttggtaattttaccatccttgagaaggtaccaagaggtaaatttgatacctctaggtattaagtacctcgaggtaccaaaaattttaatgtaaaatttaggtatctcaaggtactttctcaaggattgtaaaattcctcatagttttttccccagcaaaaactcacaaaatggaacaaagattgtaaactgaattttattaacctctatggtctgaatattgccgtcaaattgacaagcagaattgctgagagaaaaaaactgataactatgtgaaacaaaaatgcatgaaacaatataaacaattgacttgaatgtactcctatctaattctgcaagtgaccatcttagttctcacggatcaaatgtgggaacttctgcatcaagaccatgaaccatctgatagagaagcctggcgagtatattcctgtaagggtccttctctcttttctcctttagatacttcatgcagctctcaacttcggacttaacattcaggtagaggtgttgggcgttctctttgtctcttagttccttttctctccctatgaaaacaagcaaaaatcaggtctcggaaaaacatcttcatcacttcatgtgttctagcctagtagcttatcttcagattgccaaaagaaagtaagcgtgtttaacttgtcatgagacagtgcgtgcgacaggtatattaattggagatttacttgcgtagttctttagagatgtacctcttgtttcaattggcttcccaaagatgaaataaaacctccctggtatctttggggcagccactactggatggattctttgatattttaattctccggtagaatcagtcctatgaaaccaagaggtaaactgagatcagatcattttttcttccaaagaattctggagacatcataaaaacaaacactataattaaattaaatccaaactcttttgacttttgtgtatgggcgtatgggcagcatatataccttagtttcacaccatcttcatttagcatcctgtcaaggatgtcatagaatggaatcttcataagatcgtcgtagtctaacaacatctgaggtggtacatctgtcattagacaatagaataaccagaaaacaaggcaaaaaggtgccaacttttttactctgagcacctataggaactaaattcccatggaagggaaaatttcctgccaaatcttgtcaatcctagtgattacagttagaatatatagtgtaaagcataattatctatccttagaccaaacatgtagacagcaaaggttcctcgcaaaaaaaaatgtagacagcaaaggagatttgcatctattaataattggtagttaatagtaagaatgcactcacatcacatatatcatcttctccaactactccaaatggtattattgttgctccaaaccttgatgccatcctcacaaattcagactgctctggccaaaacaacttatactcctctccctgaagaacagccaatcctctagtcagtagattgatttcatgatctcacaggttctatatgccaaattcagattgatttcatggtatcactgactctatgatctatctgccaaattcaaactgatttcatgataacactggctctatgatccatctgccaaaactgttgctacctttctatgaagcgcttctcgcgcgcctcccgggtacagcaacacgaagtgcttctccgcgagaagcttgtaaaaattgcctgcggtgacaggcacggcgcccatgatccgatgcatatcgtagtaggacggatccggcatgatcttctccttcttcttgtcaaacatgaagggatgagccaagcctctgatgtggatcccagagcttctcagcactccggtcaccagaggtccgagctcaaaccccaacagcatgtggtacccaacaatcactgcaggaccttgcttgggtaggcctgacaaacccctcacaatctttccatcaggcagtgttgatagcatcactgggtttgctatgtactgcaacatcctgaaagtttcagaaatccagtagaaaatgttcagtttcatgtgacaatttgttagttattactccaacagtaggaaatttgctccctgtaaaggggaattgcatggattctgaattgaccaagcttaagttgttttgagagatggtacctgatgtgatcagttgccttctgaaattcatcaggagtcagtggcagatagtccgaaacaaagtccgtctccaacgagcggcgatagtacccagctcctttgatggccgttgccagatcaaattcagcttcctatccaatattttaaggagttaacatggacatgccaaagatgaaaatagtgtcaaagtaggcttaagcttaacatggacatggcaaggatggacatagttatctaagcaatttggactacggatggaatttgctcgatgtgtaggacaagaacagacttgaaaattgaattgacaaataaaaaacactttttctcttccttggaccagtgagatcttaacatcaatacattttctaagacgcctggaatatgtaatgcagagaaacatgagctttcataccagcaatattttgtgaccgttgtctttgaaattacggattctgcatttctctagagcgtcacgtagcctttcagcttcttctcggcttggtagcagttcatcattccaactggaaaagaaaaggagaatagaatcttcagatccagtccgaaggaggaccataagtttcagtattacttaatatcatataatccatggaaagacagcatcaagagcaatgtgcacattgctaattgcaaggacatgataaaagttatcaggagctaaacatacctagcaagcaccaaagtctgcgctttaactgcatgcaaacgggaattgacaaatgatgacgctgttctcagcattttcaacttccaaacaatagattcctttggcagaacatcaagcaaagactgcataaacaagggcataaaattagtattatgatgattcagacatgaactgacaaagaaattggagcaatggttagattcgagtctcaccataagagaaggcaatagactagtggtgatctctgatagtgcttgaccagcttcttgaaatgaaaaaccacgcccaacaatagtcgacggtatcttcatgaagttgcctaaaaacattttttggtcactaataagcattacatcttataatcagctataggcgaagcgatgggtgagcttggcttcaaatgagtctactcattaatttcataaaggctcaaagtgcagaaaagtgagctaaacatgcaattatacttcttccccagttgagtaaaataaaatcatttatccatcaaacaagtcataaatattctcatagagaagttaaccgaacctgtcaggaaattcagcaactgcggtgtggttaaatggaacggttcagggaccaaatccaagaagactgagagagactgcagctgagacttatggaaagatgttcctgcaagaaaaccatacaacagaagataagtcagtaatcacttgtcactgaaagaagataaacagagaaagaacagaaaactatggctaatggcagcaagacctgggttgactaggatcaataccaaatcgatatctggatttcgcgccgccacggcaagagcaatgcatgctccaacggattctccgactagatagactggtctgtctcttgctctctggccctctgatttcactgcactctccacatactcaactagtcctgtattcattactacagtttcagagtttttacaaactatataagtttagtccaaaaaatgagctaaaaacatggtttcttatgcatcatattcttacaggaaattacgataagttcaagatcattaaggtttatatacttatacttcttaaactacaagcacatgagcatttctgtccattctttgaattataattaggagcatatgggaagtagacactacttcatttatgagaagtagacatcaagaaagtgtaccttcaaaggacgtacaatcttcaacaggtatatgtaagcaccacatatcaaacatcctgcaaagcagaattaattaccagcggtagtgaagataaaacagccatacattatacataaaattgtcattactttgctaatctctcatgatgccggatcagtcctaagccaactccatcaattcctgcaagaccaaagaccgaaaacggttacccatttttaatttttcttgtgtttctcaaatggttggaaccaaagtaatgaaaggtatgaacatatattctgacaatccaacccataatgcagtaggttgcatttccactgggataagactttcagtactataccttttttaaaacacaaattttcagtactatacttgaatactttaaaaaccaaatctctaacccaatgatcctaagcctgaatccagactttgcaagcatgtctgctgcatcaaacagtcagattaacagtgagtctctgattatctgtccatccatctaatccagccacttccaatggccatcaaccaccagtaaacaactgagctggtcaagaaagccagtccctttccccattctactaatattggcctactgggagttttcgtagtggcttgtcaaactgcttttattgtttatggtttcagcattgcagatcttcatgcgagcaattagaaaattttgtttggcatgatctgggtgagtcaccgaatcgccgacatgttgtctaaattagtgctgctgcactgatcttgatgagcttaaatattgccaattgccaaaggtggttggtcctgctttcaggcctaccctacaaccctctggtttcagactagaaaatcttgcatgattaaatggtgtcaaaattgaaataaaaattcagggaaaaaaaagggggtactgttcaaacaaattttcattttcaacacacccacttggtactattcaatatcatgctttgtcagagtttcacaagataaacagtattcaaacacatgttttacttatttatttgacaaaaaaaaaaggaatatgcagacacacatgattaaaaaaaggaaattatttttcttttttttttcagagagaggctcataccgggcaagtagagcatcgtgggcgcgccgggcagccgccctccgccgccgccgcactccagcggcgagaaccacctcgccgggccgccgtccggccgccgcaccatctcccgcgccgcctccacgtactccctcacccctctcctcgccgccttcgcggccacgccccgcgacgccgccgacgccgcggacgcgctccaccgcccccgcggcggcgccgtcccgcggcgtggcaggccgggcaggaggggccgcggcgctgccgccaccgtcgccggcatcggcatgggtggttgcgcggctggctcgacgtacggtgacggcggcgcctctggtcttctccttgatcactcgcgcgcgcgcgcactcgcttgcaacgtacgtgtcgtgtcgccgtgtggctggagaagaggaagaagattagagaaaagtaaaccggcctagtgcactgacagcactgtgctgtactagtactcccgccatactcgtaaatactcgtaatggaaatcatttagaacagcgacacggtattcaaaacacaactttgacttcttattcctataaaaatatttattaaaaagtaatatatgtatacttttatgaaagtatttttcaagacaaatctatacatataatttttacattttcaaacttaacaacttgagagttattcataatttatattcctaagatttaatttaaatattgtcctaaatgacttcctttattagtatggagggagtatatgccgtatatatataactaggtgaatatctcgtcacgttgctacgaaaaaattaagttacacggtatatacagataagacataatatgtttattgaaaccaaaaggatgcttcgtatgttttacataatttgtatatggttgcaaatatagtgcgagatgaatatattttatgtctaattaacacttatcaattttgatctaaaaataattaagaaagaagaaataagagacaatttaaagcataaatctattatcaaaaactataaataattgagatgatgtgaattaatgagagaagagataaatagtattatatatgaaactatatttagtgggataataactatatactaagtatatagaatatggacgcacgctagcaatgaagtcaaatgagagaacgatgaatcaatcaaacagttaagagtatatagaaatactgacttgaacatctcaactagaactagactgtattaggtgcaaaatgtctgcatatacagaaatgggggctgctaccccacggaataccgtggaaatagtgtactcacgggataattaaaaaagcaatgacagcataaaggagcaccccacagaacacgtgatttgtctcaatacctagccactgtctgctcggtatcgtcgccggagcagtggctaccttacctcgccggcgtcatcgccgaagtagcagctacctcaccgccaaatattctccttgttatcgcgcgctcgggtgatacctcgccggcgtcgtcgcccctgagcacccagagtagcagctacctcaccgccaaatcctcctggtaccttgagtaaggtaccgaggtggtacctggtacactggtattggctggtacctggtaccctgggtatcgagctggtacctagatatcagaccttggtacctgggtatcagcatgatacttcaagagggaggaggaggaggagtcgtggggtcgggaggtcctggtaccctggtatcgactgatacctggtaccctgggtatcgagctggtacctaggtatcagaccttggtatctgggtatcagcgtgataccctaagagagaggaggaggaggaggagggggaggagtcgcggggtcgaggaggtcgagcagcggggcggggcggcggcggaggaagaggaggcgacagatctggtgcctaccttgtaccatgcctccccagcctcctcagccggctgtggacgacgatgtgctcggcgcacccctgccgccggccatggaggtcttcatcaccaacgatgtagcagatccgcttgctgccggccatggaggatgccgccgcaaccgcaccccgttccggctccaccgcaccccgctcccactctccctcttgctcaccgcgctcgctgctgagctcctcgccgttgcggcctccctcgcggcggcggccgccggctctggtgagcagtgggcgacggcgacagggagggttgcagtgccgtctaatttaggggagaagagtgaagtaagaggaggcgacggggaggcctgcaacgccgtgtgatttgggagaggagagtgaggtaggaggagaggagtgaggtaggaagaggggatcccgtctccacaggatgccgtgttgtaggttttctgtacagaaattcattgaaaatcaaagggaaaaaaatatcaaataattgctcccaaaaaaattgtgaaagtgagcaagtacgtgcatcactgtttgcaggatgcacgcaagccacataaaccgatctctctctttctttttttggattttggtggcagagtcaacgtagagagatgggtaatcaagcagttgccgattgagtgaagtaatgaagttgagttaacctgacagatgaattggcatcttcttctcccaaaattgttttttatttttattttcaaacagaacaatattactattgatcaacacacatagtcgttttacagcaaaagcgtataacccatgaactgatcacaatcaacaaagctggagacgtcagaaacactttgtgattgcgatgggagtctgaaccaaactctgaagaagatgtcaccctctctgcaatttctatccgttcgatgagttggccgaacgacctgagccggatatcttgttgggcctgaacagtaacattacgtgcgtgaggcccattacgattgggccggaacgagattgccacgtacgttctagttgggtcggaacgtcgcaatttcttatttgggctggtacttgcctacaagcatagtccagctacgctcgcatctcaatcctgggccgatcagttggatccaacggtcagcagcatcgctgaagggcgttaggagcctaggacccacctgtcagaactcaaaacgacgaggggggttcaagtgcattacccgcgaacctacttataggtaaaaataagtaagttcataggttagttttgcttataagtggattttcacgggtagccgcttgcacacttagggaggcccatactacgggctgcttcgctttgtcgccaattctaactgacataaacaatttgtgagagaaaagttccgtaactaccaaatattaatacaattgtatttataagataatgtttagtttgctaccctactaaagtttagtggggttgaaagtggcaacaaaattacaaacaggtcctacataacttgccacattttcaggggctgcaaaaacttctgagtggaataataaccatacaacaatccctcaaaaagtcattcaaaaaaaacttgtcattaaaaaaaaacaatccctcaaaaaaaaaaatacaacaatacaagatcatggatgtgatatcgtatgtattctactactccaggaaacaagtttcagttcaggctattcacaaaaagtgttggtgatgcagcatctccattcccccagcaataatccccactgaactgacgttgttgaggatgtcgctggatttcagacatcgcaagcacattttcagccgccgtcgccgccaccgacgttgaagatgtcagtggccctgacgaagcgccctttcacccgcgtcctcgtgtcggctctcatcttcctcgactcgtaccggatgtgcttgtcatacctgcatcaacaaataaccaaattcaccacgaaacagtgagaaaggagatgatcaatggcaggttaagcagcttctgtccaaacatggtcagaaaaaaaggctagtgaaaaccatgcctgcgagtctttctcttttctctataccgttgcatcgcgttgtccctgttcatggcgatcgttttgctgtcgatcttcagggaattcctctgatcagctccagttacagtttgatcagtgatacagttctccccggcaagaactgctgcaacttcttcaggagaagagttcagagttctatcgacgtcaacgatcctcgaagatgatggcccgtcatttgtcaatccgtgttgctcgttcttgtgtcgcctgttgccggatgtggcagtgctcagctgaaaataggtgcaagaatagtgacttgagtaactcaattgccactgtcaacaacaggatcaatcgatgggtttctcaacggtgtaaacttttcacagattaagttggctgtcagtgtcacattgaagagcatgaggtttacattgctaaacggaccaagagcaaaggatatgatgagtatgtgcatgatggcccatagtggtgacagcatccagataatatcttagatcagatcggagcacatggtctactctgtcaatatcaatcctttagacgataaggttgattgataaaaaagtctgaaacatttatggactgtgccttaacatcaatgagcagctatatataatcagaccgcaaaggtgtatatatattattatatatctaagatcaagagcacgaacctctaaacatatgaacaagagcactgcacatgaatgggacagtgatacatccctatgcgcacagtacttcacttatatttcagtataattttagagttcgtaaatatcacacaagcatgaaaatatacagaaatttcatctgtgaatagcaaaaagattgaaatgtggattacctgttttggagtcaactggtagatattggccgacacaatatcttccgtggcaaaagagtatgtcgagtcataaatatattgaagatctttccttgagctagaggaaacttcctcaatcatgtcattataacttttgatcataaagcctccatcttttgggccgaaatgaagttcaagtgcagagtgctcatcatggtcccttgattttcctagattaaaatcccatatctgtcatgccaataacaaactctgatttcaagttgtctaactcctcttttttcccatgaaaataagcacatagtgattgacacaagaagaatctgctttctctggctgtctggtaattagacccatgactataacataatagtcatataaaataaaatttccaggctagaagtgatcttaccaaaaaaaaaaagaatctctcttaggtaatactaatgcagctaatatcaacaggcaacaggcacatttgggcttgagaaaatggtcggagcacaaactgtggatcagcatgaacacattattttgcttccatgccaagttttcagttcatcctctgatcacatatcccatttttattttgtgggttacaagtttactactactaatgctaacttattacagagaaaaatcagaaaacacagctttttgacaccataccacagaacaatcagagaaaaaaatttgatgataatcaaggaggaacttggttatcaaataattagaagaaattgtaagcatgttgagaatttgacaatcagagtatgagaatgagaccatgctatcacttgtaataaactgttgaaataatggaagcaaaaaaacacagtctctttgtcactacctggcatggcggatcggagggcgcggtgcgctgccacacgagttcgttgtcgtcggtgaactgctcgccgttgccgacatcgccgcagcccgccgcctccgtcaccggcgtggacttgtacggcaatgtggccctttgcgccgccgccgctgccgcagcctcatggcggattgcagcggcagagccccggcgagctgatggggagatcgatcccgagttcgcctgcgccggcgcggattccatctcacgccgcgccagctcggcgagctggtggcagagcgagtcccctttgagccgccgtccgcgtccgccggcggcgacctccggcggcgggtcgcagggcacgtacatgtcccgcagcacgcgatccgccgccagcattgggtaaccggcctcggggaagaacggatcctcctcgaattcatctcttccgccgccgccgccgaggtcgagcccccacgacgcggcgagctcggcggccccggggcatccggagaaccccaccacgggcaccctcgccgcctccgcaccgtcgtcgtcggcgcacccggcgcaaaggaacctggcttccccgccgccgccgcatcctccagctccagcgacggcggcgacacgcgccgccgcggggcgcgccttgcaccgggcgcagagcggcgcccgcacg

SEQ ID NO: 81074 - DNA, 2535 bp, Oryza sativa
tgaaatgagatacaaaaggaaaatggaagctcacatctccaggattggtcttctctatgtctttcaaacgccttgctaatccaaaatcgcacagctagaaaattaaagaaatatatatcgttagttacaagctattgcctcactgtatgaattatttgatccagtaagtaccttcatgcacccagattcatcaagtaaaacatttgatggtttcagatcacaatatataattccttgtgaatgcaagaacctaaagtccaaattgttttgacaaataagatttcacacatcatacagtagaaataatgaaacaaggaaagaactttactgaagagctttcacaagatcataagccaagtcatgtatagaattttcaggcagcttcttatcctgcaggtcattgaagaaatgtaaaatgttcatatgcaaatatactaacacaaaatactaaaaatttgggtacatattagagcatacttaaatgtgacatgtacataaatagacagccaaagcaaaagtttttaacctgtcagtttgacaatgaattttccttccattctactacctccatcccaaaatataagaagttttagggttaagcccgtatgaagattgagggggaggggaggctgtgattggttgagaaaagaaagtaaatagagaaattaaatgggggaaggttgtgattggttaagaagagaatgtaggtgaagaagttgttatattttgggatggaaggagtaccagctataagctaaaaaaaatgaacatgtttttttaaaaaatttcttaaggagcaaacaaaagacatctcagcatgcacagagagagagagagagagaaatatttgtaaatgaagcaaatgcaaatcaaatacaaacgtgtgctattgtacaagtaaacagctgacagcgtgctttgaactagaaaatggtatgctgcttaaactgacaagcgagatacctgctcaagcaagccctttaggtctccaccaacgcagtactccagtattaaccaaaaatgagctgaggtttcgtacctggtacaacaggtacaggcataagtatggtttgtagtacaatgttaagggaacaataacgatgattgcaaccaaactgccagactatacttgtcattattgttctaaaaagtgaactgcttgccattattgcaccacaacactagtcccctagaaacgtaccatgagtaaaatttcagaacattcggatgatctaaggaatgaagcattcggacctgcaaagaaaagttcagaagtactattagtggagtaagcaaacatcctcattcctcaggctcattaactatttttcttaccatgctagctaaaagattattttttaattgaagactagaacatgtgctcatcttctatccagaaaatattatctaaactactgatcttcacccttaagcgctttgctcaaagagaaggtacattcctgaccaaataacataacatttgacagcacaccaaatgtaacttatgttgcctcatttcatcttctctagaaatggctataagaaatagattgtttcgcacgattatcaggaaatcaaaatctaaacagcatcccagcttaagcatgtaaagtgctttttcccaggaaataaatagcgatccactagtacatcaagatactatataacgaacaatgtaacattctgcccatttaaacaacatcagcttacaaggaaactctgcactctgcatgcccagaaaacagcggttaacgaaagccacggtatccacacagtctaaaacagtcacttaaactatcaaatcaatcttggatatcatatcacgatttgcttccgggaaatccataggcacccgcagatcaaatcactccaaggaccatttcacggaccaaattaaccaggcccgccaggagccaagccctccgattcaaaatatccccacccaaaatcgcggcggcgcatgcctaccagctactactgatgaaagagcagggagacgacggcgccgcgctcacctcattgaggaccttggaccgctgcgacttgtcgacgctcttgacggcgaagtactcgatgctcttcttcttccgccccttgtacaccgtcttccggaccaccgcacccaaaaaaaaaaaaacaccaaaaacaaatcagaaatctcacccatctgcacccaatccgagcggatccgggggcgcggggaacacagggaagacgaggagaggaaggcggagaggggggttaccgagtgcttgccgcggccgatggcctcgtagacgtggaagttgttcatggcggagcaccaccaccaccagcagcagcttctcctcctcctcttctcgtcgacttctcgtcgacctctcgtcgacggcgacggctagggtttgcgatttgaggcggaggaatggggggggagagagagagagagagagagagcgggatttcgatttgagattggcgctcgctcgatcggctagttttggagttttggggcgttccgtttcggcgtagttttttcaaactttttttttttcg

SEQ ID NO: 81075 - DNA, 9200 bp, Oryza sativa
acatacgtcgacgacaccgtaagaatcatcagtttcttcgtgatccttagccggcgccatggcggataggtcggaggtcaaacggtgaaacttgctttagagcctaacgaaaaagttaggcaaattttgctacaggacatcatgactttgcggttttagctataggacaccgcgcgaagtgacttttggaggaagacactcccaaaagttggatatttgctggtggacaccgcagccattaaaataataattttcggttagagaggagagagaaatcgcatgaaatgtcacaaatgcccatggacccacatgtcagctctctcctctctcttcttcctctatcccctcggtgtggcagcacagcgctgtgagaagcgacaggggacacgtgcagaggccggtcccgtcgagcgaaatggcgatggtgcaagcgaagaggattggatggcgagcagccgatctgggtgttttaatttggcgagttcgaggaaggtagaagcgaagaggattggatagcgggcggtccaatttggggaaaatagcggtggtggttgttgggcgccggtgaggggtgaaatggggtcgcggaggggcgtgggacttggtggtggtggcggcttggtcgattacgcactggaggcggtggattagaggttgagcggcggtggtggttgaggcagagctcccatggccgtccatcctcccacactgccatggccggcggtcttctccgccccgctcccctaccccacaacaccgcccagcggcattgcggtggacccgcactccgacgccgccttcctcactgtgggcacacagatctacaaggtgttcgtccaccctgccaagaaggccaccgccgccatgtacaagcgctagtttcagatcgacgacctcacccgcttcctgcaatcgcgggcgcgtgagatgaagcgcagcggtgccaatgttcctcgcatgccttggctggagctccgccgacgtgcctacctcggacggtgcgtttgtggacgacaggctcgagctggtgaggagaaggagcccactggtgctggaccggacggacgacgcgacggaggtcggctccgcgatggcaaacagctgcaaggcatggctatgttcaggaactggggcgcgtgctgtgcgcccgccggaggtggcgccggccatggcagtgtggaagaagggataaagagagggagagaggagagagctgacatatgggcccaagggcatttgtgacatttcatgcgatttctctctcctctttaatcggaaattattattttaatggctgcggtgtccaccagcaaatatccaacttttgggagtgtcttcccccaaaagtcacttcgcgcggtgtcctacagataaaaccgcaaagtcacgatgtcctgtagcaaaatttgccaaaaagttatggttggtatcgtctggccggcgtgaaatttaagccagttgtaaacatgttgcgacttgcgacgggctcaagagtccaaactccagacctacccacccggtcatgtacagggctctataatatcatatcgttggagaaccgatgggcaattggtccgtccaatacatgaatacaacaaaatttaccaaaaaaaaggacgagaaaatagaggcgtggggagatcgtgttgaggtgggatgacttaaaaaatattcgaggcgcctataaattggacgcctgatttttttttcaaaaatcggacgttgttttaccaagcagatcgagtatgtttctataaatagatcggaaatgttttagtcttttgaaaagctgaaacacaaccaaatcacctcatgaaacattttgctacaacgtatgaaacaacggtttccaaaaaatcagacgttgtttcagcctataaaaaacaatgttttagcaaatagcgtaaaaatatttcaattcttaaaaaaagtgaaacacggtcagatcgttagatgaaacaatttgattcaacgtatgcaacaaacgacttgaacctattgcaacacttaaaccctatgtacataacaacacacgtgtccaaaaaacaatgtttcagcaaataacgtaaaaatatttcaattcttaaaaaaagtgaaacacggtcagatcgttagatgaaacaatttgattcaacgtatgcaacaaacgacttgaacctattacaacacttaaaccctgtgtacataacaacccacgtgtccatcaagttgaaattattaaaacaatatcaacatccactacaacatttgatccatgcatagtaaaacatcacgagtacaatagctgaaacactgttagtggaaaaaaaatgaaacaaatccctcttaatagggtgtttcctttatatccgggcaactgttgcaacggggtgcgctgtggtggagacgcgtggaggcgcgggcgcgcgtggtggcggcacgtgggcggcgggcgcgctcgattcccgattttgttggtgcgtgtagggcgcccgatctcggacgttttccaaaaatattttcaatccctttttacatatgttaatttcatgtgtgtcttctttacagattaattaattgtggtttaattaatgcataacaaagaaagtagcgtgcacgaccaaatctttttgaagctgcattactaaatattccgaccaagctggagtaaaattatcaatgccattaatgtctgatacaagaaagagtgctgttgaaaacttgaaatcatgtaactagctaactaattggaacacctgcggtattctcataaaccagacgaaaattaatccctttggcgatcccttaacccgtaaaagattgatctgaatgttctattatccgaacaagggttgagagaaccaattctgcaaagccaacaccgagcaatgcgccgtgttcggcagttgcgcttcatccatcctcagcccgcacgacatccacgtcggcctgggcgccgtgccgccgtcgcgcccgaacagcttcacctcgacctccagctgcatggcgccgatacgccgctccagggccatgcgtccgcaaagccgctgaggcagacccacgccgtcggccgacgccaggaacggcacctccggtgccctcttcccctgcgcgcagaagcccggcacggtgccggacgcgacggtgaagccctcgtagctcaccaccgcctcgccgccgcggtagcatctcgccgtgccgcgccggttgttgacgtgaagtgtgacgtcgatagcaggggagatgatcgtcggagacgccggcgccgcgtcgtccaggccgcggatggccgtaatctggacggagaactcggatgggaagtcgtacaacgcgtgatacaagcataggaatatgaaaatggaattggtgaattcatatagcaggttgacgacgaagatcttgcggcgctggcggttgcacgtctctgacgccttttggcaggcgccggcgttgtcgtcgcaggaggaaggagggtggggctccattgtttcaaatcgtacgtgacgaaaggcctttttctctggtggattgtgtgccttgtgtgcctaataagcccgcggattttgtgcccgccgcgccacgagactactcgtagcggatgagatcagttaccgtggtattcggccgaggtttcccatgcgtaccggactgccaggccttgcatgcttcacccgtagcttacgtgtaaacgacggccccctgtgccaaaccaatccccggtcgaggccgtggatggccgtgatctggacggagaactcggacgggaagtcgtacaacgcgtgatacaagcataggaacatgaaagcgaaaaacatgagttcatatagcaggttcacgatgaggatcttgtggcgctggcggttgcacgccacggacgtcttttggcagctgccggcgtcgtcgtcgcaggatgaaggagggtggagctccatggtttcaaaccgtacgtatcgtgaatacgtacgtgatggcgttttcctttggtggatccttgtgtgcgcgtaatatatgcccgcggtttttgtgcccgctgtgccacgagactggatgagagttgccgtggtattcggccgaggttttcccatgcgtaccgggccgagtcttctcccgtcctacgtgtaaacgacgtcacgacgattgacccccctagcccatgtgcctatatatccctgggttggggggattaatatgttagggtaaccacaatttagtaaaatgtaagccttaaacattaaatgttataactttagctattgtaggggcacacattaagatccatgcaatccaaaagagtcttaagcttaagtgtgatcacatgaaaatataaaattattttttttcactgttgtattcatttctctagctttctgccttgtatgggatggttaggaattgatttttttttcttcggtgggattcaatgggacccatcttatattctaccaaagacttaaccattgtaggcattgccatagctattgctccttatggtgggtctcactcttgttgtcaatgcaaccatagggatgcttactgtaaatttgaaatgcatctcgtttccatttgggatgcatatcttcctttcaagatactagctcgcgcttatagtcgtggaggattcacatactacttggtgacagctttgtgctcacgtttatagtcttggtgtatttatagtgagttttgtgttctctttacactgctttgagtgctaattggcagatccaattacctttttaatggtgtatccaatactattgacattactagatcgttgtgaaaatatgttataataatatgtactaatttttatttaaaataataaatgtaactgtctattattgtattatatagctagatagctccatcacatctgttctagaagctagaaactcttacattaatcgagagaaattttgaccattatattatagtggtctaaattgtagcgatatgaacgataaataaagacatacagttgtatacaaccctaaattaagacataaaccaatagttgtatacgtcaaatccaattctacttagggtatgtacaatggtgcttattaacggctctctccgttttctatgcaagtaactttggaaacatgaaagagagagatgacaacggtttaaagtcgactcttatagcatttattaaagaaatttttgttgcacgtggattgagaaaatgagagtaataaaaaattatttggtgtactaatggttaagagattttgctgtgttaacttttgtagaagctaaggatagtctctaaatgagtatgtattaattaagagctaatattagattctattttgcacatgtcctaaaatgtatggtatacaaaatccagttcaaattctatatttaactctgctgaaaattgcgtataaatgttagctagtttttaactaataaattaataatacatgttttcctatagaagaatcaaagatacaccttattctctctcaacagaaagttaggtcttatcttaggactatatcattgtcctaggcggtgagagatggtatagacgtggaaaattattctacactctcctgaggacgtccaattattatttgcatatcacttaaatattaataattttttttaataagatagatcaatatatgatatgatagatcattgtacaaacatacatgcaatgccaaatttaacttttacatgttacaacagaaaaataaatttgactatgaatatgtgttagttgtagtttaatttgttttttattgcaatttgtgaaagttaaattttaattcatatatttgtggagtgatatattaaagaaaattataactatttgagtgatatgcaaataatgaggggatatcttctcaagagtttaaaatccagtctcttaaagacatagcataggaacattttgaggaacaacagtgacagaaaaggagagaggaaacgaccatttggggaggtgtggccaacaggtggggtaggacttacgatagcaaaggtgttgcataaatattgaagcaagatctctaagtatttttttaagaatgataaaattgccttaaagcaatctacaccacctaaaaacgatggataggtaattaacaaaattgaaaagaaaaacgatggttcacatctagacaattctgtaattggagcattgcaatgatattgtcaaggggcataacacaaccatagaaatctcattaccacgtctatcgagaaccaaaactagtaaaatgaaaatctgatcgagaaagataactatttgccatggcattggcatggccacatagaaaccatataaagttactgcatccaacgaggtgcaatgtctgatgcccaattctgggtagcgaacactctgcacggtgtcacgtctgacggctccgcttcctgcgtcgtcaccttgcaccacatccacgtcggcatctcgctctcgcggtcgaacaacttcacgtcgacctcgagctccacggagcaggcgcgctgctccgccgccatgcgatcgtgtacctcattgggcagcgtcacgccgtccgcccacgccacgaccggcacgtcgagcgcgtccctggcgccgacgcagaagacgcgcgtccggcccgccgcgacggtgaagccggcgtaacgcaccaccgcctcgccgtggcggtagcatcggcccggcgcgcgccggttgctggcgtgcagggtcatgttgacgatggtggagaggggctgcgccgccgctgccgccgccaccgcgtcgaggccctcggcgctgttgatctggagggagaacttgggagggaggtcgaagaagatgtagtacaaaaacggtgtcgaggccagagcgagcaggacgtacaagaccttgagcatctcacgcctggatgccttcgccgccctcgatttcttggcgacgccatctccttggatgggaggaggctgaggcttcatagctgaccggccggtgacgatatgatattgaattattgatgactcgctctcgtgttcaagacgaccccaagcgccgatcaaaatctgtttttttttttttgtgctgatgatcttccatctcgtttctatttgagatacatatatgtcttcccttctgtcgtatgtctcgtacgaacgtatcgtatcctacccaaaatcctgttctaactggtaagtccggcacttgcatgaatacatctcttcggttcgggcgttcggcccttttatcatgcgtgaaacagagtctgcgcgtaggcacgccaaaatccctgtcaagatctctatagcttccacgctcccatcaagctgaatcgatctccgacgaagaaattagccggacatggcgagaacagccctgtacggcagcaaagaggtggaccccttgttggtgctacagaccaaagtcataatcctgttctatggtatggtgacgatagttttagtgctggggatcccggccgctgcccttctttctaacgccgccgagaaggtcaagtacaccttggatctcgccgccgtcgaggggatggacgtcgccgccgccgccacggccggcgccggcggcagtacggtcatctcgcccgcgttcaacctcacgctgcgtgtagagaacccgcgcaccttccggccatggtgtctcgaccgcggggacgtggtggtgtcctactccggcgtagcgctcgcgtgggggcgcgtcccgggattctgcgtgcagaagaggtcgacggccaagctgacggtggtgccctggggaaagaacgtccacttgtcgcaggagctacgcgaacgctttgtctcagagctgcaggaggggacggctaaggtctacgtcgagatgaagctgcactactacgctaatttcggtatggctgccttcgcgcctagcactgggatggtggggatttcacaggagcttacgctgggaggaagagatgaataacagtttggtcaagggaaggctgatggatagttgtttcttcgttgttcacgttttcttgtttggtatcataactttttttcctttttccaaataggaacatatatattaattcatatttttagcatgttatctccaaagtaaatagaatggaaaacattattccttggtaaggatatggagtaataacaatttgatttatagcattgaaggttttcgttttttaattttgttgcatcgaaagtcgtcacttaactttggtaacacacccatatctcgctctccattcaatcgaactcatctcgtcttctttgaacgtgattcacttagccagacattgccaattgaccatcttacctttcatatgaagaacttttacggtacactatactatcagtatatactaccaatatataaaagtgtatatttggaacttaaaaaaattgaataaggggtttttttagtaattcgtcagatctaatggggagtaatcggtcttggatctcatcatgcgtcgcgagcgtgatttggttatggcgcgtgtggcagctccgcggctgcacggtttgatgagcaacgagaagccgaagatacgctggacgcaagccccaagcattcgcggcggcctgccttccggctaagcctcaccggccacggcaagaaactgcaacgagctgattcatagtgtacattgagcgatcttgttagttcagtgtagattctactcaaaattgttggctagtacggacaacgtgaggcaaataaatcaggtactgatttggtactcttggacttgtcttgcgttcagtaccagatcggtagatgaacatggaaattcataaaaccggctgtgtacacataaagacaaagacaggtttgccccttagaattttatactggaatctcattaagtggggaggagaatgaatctacaccattgaattatttatactagcagtatatactggtagtatagtgtaccgtaaaatttctcttcatatgagaatattacgtactccctccgtcccaaaataaacattgcatgagttcccgtgtccaactttgatcgtccgttttatttgattttttttataattagtatttttattgttattagattataaaacattaatagtattttatgcgtgactcatattttttagttttctcaaaaaaaattcaaataagacgaatgatcaaagttggacacgaaaacttatggtgctgcgcttattttaggacggactgagtagtaatcaattgatctccctcccacctagtcacaccttacaaattataaaaaaaattc

SEQ ID NO: 81076 - DNA, 3360 bp, Oryza sativa
aatggacatcgctagcatacgagcataatttgtactttcttagataatagaagcaactaaggataattaaggataaagcatctaatccaaccgttttatacctgtgaacttaacagtactaaaatatgcataagcaagcttctgcaacagagggaattaaccacccaaaaactctagtcaatctcacgtttcattgaggatattgtcattatgtacgtcacaatgggtttgcataataaacagtacgatgaacgaaaatatgccgcgaacatcaccacctcgaagctctctctagtcttagcagttctgtttttacctgaatctctatgagcacatcgacgcgcttcctgaccacgggcgccaggctttcgagcacgtcaacatgttgctccgccaacgcctgcagcttgttctgcacagatgacacacgcacatcaccgaatcaacaaaaaccaccattgcacgatcgctccgattgaaacccaacaaagcacaccgaaaaaaaagcgatcatcacaacgagagaggaagaggttataccttcagcgtctccacgaggatggccttttcctctgacaagagctctgcatcagaaacccgccgccgcaaacagttagccgtaaacccaatcacggaatcacccgaaaaaaaaaacagcaacaacgcaacaaaatgcgaagcaggggagaggtatgctcaccgggattgctcatggcttctgcgatgggagatggcggtgatgaactgatgatgctctccggcgtgaggcggcgagttttcgagcgaggcttcggattaggcgagcgaggcgtgggcggcgtaagccgcggaaggtggtgataaagggtgggggaagtgacagagcggacggcccagatctcgcgggagctgggagacgtggccgaacgggatgcgggttcgcgctcgccgcgctcgtgtggagtttggacttgccgccgcgagttcgattagggccgttcgggcctttttctctggtggattgtgtgccttgtgtgcctaataagcccgcggattttgtgcccgccgcgccacgagactactcgtagcggatgagatcagttaccgtggtattcggccgaggtttcccatgcgtaccggactaccaggccttgcttctcccgtagcttacgtgtaaacgacgaccccctgtgccaaaccaatccccggttgggatgaatgtattacagtagatttgtttttctgggatgcatgccttcttgtctgtcatacgtctcgtgcaatcgtatcgtatcagaaatcctgttctaaccgatatgttcggcactttgcatggattttgctatatctcctgtcaagatctcaatagcttccaccttccctagctcttgatcgaccatcaaactgaatttcggacgaagaaaatcagccagccatggacagcgaggaggaccctttgttgaggttaatgaacaaagtcagcttcctgttctggacgacactgttaccagtttttctgctagggatcttcgtcggcgcccttctttccaaagaatgcgagaaggccaagtacaccatggatctcgccgccgtcgaggggatggacgtcgccgccgtcagcacggttgtctcccccgcgttcaacctcaagctgcgcgccgagaacccgcgcgccttccggccatggtgtctcgaccgcggggacgtggtggtgtcctactccggcgtggcactcgcgtgggggcgcgtcccgggcttctgcgtgaggaggagggcgatggccgagctcacggtggtgccctggggcaaggacgtccggttgtcggaggatctacgcgaccttcttgtctcagagttgcagcagggcacagcgaaggtttccgtcgagatgaagctgcactactacgctaatttcggcatggctgccttcgcgcccagctctgggacgacgtcgatttcacaggagcttctcctggactcctgggaggacaacatgaatagcagtttgctcaagacgaaggctggtctcccgggaagacaagatgaataatatagtttattcaagatgaatcctgacgagttattctttttctttgttgcgttttcttttgtgaactcagcataattttgcttcttctaattaatataataacatttcgtattataagtaattttattttttagtcaaattttattgatcaaatgtataaaaaatatagcaatatttttgactaaaaacaaatgcataaaaaatttattgcaccgccctctgtttgtgttgtgttgagtcagcaagcccgctcctgttctcatccaccacaagggcaatgcagcacccctcctcacatatgccaccaccactaagctcgtcggcaacctccactttcgtagctgccctccttcctagctcggcggtagccaccacctcccatggcctacccgcccttccacccaagctcgtcgagcggatttgagctgttcgacctttgtctcccataagctcctaggttcgtcgcccggattctagctcgccaatgctagaaaatttcacctcttgcgcagccttcctcccaagcttgtaagttggatctgagctaaccgatgaccttcattttcctctaggcccacctcatgagtcatgccggacaaatgcgatgaatggacagaggatgtgattcccatcgcgtgtcatgggaagggaaggacctctccagtctccacaattgcttcaagttattccccatcgtgcccctattaattaaacaattggattttatttggtacatgacaacagtggtacttggtgatacctcctcaagaattgtaaaaattctcggttttctatacaatttatgtgcacgctctctctgtccctctcttttggctggtggttgccaatgaaaataatcgtgtgttcaacgctgagggaaggggggacgacgagtctcatcagcagaggatcccgttagagaggagtggaggaatctgttgctgatggagggataggcagccaagctgagtggagaaattatgagaaattaccaatatggcgaaactaggtataatagaaatctcttttttttaataatggaatataataaaattttctttataaaacaatattaaaatgtcaaattgttgttagcggtcaggtgatggtattttctcgatgccaaagcgtataatttcataaggaacgaggaataactgtggtgcattcatcgataactgttcaattcatcaaaaattgatctcaatagaatataatgatcataatgatgattttccacgtataaggtaacataaacggcatccattttggtcagtggacaatggcacaataatttaatttacataataaatataataaactaaaaaaat

SEQ ID NO: 81077 - DNA, 5932 bp, Oryza sativa
caacaggtgtctaacaatctaagaagatgtttagtgagaataattaaagcttcaatatcaaatactagaaaattggattttctatatagttttttcaatataataatttttttcgtaatatttactagtgatatttagtaatataatggaggcaaagctaatactcgtgtggaatcatgcgggataaccaattttacatcctcaaattaatcatgcaaaaacgtcacaaactgtaatcatgcatgcatgcatgcaagagatttttctcgatgatgataccatccggtcgaccaggcgggggagcaaaaatcgggcgctccccccacccctgcccccccgtgcaccactgggcctcacaacagtgcctgcccccacctacaacaaatcaaccatatattttggaacccttggtttattttttgttccactaaaaatgtttcaactagtgtactcacaatattttattatgtatagatataatgttgcagtgaactgaaatattccattgcaacaaaaaacccacatattttggaaaccctctattaagggaattcgttttattttttttccaccgaaaaatgtttcacctagtgtacttataatgtttcactatgtatggatcaaatgttgtagtgaactgaagcattctttcgctatttgctgaaacattgtttttatataaggtgaaacaacacccgatttaaacgagtgaaacattttcgatctacatagtgaagcaattccgatatacttggtggaacatcgtgcaacatttaaaaataattcaataataagataattttttttttcatcggaatatatgcatgtgtggtcttgttttgaagatttaattgcaacgaatttaatggtacaatcggatcatgatttagataagtaatttaagagaaaaatcagtttaaagtagttttgcacgtaaatcggacactgacgtcatactgacgtcagcgcccgatttttctccaaatcgatcgggcacccgagccgtagactcgtccgctttttctatatcgatttgttacggttggcttcggaaagttgtgctccctctgcccaggtgccgaaatacgcggtgctaattacatgcacatgcatgtgcagccgagcgagcgacagctatatatatcggaccgcgctcgcgacgagcgaacactcgcgagtcgcaacaactatatatatatatatatatatatgtatatatatatatatatatgtatatatatatatatatatatgtatatatatatgtatgtatgtatgtatgtatgtatatgtgtgtgtggctaatgggcgattcatcgctccccatccccctatacactctcttctcccttcctagctcctccccttcttctcttcctactacaccataaattttaaaaaaaataaaaaaacaaagttaaaaaaaattatgtattgaaatactatatataaaaaatatttgaatttaaatttaaatttgaaactggtatgtaaacttttgacttataaactttgggtctataaactaatatttgaattcaaattcaaatttgaatcgggtatgtaaacttttgacttataaactttgggtctatgaactttaggtgtataaactttatatgcatagaaatactatatataaaaaaatatttgaattcaaattcaaatttgaatcgggtatataaacttttggcttataaactttaggtctataaactttaggtgtataaactttagatgtataaaatactacatatataaaatatttgaattcaaatttaaatttgaatcggatatataaacttttgatttataaactttgggtgtataaatttactaaaatagaaaagtaatacggtgccaagaaagaaaatcgcgtggaggagaggagaggggggcgatcgctaggggcaatcgatcgccccttagcaatctttcgtcacgccggcggctgccaaaaggcgtcagcgacgtgcaacccccagcgccgcaagatctttgtcgttaacctgctttatgaattcaccaattacattttcgtattcgtactacctccatcccaaaataagtgcagccatgagtttccgcgctcaactttaatcgtccgtcttatttgaaatttttttataattaacatttttgttgttataagatgataaaacatgaacaatactttactcgtgacttatgtaaattaaaataagacgaatgatcaaagttggacgcgaaaaatcatggctgcacttattttgagacgaagggagtatcacgtattctacgacttcccatccgagttttccgtccagatcacggccacccgcggcctcgacgacgcggcgccggcggctccgacgatcatctcccctgccatcgacgtcacacttcacgtcaacaaccggcggggcacggcgagatgctaccgcggcggtggtgagctacgagggcttcaccgtcgcgtccggcaccgtgccgggcttctgcgtgccggggaagagggcacgggaggtgccgttcctggcgtcggccgacggcgtgggtctacctcagcggcttcgcgaccgcatggcggtggagaggcgtatcggcgccatgcagctggaggtcgaggtgaagctgttcgggcgcgacgacggcggcacggcgcccaggccgacgtggatgtcgtgcgggctgaggatggatgaagcgcagctgccgaacacggcacattgcacggtgttggctttgcagaattggttctctcaacccttgttcggataacagaagattaggatcaatcttttacagtggtcaaagggaaattaaactcaaaaatctctgccgatctataaagggatcgccaaagggatttcctctggttcatgagaatggtaccgcatgcaggtgttccaattggttagcgtatttcttgtatcagacagtaattgcattaataattacttcagcttggtcgatcggaataattagtaaggcagcttcaacaaagatttggttgtgcacgctatttttctgttatgtgttaattaaaccataatttatacgaaagacaaatgtgtaacaccgatcgtgccgaatatcttcaacactcgtacaaaaataaacaagaaaaaaatgtagcatgcatgacatgtgcagtggtgtatcttagaatttttatatgaataatccaacttttacatgtgcctgtgtgttagatatcctgaatatttttctcggtctcttcgtagccgtatccacgtggccgtatctcagccatcattaaatgattggatggctacggaagggttgtttgttgaagaccaaactgtacatgcgcattggatagattttacccaaagaaaaataagtactctcttcgtatgaattttgagcaagcacctggtcaaactaatgccaggagtacggagtaccgttgtcttaaatattgtgattgattacgtgaaaatcaattttagttacaacagaaataaatgacaataaggtacaaatgcacgagaacaactgacaatttttttcgaggaccgagaacttattattaaggggccccatcgtttggccataggctgataatatgccatatgacatattagataaaaaatatgagtaaaacttttatatgtgtccttagcgagttaaaagtcaatgttaaaaaaataaatttcgatgaaaaaattttacaatcaacttcaaatttaagttttaaaattcaaattttgacattggctgattctatataggggcaaacgaggtggggtgcaagccagggcggatctacccatatgccataggcagggtgggtcgactaacccagctacgacacgtgtcgtcttacccccctcccccaaagaccccctaccccccttatagtaagtcttgggtcatcaaaattaggtatacaaggtgtgaacgtccaacatattagtttatctcttcacaacgcatgcatgccacaaacaatgatcgaggcaattatgcgattgaactataaatacggatatgtgttgtgtttaattgctcttatcgagtgaacatctccattctacgtcccatatatatttggaagctacatccgcctagcaaagattgtacatagtgacaataatgatggcactatagttttgaccagccgagcataatatatggcaacaataggagaaaataaaaaaaacacgtagaaaagtgaatccaccactaataacttaatagaaatcaacttagtagttgcatatccttcagtccacttctgacttctgagaactaagataaaaaaaaagtattgctgcttgcactcccaggtcgctcaccctgcaatctagcaactctgccagccttccgttcaaaatagagggataacaatggatataaaagcatctaacgttctaataccccagtagaacaaacgacacttgaatgccctatgcttcttcatcactatattcatcgtcatcatcctcttcatcatccacccaagaagcaccataatcctcgtcttgaacagcctctccagtgaaccaagaaacaacatgtggtataatcttgtccctgagagtagatctggcaacatgggcaagctaatttataacgagataatatatacaggaagtatgttgtttcataaataatttgaagaattgtgtctttcagtataacgtatcatgcataataacacaatagtaatcacttctcctttagaaaaaaaacaattctaatcggttaagaatgcaatggagcataatagcttacgcaatgtcataatctcgttccatttggttctgcaattcttcagcctgttaagcagcagcagcgaaaaaggccataagtttgggcataatgtttcaggaatcaatgtatgtagaataattacttgttcaacttacggtattttcgtcaatttttgcatcatcctctggaacttgaggggggctgaagaagttaaagaagctctcatattcttcagtctttgttataggtttagtgctctctgaactctcttttgttagcacctcctgtgtcaaacaatttcctggatgccattcgatttcagtcctaagaaaaaaagcggtcagggaatatttcaaataggaaatgcacgagagattttttttcatcataataaaaacacaaatttgcagaaataaaatgatatatacccaattgctttctctaggatgggttcatcatcttcatcaatcatgtggtatgttttagtcagcacttgatttttaaagaagggatttgtatcgaaaaagaattcgaacttaaaaccctttggatcatcaattctgcaccatttgatgtccttaaggtacttcagagcttcctcatcgctctcatggatctggcaatggaaaaggaaaaaaatattcattacaagaatcattggcacttcattatctaaaaaaaatggcactaagcaaatcagcacactgaacaaataaataagctcaagttctaatgagagcatgagaacataaacattgataaattagaaagtgggaatttacaaactagaaaagcctctcacctcctcagcaagaatctcattgttcttcattgctttgagccagaaatctggaacacccttttcctctgcatggaaccatcgtgagattatagaaaaaaactaaaagggtacccaatctatcaataaccccagacgtgcccagaacacctatagtatgaataagaatgatatatcacctctttcttcagtctcgccctctacttcaagaacaccactcacaatttcagaacgctggaaatttgtaagcacaaaaaaggtcaccagaacaacacatcatatttaaaactcagaaacataattcaagatatgtttcttaaagaagagctgcctatacacaaaacagacaactctttttgaaaagaaagataagtggggtaaggctagattgcgttacagggctgcaggaat

SEQ ID NO: 81078 - DNA, 2073 bp, Oryza sativa
ctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgcgaacggacggccgagattgatccgatccaaatcggacggctgagattgatcgagtccacggcggttcacggcggacggccttgatgacgccagcaatgacgtcaccgacggcggcggcggctcggctcggcagacggctcgggcggcgcacgctcaccggcgaacggcggcgctacggcacgaacggaggacaccaacgggtagcggacggcacggcgaacacaccgacgaccaaaacgacggcggagaagcaacggacggcgacggcgacgagaaggaagcggcggctaccttcgggttgtcgacggcgacgaagctccagcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctactccggcgacgagaggcgaaggcgagggctgcgacgggtagaggagacaccgggggtccttttaaaggggctcggaggcggcggcgaaggcccacggcgacggcaacggcgaaggaaactcgcggcttggaaagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaagcggcggcgacggcagctcggcggcgcgaaactagggtttcggcccgaggaagacgacgactgacgggtgggccccacctgtcagcggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcg

SEQ ID NO: 81079 - DNA, 661 bp, Oryza sativa
attactgcaccaactagaactgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatagccgcttgttcagttgcaacaagaagctgatcgacaacacacttgaagaatgaccttggtttccatcaaggacttacagtttggaggaacaaacatagtgcaaataaatacatattagctgagaaaaagctaacagaataaaaggaaaggaaaaaaataacaaagatgtttgtgtttgtgtgtgtcgtgtttggggcggtgggggtgaggatacgatgatgtcagtgcaggtgaagctcccattcttgttttatctggaacagatgcaagtagttgagcaacccttgaaatgaaagctgctctgcctgggttcaagttgtcatcatcgtgcttgctgcttacagtaaactctgcaataatctggctgacccccttattctcgaccaaacatagaattaacagcctgaaatggggggaaataatgacacaccaagctcaaaacata

SEQ ID NO: 81080 - DNA, 2080 bp, Oryza sativa
ccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcggagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttgg

SEQ ID NO: 81081 - DNA, 2793 bp, Oryza sativa
tcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctacattccttgcgtcctccacaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccactgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggagg

SEQ ID NO: 81082 - DNA, 129535 bp, Oryza sativa
  unsure (1)..(129535): unsure at all n locations
ggtttaccaagtttggcggggaagcaacgtaagcgctctctagctctctgtctctttctgtctagcttcatggagcaattcgattttgtttgcctgtgaacggtggatctggatctgggcgcgcgcgcgcgagattagctgcagcttttagggaggatttttagccgttttattatgtgactgggcgcaggcgtgggaggaaatgagatgttttcggtttcacgtgttcgcgatttgtgtgatgcttatgttcgaaatgcgagtttaggggcttggtgtgacagaaatttgagccgtatttgatgcttactgtagactgttcgtgttctagttgtttatggttgggaaatatagctctggatgggtggaaatcagttcatattcgaatcatgaaatgttgatacagctaggggaaagtgtgtgctttctattgttacgagaatacacagcagaaaatgttttatatttatgttcagtgcttcagtttatttatcaggttgggtggggactggggaatgctagttcattagtttgttggggaagctacttcaattttcagaatatgaacttttaatgactcttacatgattatgaggatcatggaatggggactgcagcttttggtagtacaatatgttgggaatgtttgatacagaaagtaaaatgttttatatctgttgtgcagtgattagttttggcgagaaacacattatatattggaccgtaaaatgctttggttggaaatgtgttatgctctatatttctcgtagaactgaaacataccgagacaatggtaattttggtctaattgtctaaatgatccttttgattcctttgatggggtacttggatgcatttttaagtagaagaatttattcaatgatagcttctttgatcctttttattcctttgatgggatacttggaggcatttttttaagtagaagaatttattccaggatagtgtcatgctttagctcatctacagagtggtctatgcacagcgacctttgtacatgattcaatcacattctggcaggtgtaccgtcaataaattagtgcacgcttcgtctgttgaacaagaggtgaatgaggcatttgtgtatggagattacctcatattaccatctcgttcctggcatctccgtttcactagattctccaattgggacagcgtgcaactagaacaaacaatccattcaaacatctgtcatctgcatagtagtgtgcttaaggttgtgattagccaacgatgtgggatgatgaataatcttgtggccttataaagaagcaaggattaggaaatctttctgggagtttggatgtactttatttttttggcaagagtgaggctgttttcttattaaaaaatttcttagcttgtggatataattgtccatccacctaattttaacaagctagagaagttcttgatatggtacacattccgtgcttgggagaaacagctaggaatgtttcatattacaaagccgctgagttacatttttagatatcatttcctgtttctgattatttggttgttttcatgagattttagttttcttttgcccttctcactattagtgttagcagcttttaaccttgctatattgagacatcactatttaatgccataaagtgccacttttttggctaatcgactctgttttaaaaaatagcatgctgaccgttttttttataaattcacttatatatttgcaattatttcttctagtttcacgcattggattcattgataacaattatggatctttttttcaggagtttttcttgcaaggccggttcatttttggaccagatgtgagatctttgtttctcactatattcctcattcttgcaccagtattagtcttctgtatatttgtggctagacatctgatcaatgacttccctgatcactggggagtttcagttatggtcgtagtggtcgtcttcacaatatatgtaagtattgctaatttgctgcttctcatttttttttcttgttccctctaaattgattgaaggctgtcttagttctgctactctgaatttggttcatatgacagttcaaccatgttctctttatctcctagcgcttgcatgatcagtaaaatttctggccatgaataaaactattatgccaagggtttttattttagttagatgattatcaaaatcggataaatctgtcaaaagtgatgcacattcatgtgtaaagagtaacatagtataatgtgtatgggaaacacataaaaatgtgattggctactcaaacattgttatccatatgaaagggagttatgtgccgagtgaataaattactttgacagtgtaatttattatgtttggttgtttgctgcatttatttcccgagtgaatatgcactgctgcagtgtgtgcaattaactgaagcttcatttaattttccaggatttgacattgctgcttcttacctctggtagagatcctggtatagtaccacgtaatactcacccacctgagcctgaatcgattgatggaggcagtgatatgggaaatggacagactccacaacaactacgtttaccacgcacgaaggatgttttcgttaatggagtaattgtgaaggtcaaatactgtgatacctgcatgctgtaccggccacctcgatgctctcactgttctatatgtaataactgtgtggagcgttttgatcatcactgcccttgggttgggcaatgcattggaagggtaagtatcttgatgtgttggaaggtttaagatatccttattgcaattagcttgaagatttgatatcatgtgcggtgttgtggtctgtatacctcttgttggattttctatattagatattagtagattgttagttactactttaaagttttaacaagtcagcgctaattatcaacttatctgctgcagcgaaattaccgattcttctacatgtttgtattctcaaccacattgctgtgcctctatgtctttggcttctgttgggtgtacattgttaaaataagagatgctgaaaattcaacgatatggaaagcaatgttaaagacaccggcatcaattgtcctgatcatctactgctttatttgcgtgtggttcgttggtggtctgtctgtctttcatttctacctgatgagcaccaatcaggttggtatcctttcggtttttttttaagtttttacaaataaatctttcaagcatagcttaatgacttgttaaccgtccttttctttacttgtgtgtatcagacaacctatgagaactttaggtatcggtacgatcggcgggctaacccatataacagaggtatggtgaacaactttctggagatcttctgcactgcaattcctccttccaagaacaattttcgagctagggtcccagtggatcaaggtttacaacaaacacgcacgcctgctaggggtttcatgagcccgaacatgggtaaaccagttggagatcttgaattgggtaggaaacccgtatcatgggatgagcctcggtcagcagcagatatcagagatttggaagttggccttgggggtcttttggatgagaaagagggtagaatagcccatgcatccccagatctttctcttccgggtgagcttgtggaaggtagggctggtatgcattcgagacgatcaagttggggtcacagaagcggaacctcagagtcgatggacagcatcgctgtgcaaatgggaaccgaagctaactggggttcaatcagcagcggccatggtaccaccagttcaactcactagcacacatcactgcatttctgacgctgcatctgcatctattggatccatctcatgaatgaagaaccatgtgtgtactctcttctcctgtgctgcttttcaccttaggatatatacacagtgctttcttcctcccgtcctctgttgttgttccatcctggaatgggcatctattgatgcacatcctgttctagtgtctttaagcaaaaataacagaagatctttaactcaatgcgtggcttggattatctatctgtatatatcgagtctgtaagcaaggttgtcgtgtttggtttggtttggttttcgacgttctgtaactgtaccatgctgctcgactcttactcaagaaatactactacccaaatcatcctctttttctaatgcaattctttttcttcaagtctctaattggattgttttttttttctttttgggacatggtataccatctgcttcgcattcttctgcatgctgagctgctccttatttgattcttgtgttatctgctcaaccttttgtattcctttgcatactgagctgctcattggtactatgaattcggtgtaaaaattaacttcaaattcaatttgctcgaaaactttcattagcatatactccatgtaatttatccagaaaaacaaaagcccagttgcaattgcaacgggggtgttctgctgggttattttaatacagatgccactgaagcgtgtgcagcatctggctcgcgccgaccaatcactcaacctgcaacagttgcaacagtgggcttgtgtgtttggcatgctttccaacgcaaaaagggcacatgctgagctgcactctcctgctctcgcagcaatgcaatgcagaagcagcgtcgcttttggtgctcccatgaaaattctgtggcatcgccagtgccaagcattcaagtatattttgtaccaccattttcttgctcataccagagaaaaatcatcataagaaactttgtattttgagtgttcttctgtgtgtcatgatcatatgttcagtgaggcatgttcttacatgtttcacagagcttcagttccgctaaaaaagagagcagagtgggctaaagtgatcttaaaaaattaaactagaagggtgaagcgagtctcgggccactccacagctacactttagactccgctcctaaagttaggtttataagttagagtcctataaaacaaactcgggtttatgacgattattcaaggacaaaaacaattaattatatattagaaagtcgaaaagttgttttataaaagttttctaagaaatgttgaagtttttttttggcaaaaaaaatgtaatatttaggaggctggaaagcgtgcccacgataatccataagccattgtgttaggtcaagttggatcgttgtgacacatcagtcaccaaatcaaaaccgttccaaccacagttaagtacagaaaatctgaatggattcatgtgagagtgaataaataatcatcactaagaatcaagcagaatcaagcaggaaaatgcatgtttgattcccctgccaggagttcctgatgcaagcagatgaagccagtaagtacgtagtagtagtggcctccagctcgagcagcagtgcagcactagaactgatccagaaacatcaaattttccaacaaatcaaagttcagaaactggcatgtcatacatggaaaattcatactcctaagtgcctgcacctgaagatcctgtggatacaagcaatggtgtatatttggcacacaatccaaataattaactagagcagattccattgagtggcaaaaggagatgatatgatcaggttagtggcttgtaggcaagtggagatcaatgaggaggtgaggaggagatgaatcgtatctttggtctcctcttatcttcttctttttgaatttaatcttcctttccaataattgaaatgttcataattcatcagaacattataaatgattaagagttaactatctagttcttcaattagctcaagggaagcttctgtcttctcattgatacacatggtaccggcagggtttcccaaaccaccggggccggggttaccacgccccggcggtaggtaaccgtgaaaaaccatgcaaaatttatcaaaaatttaaattattttttaaatttatttgaatttaaggaggttaccgtggtatttatattaccgtaccccgcggtaagtccggtaaccgcgcagttaccgacggtaagggaaaccctgggtaggtataggtaggtaaccatgtaccgaatagctggataagactgtgacaaactctgcattttgccctcctttttcttgtgctgatctgagaaaagaacacatttatgcatctgcttaactagacccaagaaacgtgcacgaatacacatcagctcagtactctccgcagaaaagattttctcaggcttgtcttcagccacagcaggaactccacttgatcagtaataatgcatgcatgcatgccaagcacttactagcaacactacttcttcttgttcatcttcttcgtcgccatctcgataaaacttgccgttcttggagaaagtaaaggcacagttgggcagctgcattattgaatggttcagctattcaccagcatgctgaaaattattcagctgttcagtagctagtagaagcagagaaggtgccagtgaaacaagcactgaaacatttccgtttcatcgcctcctcattgccgcgatgcagaaaaggcctcgtcgctgcatgcacataatgtattaccaccaagctttgatccgacaagtggcaggcaaatgtgatttgcagctgtaaagcaagtaaaaaaaaggtataattgtccatggtttgatggtgaaatgtaacttactgatcaaccagatgcaaagctagtttcagctggtaattaactttggccatctctgatagatgcaactagcttaattgtgttgtgtttctgtgactcttgtgtgtggtgcatcatgtatccacatacttacatttactctttgtgttcatgagaattggcatgcagctagctagcagcattgctgaacctgaatgctgatcagttcagaaaaaatcagatatgagcgccgatcaatggatggaaagagaaaaggcctaaccttgactgaaccggccacattgctatagtgctgtactgttgtctgcatgcatgcatctctcttgtcagtgctggtcatggatgtgtattaacagtagtagtacattatgtaatgcgtctttgcaattaaaatgcacagtatagtagtaacaaaaacatgcccttttcttcccatagttttggggtccatgcaggtaattcatgtgcagattctgatactgatgatctgacagactgacaacacatgaaacctcagatgcaactggagaagacataatttgattacactctacaatatctaaatatgtctctcctatgtactaactttttgaatacattcctgaatttagttaatggaaggattattatctgacaaatgttcaattattcagtaagacttcaggttatagcaaacagtaggagtataatatctctggaccacttaggcacttaggcaccatgtagatacgtacatatgtaacatatgagaagaagagaagctctactactatatatacaaggcttctacccccaatgccaagcacacaaacattgggtgcagtagtgaatcctcttcagaagttcagaaaactatagcttgcttttagcatatataaattaggtgtttttatcttcttttgagaaggagatcaagaacaggcagtaggaggcctcttcctcttctccatggatcacctttgggcctctgtctttgggattcttggtaagcatctcatgcatgctagttcaccatctatacatgcatccatatggtagcatatggcatggcatggtctcccaaatcatgattttgtttaattatatgtatgacctcaagatatattattcttactgacatgcatgaaaaatgcacttttcttctccacaggaaacatcgtctcattcctggttttcctcgcaccgatgtgagttttgctcatttacgccctgattttttcttttccaaatcattcattcacctaaacttaattacgcgttctgacaagtgcacaattaaattttattttttactaaaaaacttaactacgcgcacgtcctgactcctgacacgcgtgtagttaagctttgtcttgttcttaaaaaaaacaaaagaagaaaaaaatctcaataactacgcgttgtggggattgtgccagagttttgaatttcaaaacatgtctttttgccagtggggactgaaagaactgaaatcaccgaaattttggtaatttcggattttttttgaattttcaacatattttgattaaatctgaataaatttacaaatatttgacaaaaaccgaaaatttcggggagactttgtgcttgccggtggggcccgaaattttcgaaccgaaatttcaaaccaatggatggtgcaggccgacgttcctgagggtgtacaggaagaagtcgacggaggggttcagctcggtgccgtacgtggtggcgctcttcagctgcacgctgtggatactgtacgccatggtgaagaccaactccagccccctcctcaccatcaacgccttcggctgcgtcgtcgaggccgcctacatcgccgtctacctcgtctacgcccccaggccggccaggctcagggcgctcacctccttcctcctcctcaacgtcgccgccttctccctcgtcgtcgtcgtcaccgtcgccgccgtcgcccagccccaccgcgtcagggtgctcggctccatctgcctcgccttctccatggccgtcttcgtcgcccccatgagcgtcatcgtaagaagctctcacctcatcgatcagctcttttcttttaaagatatataatgaaagtttttattgaactcagccaattacatcatatgatattataactgtagtaagaacattccccaacttgaactcaactcatcagttttttttaatataatgaaagcttttattgaactcagccaatattacgtcagatgatacaaccgtgctaagaacactttcaacatgaactcatttcatcagtttttttttaagatgatggaagctttattgaactcagccgattacatcagatgatacgatcattagcttgaactcagctcattagctttatcttttttaagataatggaagttttattggactgagccgattacatcagatgatacgatcgtactactgagaacactttcaacatgaactcagatcatcagctagtgatgatcttgcatcgtacttgttgagacatgtttgctgatcaatcgatcgatggatggatggttttgcagatggtggtgatcaagacgaaaagcgcggagttcatgccgttctcgctctccttcttcctcacgctcagcgccgtcgcctggttcttctacggcctcttcaccaacgacctctacgtcacggtaattaaacatctcgatcgatatcacatcaaatcttgatcaattctctcgaccaattcatgaatttcaatcaaagtttgaattgtttaatttgcgtgtagcttccgaacgtgggaggcttcttcttcggctgcgtccagatggcgctctacttcaaataccggaagcccaatacggctgccggcggcgtgatgatcctgccgacgacggcggctgcggcggcggtcgacggcgccgtggctgagcctgcggcggcggcgcagcagctggcggaggagctggaaatggagctcgcggccgcaggcgcgcacgcggtggccgtgctgccggcgagcgcgctgcccgtgctggccgagctgcacaagatggagcaggagatcgggacgccgcgcaagggcgccaccaagaccgtctgacacgtggctcgcctccattggttgtcgagtgccatgtcatcatcgtgattattatatatatgggcaaaatgcatcatacccagtagtaaatttcttaatttcagctgtttgtttgcgttccatttgtgtgtttgaattgagtttgtattgtgcaattatcccaagaaaaaagaaatgtgcatgtattggttatgattaattaaattaattcgtatcctatcaagcatagttgcaagtcgagactatcttttttcttcctagccattgggtctccaatccaaaggtgagacagcccatctgaacttcgcggtccagtcagcccaagctcattaggcccagtatctctctgcaacatttttgcatttttttttctttctttgataaactcctctagtgaatatgtgcataactgaaatggacgctggcctgacaagatcaaattaaaaccaactcttatgtttgagccatagctcacaagtcacaaaacaacaagtgattcaaacaaatcagaaacaataagtactccagtgatcttgcagggggaggcagtattctatccaagcagactgtttgctaataatcttatgaccatgaggccccagaaaaaaaaaatcacatgcactattttagacttcccaatttatttctacacataaaattttaaaagggaaaaaaaaagagaaagaaagacgagaccacacagcagcagctagtgcttgaccagcctctctcccatgtctccactccagtccaagccgattcacatgcatttgttctgttgcatgtatgcttcctcttcctcctctcctctcctctcctctcctccccatttctcatcttctctctctttctctcttactccaatctgatctccattgctcaccttcctagtagcttagctgatctcaatggcgacaatggcgagctcaggagcagcagcagcagccatggccgtgttcttggcaatggcgctggtgttgagtggcactgaggccaggttcctgtccaacaacatcactgtggttggctctgtctactgtgatgcctgctccaacaacactttctccaagcacagcttcttcttgaagggtgagtagaaatggtagtatacctgttacacagtagctcagctgcattagagttagttttgatcaatgtgtcattctgcattgtggtcaatcaatggtttgttctgaaatatggtggataaacatggagtgtttttacagcaggttattctttgtttctgagatagatttacaagatgctgtaaatctcttgctcattgcacagtacaaccacatgtaggatgtcttagaagtattaggttttttttttctgttctaggaagatgtcactgaaaagtgaaaactaataggcaagcgtgacaagacttctttttgagtacattgattccctatgaatctaaaggagacagagaaaagttgacatatgcacaattgcacataaatgtgtctgtggcttgttctggatttataattggtctggtcaattttcttggtccaattgtaattgttgtttagttttagttaatgctaccatgaaagacaagatgcctcacacaatataactcaagtttcttaggcccacttaaagcttggcatacactaactgaagttgaaatacaactgacaattactacattgtgccttcaattgcataaatgcagtatcatccagcttctactacccatctgggctctggcattgcaaacagaagttttaactggctctgagatgtgcttgttacacagtttcaattcagagttttgatcttttttttaaatggaaaaaaaatgtttctgtcggttattttgagcgggatatacctctaaatctcataatgctatgcaaattacaatgctgcctcaagctagaaatttccatgtttttggctttgttctaaaaataacgatttcattatcctaatagaacatagtgtctatgagttgccaaagtatgacattgcactatattaccaatgcctcattctacattgccactaaaactaaagctaagatcattcacaagagcagctggtttcatagatttcatcattgcattcaatctgaaatctgaacaagtaaaaatcagtaacttaccagatatgaaattgtcttcatctttggcaagaactgagatgctgaagccacaccactaatggccaccatggtgatggatgctgtgcaggggccagggtgctgatccagtgcagcttcaaggtgaactccaccatggccgaggagctgtccctggaggcggagcgcaccacggaccagaacggcgtgtacaagctcgacgtgccggccgccggcggcttcgactgccgggagggccacgacctccggtcggcgtgccgcgccacgctcgtccggagctcctccgccgcctgcaacgtcccgggcctccggggatccacgcagcacatcgccctccgctcccgcgccaccaacgcctgcttcctcaacctcaacgcgctcaacttccgccccgccaagcgcgacgccgcgctctgccacggcggcgatggcgccggcgccggcggcggcgctgcgttcggctcgtcgctcttcttctggccgttcttgccgctcttctggccgccgtaccggctcccgggcggcggcggcgggacggtgtcgttcccgtggccgttccccgtgccggactggctggtgccattcctgcggccgccgttcttgccattcacgctgtaccagccggcgccggcgggctccgcgccgccgccgttctaccgcttcccgccttcccaagaagcatcaccatctcagccttagacctgaaaaagtacaaaaaaaaaacttgccaagattaatcctagattcttcatgtttagcagcaagagaggttgtgtgattgtgacattgttgtaggtgatgattctccctgcatcacacgtgtagctggagctagttcaggaattgccaccgtgttcatcgggctgatgaatatgtggaagtgataattataatgtagtgatggcaacttgttagtagtattcggtatattgtcttaaaatatttcctcgctgcagctaatttttcaatcatatttatatactgatgaatgatattgcagccgctaacactatcttggtactctttttttttacgaaccggcacttagaatgtgccaatttcattgaatagagggagaaatcctgataccgtttttctcacaatttaaacttcattcctaaaggaaataaactggacaactattttgaaaccgagagagtaattgacagatacaaaatagtaaaacttgtcagttgggtgaactcatgaaggtatatgcctgattcagtccagacatgaaccaaggaaaagtttcttcgtctgcgtgtaccagcagagtaactacccaatttgcatatggcacgaggaacaggtacacatatgtctctaaccgactgctgaaagtagagttcatcagaattgattgcttcgtcttgtctcgcggattttactggcatggaacatggtatgttttttgccaagcccaatggttttttgatttcttccagtggaactgacagtgcagtttgacaaggaaaaggggaagcagacacaagataggacacggtctgtttcatcatgtaaaaatgcatggttcagaagtaatttggctcctggaaacacttcgcagtgatgacatttcaaagttcagtttgattcaactattcagcaatcggttccaacatacacaaatctagctctgttaatctgaataaatattctcaaccaataacaaatggttaaacttatacggagtatattcttagacccaggagcagatgtgtcaaattgaggagagttgacaaggactaggcgaccaagactgaatccataacaaaacaaccgaccatttggagcgttgcattgggtgagaaaaagaacaaagaatcctgtttaggctaaacaacccttgtggctggggagttggacacctccattctaagtacaatcatgcacacaggtcaagaggtgtttatagctaaatctaatgcattattgacatgacgccactggcctctccaagtcggccatggcgtcactctttgcacacttgcaactcctgctccagttattaaccttccggtgctgccgtacctcatgtatactactaaatcactgcatccatggaccaagtacttaaatgctatatatgcaatcttcagttgtacttaaattctatatatatgcaatcttcaattgtacttcaattcaatatatctactctttaattgtaattaaattctatatatgaaatcattaattgtgcaagaaccatggatatctgcccccaatccaaaagatggcctttggaccaagaaccttgcttggtccatctatatatatcattcaccacctctcctttcaccttcccacatgttcttgcttaatcctttcactaaatgtgtaaacaagttgtcgatgtgccaccattagaaggagcatttgcaactttgtaatcactagctaactaaaaagaggaagctgttgtatacgtacgtgagcgtgggcatggccgagaagaagctggcaatggcggagagagggcggaggggcctgatcatgaagacgctggaccggtgccggccgccggcgtggaggaggccggcggaggggtgcctctcggtgtacgtcggcgcggcgcggcagcggttcgtcgtccggacggcgagcgtgaaccacccgctgttccggccgctgctggaggaggccgaggaggcgttcgggtacgcggcggcggggccgctgcagctgccgtgcgacgccgccgtgttcgccagggtgctggagcagatcgaggaggaggaggaggagacggcggccgccggcgacgtggcggcgaggaggtgcggcctcgccgccagagggcactccgcctaccggctgctcgtccccggcggccggcctgccctcgccggccggtcgtaggacggtgcagacatgcagtggagtgtttcttgtccatcgacttatcttgagcttgtggctctgatgataaatccacctaaatcaattaatgtatctgcaaatcatgaatattgcaacaagaggttagtgcttagtactagtagttgatcagatcttgggcttgagtttttcttttgttgagctcatattcacagaagatatgtgtatctcttaggtcgcagtaactgttgatcagttgatgcaaatgttatatattcaaattccctagctttggatatttatgatacagatttcccaagctttgaatgtttatgatacaaatctccctaacttggaatgttttatggtggaatgatgcttagaattataaataggttgcatatttgaatgcatctcacattgataagtttgtagtttttggcctcctgcagttcacttgtcaattgtcatgcatgtattcattatttttttataccaagcttctttaagtctactattcaatacatataatattaaaaagactcaatgcttcaaaaaccaaataataagtcaagatagcaattagcaagcaacacagcagaaacacggtgacgagtggaaaaatgggtcaacaatggacaaagaaccagtactaaccagcatgtacagaagattgaattcaaaaaaaggaaaaaaaatctagtgaatcactgcacatacctcctggtgctttgcttggcttgctagaaggttgaatcaacataagggactacaagtattcagcaattaacatctactgaggcagcacctatgctgttattttcagcagcacttgagggacattttgtcaaaaaatccaaatctgaaaatttcaatgtaatatgatatgcagttaatgattaacttttcttttttgctgggtcggccgaaaatcaaccaaccgaattgtattaagaagaaaagagagagttcaggttacaaaacgacattaaactgttgaaaagggcaaacagccaaccacgaaagcagcaaactgatgtccctaaaaggaaaaaagcctgggcacaactaatgtttcagtgttaacttggataacgaaaacaacagcatagaatttaaaatggctaggttccctgtacttttgacatctgtagagtcaaatgacaggggccacattgtttcgctagccctagtatcatccgaaaagctacaactcagtctaagactcggtaaataaaatcaagcagcaagaagaaaatgtcttgttacatgaaacgggctgacctttcaaagaacaagtgttggaggcgagaagtttttttcttatactcgattggaggcgaaaatggttgtgaaaattatacaatctggcataacaaaatctggcaaatcaaacaggctgctggttgtgtcatgtatgtgatcttaagcaaggtgtgggtaaaatattcactctttagatgagttttttggatctttacctcaaattcatagagtcctggttttcaatacttgcctcaccactagaatgtcttcagaatatggattctgaagccgtcaatttgtaaccaaattacaagaagaatgcagttacatggtcgcatacttttaaagcatgtgcagtaattcagattaggcataccaagactgcggttgcgtggtttctgctctacaaagatatcgcaattacagaagttctggtgaagaaacacaaagtacacacccttgcaactcctgaaactgagttcacttattcaatactcattgagaaacagtgactctcaacctccttcaggcggcctcctctgttgcctctgaccactgtgctctccttcttcattcctgcgttgactcgccaagggcgcagcgctttcgctttgaggccttttggcctaagtttgagggattcctccaagttgtgcaggacgcctggcaacctcctgctaaccttccccccctccccgcgcttgcctggtgtttctctaacacggctaagcgccttcagagctggagtgatcgtcacgtcggtagcgtccgcctccagctgcagatggcgaaggagctcatcttccgtctcgatgtcgcgcaggagaaccggtctctctcccccctggagacctggttgcaacgagacctaaagttgaagtcccttgggcttgcctctcttgagcgcaccatcgcccgtcagcgttcgcgtctgctttggctcaaggagggtgacgccaacaccaagtttttccaccttcacgccagagcccgaagacggaagaacttcatctcacgtcttagagacggggactagcttgccgtcacccatgatgagcttcaagagctcgcctcttctcactttggcgccatcatggggacgtgcgttgagcgcgagctcgctcttgatctccactccctcggcctctgtccggcgcagcttggggagctggacggccccttcaggaggtgtgggcggtggttaagtctttgccttctgacaaggcgcttggtcccgatgggttcacgggtcggttctacaagacttgctagccagtgatcaagtcagtggttttggcggctctcaactccctcttcttggcttacggccagggtttctcctccctcaatgatgccctcatctctctccttcctaagaaagatgaggccgttgacgttcaagatttccgtccgattagcctcattcacagctttgggaagttgttctctaagattttggcctcccgtctttctcctctcctcgacgggcttgtggaggccaatcagagtgccttcgtcaaaggccgatctcttcatgacaactttcgctatgtccagctcgcggcaagggctctccatgccagacgcactccccgccttcttctcaaggtggacattgcgaaggcttttgacacggtcagctggccgttcttgcttgaggtgcttgcccatctagggttcagtcaatgctggcgtgattggatctccctcattattagcgcctcctcttcccgggtgctgatcaatggggtgccgggtccgcgcttccttcaccggaggggtcttcggcaaggagaccctctttctcctatgcttttcattctagtcatggaagtgctcaatgcgatgcttcgtaaagcctctgattcgggcgggttccttccgcttaatgatcgcgctttgcgacaccgcgcctccctctacgctgatgacttggtcctcttcctctccccggttcggcaggatctcgagttcatccagggcattctctcggtctttggtgcggcatccgggttgcgcaccaattttgccaaatgctcgattactccgatccgctcctcggatgaggacctggagctggttcactcttgcttcccctgctcgatttctgattttccttgcacctacctcggcattccgctgtccgttcgcaagttgccgaaggcggctcttcagccactggtggacagggtcgctcatcgcctaccaccttggaaggggcgtctcactactcttgctggtcgctccatgttggtccagtctgttctctcctccattccagtccatgtgtctatggcaatcggccttcctgcctgggttgttaaggccattgacaagaagcgacgcgccttcttgtggacaggtacagattcggttcatgggggatagtgccgggtgtcctggacgaatgtctgtcgtcctaaggccttcggtgggttaggaattcctaacctcaggttggcagggttcgccttgcgcgttcgctggctttggcttcagcgttccgggcatccctattgggatggcttgaaggccccggtcgagcagtctgtctccgacatgttcgaggcgtccaccttcttcgtgccggaggatggtgaatctatgctcttctggactgaccattggattgatggaggccactcagtggcctccttggctcctgacctcctcttcgctgtgccacagcgcctccgttcgcgcacggttgcttctggtctggcgaacaactcctgggtttcggacatccgcggggccctcactgtccctgtcatctcccagtttcttcttatctgggatgctgcgctccgaattcagctcttgccgggtgtcagagaccgtcttgtttggcgttggacgagcgaccagcgctactctgcgcgttcagcgtaccaggccttcttttttggccagcactcctttgcctgtgccgatcttctctggcacgcgaagggccctgctaaatgcaagttcttcctctggtttgcattttagcggcgctgctggatggccgacctcctcctaaagcgcagcttggatagtcattcggcctgccccttctgcggtcaagagcttgagacagcgaaccacatcctcctcgattgcgtgttcgctctgcaagtttggctccgtgtgctgtcgcctcttggttggactgcctctctgctctctggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctccaagctatttggagttgtgtgtagccgtcacagtagtcttttgtctcttctttattttagtcttttttctcccctttcttggtataagtcggtctgactgattgcgtcatgtaacaaacattctattcttctgatatattgacgtgcaattcttttgcgcgttcgagaaaaaagaaacagtgactcagtgaggcccataggaagatatttgatcaagctctaaattcaatagtccctgacaggttcccaggcatagaactttattcagaattttggacgattgcctcaacaaactttgaaaataggtaaaaataccaatatttactggaacctccattcccaaagtcccaatctacaacttgcaataaaaaccaggcgattacagtttctccccgaaaccaagtaatcctactgaccaccaggggagatgcaatgcatcgcaagacataactgtcggaatccccaagcaaaccgcacaaaaatcgcatcgcatgaatactagcgcgctatgatcctaccagtacacagagcacgagtatggaaggctagttgttgatgacttgagatctgcgaagagaacgaacagagcgagggagattcacctgggaatccccgcgcggtggaagactgcgaatcgctctccccggcggctcgccgtcgccgcctcgctccgccgccgtcgccattgggtttaccggaagggcaaacacgcaatatcaaagtacacgaggggtctacgtggaaaagtaccaaacaaatgggctggactcacaatcaattacggcccggcccagtagataccaccacctcacactccattcgcgaggcccacggcccaagtgacgcctcctaaaccctaatcctggcaacggacggcggatacagcccacctcctccccccacgccgcatccgacgctcacgaagcgtccacgtctccccgacgattgctttataaaaccaccacctcctcctcgcaccaccagtcgccgccttcttcctcctcctcctccgccgcccgcctcgccgcctcccgagagctccaccctcgcctccggcgaaatggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgcaggcaccgaagcgaggcggcagggcgccggtgccggcgaagaagaagacggtaatgctcgccgtctctctgctcgaaatctacgttgtttcgttgttggggggcttgtgatttacttggatgttttgcttggtggttcttgcaggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcggtatatatctacatctcagttcgttcatcatgtcggattgcacctggaacgctaattggccgaactggttaggtgttacaaatgtcatttccttgttaggtttgtaattgtagtgactagctgatgaatgtgtcttcagtttatgatgaccttttgggtgttctagtcgaacatagttatctcaaattaatgctggctgtgtcggtattcttgttggcatggtagctctctgtccaaattttattctaggatagaatgttaaccctgtgtcaaaagtggtgcttttaagaatggaaaattgctaaagcagactattgaagttttgctgcagtatatggtggttgtcagtttttatcatgtttctgtttgtttatcactatgattagactcaacgctgtctcttcaacaccattgttatgtaggatcgtgttatcaatttcttagttgttaccatttcaaaaatgaagcaaggaaactcatctgttaaattgttaatttgtgttgaggaattaatggcataaaaaatatctgatgtaaatctttatttgcagcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcaggtacaggagcttgttaatgtgttcatttctttgttagtcactcatcaaggagacttattcatgggaacatataatcaagcactttactgataatttgaatgcttctcgcgcagagcaaggcccagctggttgtcatcgctcatgatgttgatccaattgagctggttgtgtggcttccagccctgtgtaggaagatggaggtcccttactgcatcgttaagggcaaagctcgccttggatcggtatatttcctgactctccatactcaaattgaatgtacttattgaaagtatagatgctagtagaaagcggagctcaaccttcgcaaatgatcatatgcagattgttcacaagaagactgcatctgttctgtgcttgaccactgtcaagaacgaggacaagcttgagttcagcaagatcttggaggccatcaaggtaagaaaccacggcatcccttgttctctcattcatgatcatcatgttatccagtgctctgctctttagcctcattgctaactcggtgaaccataactttgtaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaaattatattcgccccccgccgttgagctcgccctgtagtttcatttttcagtgtaatgattttgacgaggaactcagttagcaccatgcgacagtgctgtggttttctgaagtctagtttcatatattttctgttcaccggaccatgttgggaaactatgcaagatatcagagctttacaatgtttggtttctacgcagtttatgctgtgtgttttgctactcgtttgtttgccttggctgaacctgaacatagggcttgatcactttgatgccattttcagccttatcaaattttggtaaagttacctaaaaaaaagtggatatatttagtttgctgcctaattttggtaatgttaaattttggtaaggttttttttcatcaaagtaaatagccccataaagttcatttcacagccttacagccatttaatttaagcaaaattatgaaagctaacatgttatttttttaattttttgtaatgtcgaaagttcttggtagttttgcattagttgaaagtcaaagtcatacgaaaaatgtcaattttgatggatatacataaatctaagatgcgagctcgcaaaaaattccgaaaccgtaagtttatattgggctagtagtaactctagattaggcctagcccaatttggacagttggcccaagattttacttggagctcaattatggaataagttcaccggagatccctcaacttaacagcgagattttttgagatctcttaaccacaaaaccagaaatcttcacctctaaactatacaaaaccgttcactcaaggtccctaggcagtatatatgagtggtttcgctgacgtggcatcctagttagccaaaaaaatttttttcttctcttttcttctccttctcttttctctcttctctatttctcttctttagtgagagaggccagcggcaggcgcgcttctccttctcttctcttttctctcttctctatttctcttcttcagtgagggaggccggtggcaggcggagcaacgcacgcagatgcgggtggcgcagcagagggcaagcgccagcggagcggcggcgggcgcaagcgcggcaggccgagcagtggagcgcgagcacgaccgcgggcagagaagcggagggcgagcgcggcggcgggtggagcggtggagggcgagcatggcagcggagcggaggtgggcgagcacggaggcgcatccagcccaccccaaccgaccaaagcacaccctttgccctcggccataagccccgccgccaagtcgccgtcgccgtcctcctcgtcgtcgtcgagcggcagcgatgacttcgcggtgctcctcgacgcggagctcaagctcacctccgccgctgactcgacctccgccggagacacctccgccgcaaacgacgacttcgaggaagacccctcccagccttccctccttcctcctcgagctccctcacgccggcgcccacgctgcagggatgggaagctaacagtgctggtcgtcgtggtcagctcgcttgccgcggcaacgctggtcccggcgctaaccggctgatgcgtctgcggatcgatgccctggctcatgagcttgcgcttgatgtgcgtgttccacctgcagaaccaatcaatcagcaccaagaacacaagaagagctaaccggagcagatgacaacacattgaaatttgttttgcttacttgttgccgagaagggcatggagcttgatggtgagctcgtagtcgtcgtcgatgaaagttgctgcacttgaggtcggggctaaggtagttcatccagtggaggnnnnnnnnnnnnnnnnnnnnnagcagcaccatcgccttggggagggagagagggtcgacagggagagcgcgccgctcgtcgggcggcggcggggcccgtggtcgagcacccagcacattcgaacatctccgccgccgagctcaccgttgcgccgaccgccatctctcttccgctcccgccgccgccatcgcatcgaccacctctctcttcctctccgccgccgccgtccccgctccccgccgaccacctctctccccccggtcgccgcgcttgctcgagactcgagagaactcggagagaagagaagagaaaaagaaaaaaatacaaagaaatgtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcgcatacacatttcaagattcaacatttaaaacatttaaccaacacttagtataatattaaatgaattttatttgttaaaaaatatatcattagattgaaatttaaattactttcatatggttataattttgttgctacacttagtataatattaaatgaattttatttgttaaaaaatatatcattagattgagatttaaattactttcatatggttataattttgttgctacaaaccttctaggatatgagaaattataagttaactttgaccatgccttatattatgggatagagggagtatatagtatgtgaatttgggagactgcagttgtgtgttcttatttctcttaagctaataacctcactcgtctttttttgggtagaatgttacagctatttgatagtagttctgtaatcctatgttgatactgtctaaattctatggctttgtgtttcttgcagtaggacaatggaggggagtttgagattggggtttctgttggttctatgtatcttggccttcttgcgccctgctgcagctattcgcttcgtgatcgatagggaagagtgcttctctcataatgttgattatgaaggagatacagttcatgtatcctttgttgtgatcaaggcagagacgccatggcattataccgaggatggcgtggatcttgtggtatgatcttgtttttctttttcttacgtccaatcttcatccatgtaaatactccacaattgtagagtgtggtgagattcttgctttcattttttaataaggaacaatagctggctagatatttccgttcttgtagtctgataatgggcatggaggattgcatatggactccatgttttgtttgatgcttgcatgagcccttgagaactttccagttatgccgcatccaaaactgattcaactttgatatatggcaggttagagatcccaatggtaatcaaatccatgattcccgtgacaagatcagcgataagtttgaattcatagttcataggagaggcgttcaccgcttctgcttcaccaataaatccccataccatgaaactgtagattttgatgtacttgttagtcacttttcgtattatgaccagcatgccaaagatggtaagcatttttctggttttgttaaatttgtctagcaaggagcatgtggttgattcctttactctggaaatatgtagaacatttcagcgccttgtttgagcaaattgcaaagttggatgaagccctctacaacattcagtttgaacagcactggttggaggcccaaacagaccggcaagcaatatgtatgttcctcgtgtcttactctctcctttaaatactagtactttttcgaaattgtaatatgtgaagatctcttgttttcttttatcttgtaataaatagaacttatgagttgtagcaaatgctcaacttttctgtttctgtactaccgacaaactgtcctgccttaggagctccagccttttatgtcaacctttggaccagaccgccacacatgccacattaccaaacatcttgaaattgataaatatttgttacattgatgaacaacatgagaacacacaccatcttcttttctttttcttttttttccctttttttttgtaaatatcatgttctgtcaaaagcaaaatttacagtatctcataaacgtgttttgatgctaaaactgtaatactatatttgtctatctgatgcagtaaacgagaacatgagtaggagggcagttcacaaggcattctttgaatcagctgctctcattgcagccagtgttgtgcaggtctacctactgcatcgcctctttgagcgaaagctgggaacatcgagggtctaattctctgatagtaggtctccttagactcaccaacccaactgtatttcaatgctgcaaaatgtgtttacaatatctgttacatcctgctcagatatttagcatttttgttcagaattttgtaattcagttatttacagtactgtgctgcagtaacttgccgcctcatcagattcatttcagcgcattatatctatcgtcacatgtatattaggtcctaagtatttccacggtacgcactgctttaaaaccttttttgcgatcaaggtacaggagtgctagtattgagaaagaaaatgaagaaagaattccttttctgacaaagactcctaaacttcagctcatcagcattctactttagtttcacaatttcagaatccatatttcgatgataaccatttagtatgaagtattcaacgtttattgagcctgtattatttctgtatttagctgtctggaggtagaaaagctcagacgataccaaatccaaggagatgacaccaaattggtttcttgctaacatcacaccatctgattaggatacagttggaagccatgtgcagtctggttggtcctaaattcttttgctgactggattttttcgtgttatggataatgatttcacaaataatgattggcactactgcttgagccgataagcataacaactctggtattcgcatttcaatgtccagtttggttggtacatggagtcactgacaatcgagtttggaatctctgaccaaacataacagccgcccgtgacacgtatcaacatcaaggatgataaccaataatcttgaatttttcagtaaattctgcctgaagcactgtactttgtaaagttgcatttcagatatcagcacttgttctctgaatcagttgtaactttgtcagtaatttagtagcctgaagccctgtactttgtaaagttgcatttcagatacacgaaatcaggcatcagcatttgttctttgaatcagttctaaacctgtgaaaccttttcatgagtgtgtgagctccaccagaacactacctcactgttcatccacagttcatgctgctgttattaagctcaacaaaaaccttgatgcagtgatgattgcatagtttcaagggacaaggccatcagtctctggatgaatctgaggctgaaaaccgggtcaagttttgtcatggttcaagagaaacgaatgccattgtttgttcagtttaaatcttagcttttacagaacaaatcctaccaaaatgtacacaaattcataaatattacaaacttgttattagattttataaacttattctgatataaaattgatggttggaattataaatatttcgattgaatcatatcctaaacaatcatatcataaacatcaaatatttaggcctgtttagattctaatttttttcttcaaacttttaacttttctgtcacatcgaactttattacgcacacaaacttttaacttttccatcacatcgttctaatttcttcaaacttccaattttaacgtggaactaaacacagccttatatcggaggaagtagttagctaacaccaccttgcaatttaattaatactatacaattatcatcaacaaaaagctcttccacctttcactcttccccactgcccaccactgtactgtacccccaccattcctgtctcttctcttcttcactccactccactccactccactcctctcccccatttggccactagcttaatccctcctcccccattggaaggaaggacaagctcgaggagctcctcctccatggagcgacgtggtagcctgtacggcgtcgcggcggcggcggcggtggtggtggtggtggcaatggcggcggcggccggcggcgaggcggcgaggctgtcgccggagcactaccggtcgacgtgccccggcgtggagtccgtcgtgcggtcggtggtggcgaggaaggtgaaggagaccttcgtcaccgtcccggccacgctccgcctcttcttccacgactgcttcgtcgaggtgagcagcggcggctggcactgacccaaccaaccctcgtgttcttgattcagatttcaaaccggaattggaggcgtcagagtttcagagtcgcacttgcaccctcagattttctggttctaggtttcttgatttctttcgtaattgatagcctcggtttgatttcggcgagtagttagctttgcatttggcatttgaaaatccttgcaaaattttcgcagcttttgcagcttcagagctgcttgtgatgcactgaatttttcagcattactctgcattaggcatttgcatacttgcaaagcttacaaacttttcagctgctttcctgatgcattcaggattcagcttagcagcatgagcagcatgagggtctctgaattttcagcattaatctacatttaattgcatcagagatcatgtcaaaatttggtttgttagtctcagggaaaggagagaaaagctacttcctccgtttcacaatataagtcattttaactttcctcatattcatattcatgttaatgaatctagataaatatatatatgtctagattcattaatatcaatataaatgtaggaaatgatagaatgacttgcattatgaaacggagggagtagtagtacgagataatgagagattaacagtagattaatggtacgaaatggcaactggattagctccaaatcacgcactcgtcgcttctgccatgtgactgcacgacccttttctgtcaactgggctgcgtaatcaaatgctcacgacagatgcttctctgaatccctgctggaataccaggcgccacgttgtcgtatccgatgtggcggacacggaattccgtgccgtccacgtcatcattcctcccatttcatgatgatttcatactccgggttatttagatcgatgtcatttcaaaccatatttttttataaagttgttaaatatatacttccatttatttctttatcaaactccagtaaatacataagaaatcatacaaaaatttgataatattgttaaaatttggtaaggtttattttggcttcagtttaaacagacctttaaatttttgataggtgtgcaaatgctttgatcactttgaaaattgaagttacgtacgttttcaattggcactgaaattattttgggggaattttaaccttttctgacaggggtgtgacgcgtcggtcatgatcgcgtcgcggggcaacgacgccgagaaggactcgccggacaacctgtcgctcgccggcgacggcttcgacacggtggtgcgcgccaaggcggcggtcgagaagaagtgccccggcgtggtctcctgcgccgacatcctcgccatcgccgccagggacgtcgtcgccatggtaaaccatcccatcaatcctcctcctcctgccatggcgaaagctttgctgcctctaacaaggtcgatcaatcaatcaatcaatggcgttgcagtcgtccggcccacgctggaccgtcgagcttggccggctagacggcctcgtctccaagtccggcggcgtcgccggcaagctgccaggcccggacatgcgcgtcaaggacctcgccgccatattcgccaagaacaacctcaccgtgctcgacatggtggcgctctccggcgcgcacaccgtcggcttcgcgcactgcacgcgcttcgccggccggctgtacggccgcgtcggcggcggcgtggacccgtcctacgacccggcgtacgcgcggcagctgatggcggcgtgcccgcgcgacgtcgcgccgaccatcgccgtcaacatggaccccatcaccccggccgccttcgacaacgcctactacgccaacctcgccggcggcctcggcctgttcacctccgaccaggagctctacaccgacgccgcgtcgcggccggcggtgaccggcttcgccaagaaccagacgctcttcttcgaggcgttcaaggaggccatggtcaagcttggcagggtcggagtcaagtccgggaagcatggagagatcagaagagactgcacagctttcaactgaacatagttgcatagctgcactgcgacatttgtaagttgtagcaattggggatttgatcgtatattaaaaatgaaatcatttcaaggtaagaatttcatactttctgttttcggtccagaagtcatggctgagtgatgaaagcgacaaaatgcctcttaagttaactctacaattaaattaaaattcaaaatagccacagctgaaaacaaccgaaaataatttttgatcgtttaagccacggatgataagctactcttgttgtttcaaattatttgtcgttttaggtttgttctaaaccaaacatatctatatttgactacaaatttttagaaaaccgtataagttaacaatacatgaattatatattatgaaaatatttctcatggtgaatctaaaaatataaatattgagatgttaaactatacgagtttatagaaattaatgattaaatataaaaattcttgacttagaacaaaccaagcaatttaaaacggatggtaaaaacaatttatggataaaaccttttattaccattcttaatagtttgaaaagccaatacccaaagataaacttcgatgcaaatatctgaatcaacactaaaatattttagttttaaaatttaaatgttagctacggttaataagttaacaacagtctctctctctctctttctgtctgcgcaacggcatgcgcaaatctgacgttcgcagccgcttgcctgacgttgatacgtgtagcttcagaaaacaaaactggcagagctttcttgtggtggtagggcaatggccactgcttgcttcctggggttgctctcctcttgctttcaagacccatacttttgacctaatcacccaaacctttccttgctgttgtctgaacacgggccatcttgggacctactcaacgcttccagcatgcatggacagttgccagtagcaatcagatgctactaaccattttcaggttcagatatcagaagatatacagagctttcagatcttgctgtcttaacaaggatccaggtgttaggtcatgtccagaatgcctgaattcataccgaaatactatcccgttctaaaatataagagatcttgaaagtgcaaatacattgccaaaatccctttatattaccgaatagttcaattatggcatgaatcaagaaaaatcctggttcccaaaacagagcccttgagacagagtaaccatcctaaccaaaacagaggcaacagagcagctccataagattggagacaatcagtctgacagtgccagttgagcaaaaacaagatacaaaccttgaaggaaaagaactctccaattctgaaacaattataggatagatgtaataaataataaaaccaaaccgttctttttccatatgtacaaagttttctgttaaagcttgccatcctaattataatatataaaaccatctaagcttgttgcggcgttacatggtaaaaatgttgtccgggaaggaaaagataggatggcaacaacgtaatgccgcccaaactcttctgcttgtatacacctccatgagaacctacttctcattcaacttcacatgtaggacatgaatggaggcttggaaaatatataccctgccagaagatacaatccaaagctcttgttatacgataacgttggaaataggtatgaatgcaataaagacaacaactcttaaaagcatgatagtgatgataatagtgatataggcatgatactgtttacagtcagtaggaccaagaaaggaattgcactgatatcatatttgaacttatttgggttgtaatagctgatcttgatggtgaacttaatacatccgcattaatttaccacagaaaattgatgtagaatactgttcgtttgtgaggaacaagcacatcaaggttggcagggaaattgaggttcagcttcacctgtattacacccatataaagtattttctaatttcaacaattaactagctatatcaatttttctagatgcattgacagtgaaatcttgaaaggtgaaaggaatacactaggtcaagcttaactaggctattctattcttcctgggaatctaagaaagctcttcttctcgattgtcactagttgcatttagttcctctcaagctcctttgttcctaagaaactcagcttgtatcccgtcgaaacgaacaaagttataaacttaagctttctggtctcctacttagcaagcacgaaagcgctcaggcatccatttcattgttatatggccctttttgactctatatgtttacagctcctttccccctttcagttcatatggtcggtgctcaccgacgcaatttagtcccttacgccctttcaatatcgaatttcatcaacctgaagctatagccagcctctctacatcaaattagagatccaaaacatttgagaatcatctggattgcatcgacaaccaccaattctgaccctttccacttcttaccatcgcgtcaattttattttaactacgacaacaagctgctcacattatttggaatgatgtcctcccgaactaaatcaacgcaacaatcctaataaaaccacaatttaaatacagaagctacacatatctcaattttcagagaagcacccaaagtatgacagatgcttcacaattgggcataatttaagcaaaggcgctcaatttagcgcattttgaactctgataaagccaagaaacaccaccaatcatcatatttaccccccaaattacgcatgaatccacagtgaattccccaatcctgactaacccaaacatgtaaaaagaggagcctcttcccttttgtccccaaacatgtaggagccctactcctaaacggccaagatcacgtacatgtggaggccaccttgggcgaggaggagcacgaggcgggccagaggatggccctccagatcacggacaggttggtgacgaacccgacgaggaggaagacgcaggcgaggccgatgacccagggcatgaggaagaaccccagcatgaaggtcaccgacccgcacagcatcagcgccaccgacgcccccagcagcatcgacgccacccccgccgccgtcacctgccgcggccacgccgccgccccccgcccgcccccttcctccggccacgcccggagcaccgtcagcagcagcgcgcacagctcgtacatcgccctcgactggtcagcctccgccgcctccgccgccgccgtcgccgacgacctcataccacccccaagaattcttcaagaatcgaattcaagaaatcaagaaccgatcgcctcctcggcggtggcgcaagaatcttggaggaggcgaattgggtcggagaaattggttgtcgggtcgggtttgcttctcgatcgctctctctctcgcgttggtggaattgaaatggcgagatgggggaggagagacatggggggagatgttgaaatagaggggggaatgggaaattgggaatgggcggagacgtctacgctacgagaggataatggtaggctggatttgtttattcggcagttatttccggtgttggcgtggataactgtgcaactgattggttgcgttggcggtcaaatttgcactagcacttgttgaatcacaacgtttcaagtttatggaaaacacctcaaaatttgtactccatgctcgtaaaggaagtcgtttagaacagcaatacggtcttcaaaacacaactttaactttttgtttctataaaaatatttattcaaaaagtgatatatttatacttttataaaagtatttttcaagaaaaatctatacatataatttttacattttcaaattcaacaacttgagagttattcatgatttatatttctaaggtttgatttaaacattgtcctaaacgacttcctttatgagtacggagggagtacttctttctctgtcccaaaactacttcaaagtttattgtaatattttaagacaaatgaagtatactatcttcgattataaatattttatgtttggagtaagacacggtcggacttttgataaaacgttgacgatcattagtttctaaatcactattttttaaaaaaaatgatatgaaccgatttggcatgaaaaatattattatagtactatgggtttattggatctgcgagtttattataacatgaattgaatgtcgaggtttcagaaatttaaccacctctcttctcttatggtactccctttggtttaaaatttatggatgttttggacagaatatcacgtactactccctcctgtgccaaatgagttgacgttttgaggcttaaaaatattataatagtactatagatttattgaacatgtgaataccactctcctatatatagtgctccctccgattttaaaattattgatgttttgggacagaaatctcacatatcaaggaatgattaattgtgacgcttctctccggtgtcaaattagttaacgtttggacttgggaggcttgaaatatattataatagtactatagatttattgaacctgtgaataccactctcctatatatggtgtccccctccgattttaaaattattgatgttctgggacaaaaatctcacgtattaagaaatgattaattgtgacgctactccctccggtgtcaaattagttaaaggcttgaaatatatttcaatagtactatatatatttattggacatccaaatttattataatgaaattgaatctcaaggttcataaatctaaccacctctcttatatatggtactccctaattattgatgttttggataaaatctcacaatgccaaggaatgattaattgtgatcctactcactcggtgtcaaattagttgaagtttggaggcttgaaaaatattataatagtattgtggatttattggacctgcgaataccactctcctatatatggtgctcacctccagttttaaaattattgagatttttggacaaaaatctcacgtatcaagaaatgattaattgtgacgctactccctccggtgccaaattagttgatgtttggaggcttgaaatatattataatagtactatagatttattggacatgcgaatttattataatatgaaattgaatgtcaaggtttcataaatttaatcacctctcttatatatgtactccctccagtttcaaaactatttgatattttggacagaatctcatataccaaggaatgattaattgtaatgctacacctccgatgtcaatttagttgaagttggaggcttgaaaaaaacattctaatagtactatagatttattggacttgcgaatttattaaaatatgaaattgaatgtcagaaattcaaccacctctcttatggtactccctccggttttaaagttattgatgttttcgacagaatctcacgtaccaaggaatgatttgtgatatgctactctctccggtgtcaaattaattgatattttgaggcttgcaagatattacagcagtataatatagatttatttggacctgcaaaattattatgatatgaaattgaatgtcaaggcatcataaatttaaccacctctcttatgtatggtactacctcctgtttaaaattattgatttttttttgacataatctcactatcaaggatattatatttgttttttatgggacggaagaagtagatcgcggtttacaaggaaaatgctggcacaggtcttaattaattagtggtatctcctgttctctgcaccctttggtaattttgacgacgcagtgttatgcacaaaacacgtggtgatatggtgcatgtgcattattatcaatcgtctctattcttcatttcagagatggcttgctcattcgtgtttcggacagtacgcaactccctccaattttttttttaaatctagcattataacggatgaagtaacaggaattataagctaatacacagcaaagatctgccgaagtgcattgtttttttttacaaaaaatacttatatattctaagagttaagtgtacgaacgggctataaacttgtgtgcagatatattatctagatctctaaattcttaaaatatattttcaaattatcaaacttgttttggatataatatatgatcaaatgagctttatcctactccatacggtgatgtagcatgtcatggtgacttttacagatcattagtattttttaaaaaaaaaacatgtttttctccttttaggtagagaggacaaaagataaaataaaaaaatattgaaaaaaattaaggtggagaggagaaagctaaggcgagaaaagataaaattaagaaaatactattaacgcatagctaggcatcactttgatatgtcacgtttagtatatcacgtcagctcatgaagtagagtgggttggaattcgtttgaatctatatcgacgtcgcaccgaagacaagttcagaaactcggaaatgtattctgaaggtttaagcatctagctagatgatatacttagggaccgtccttgtctaatataatctaattaatatatgatctaaacgtgcaacgcgagggttggagttgttaccatctcgatctatggtagtgttacagaatgcaagctggagcactgattgcgatcgaggtacgttgtttataatataatgtaccccgatctagcttgattctcttgtccttgttgcaacgtgttacacgcgaggaagtcccattcggtttgagacaacgatgatgagaggagacagtagcagcaggtacgcgaggaaatcgtgggcgacgacgtacgtacgggtgccgccgtgcattaatggctgcgacatattgtactacctccgtcaaaaaaaaaaaaaccgggtttccgtgtccaacgtttcaccgtctgtttaattttaaaaaattatgaaaaaaaaataaaaagacaaatcacgcataaagtattaatcatgttttatcatctaacaacaataaaaatactaattataaaaaaaatttcatataagacggacaatcaaacattggacaccgaaacctaaggtttgtctttttttggacagagggagtagtagtagtatcgttctagatagtgctatatattgagcaagtttaatagtatagccaactattagctctagttcatctatagccaatttaatagcttatttatacaatagttatatactacactattaatatatggtcccacatctcatacacacacaatgtattagagtctgtgctgcagctggctacaaatctgaagctcgctttccttctttctctactgcacatgtgcttacaggtgacttgtagcttgctactgtactcgctcttaggttgtacaaatagtcaccacaggattagtttccgggcaatccggggcaacgcaaactgtgaaccgcgctggatgtgtacgtcgttgttgcttgcacatggtgataacatgggcatactttgaactcgggttgcacgtactgagagcatataagtgggtcgatccgtgaatctacttatagcctcaacgtaccgatttggtacaactcgtcaggaacgctacgttcacgccaaccccgcatttcgatcagcttgtagccttgtatcctcgacgtaccgatttggtacaactcgtcaggaacgctactttcatgccaaccctgcatttcgatcagcttgtagccttgtagcctcaacgtaccgatttggtacaactcatcaggaacactacgttcgcggcaaccctgcattttgatcagcttggtgacgaaagcgtgcgtttacgacggttgtgttcggtagtttgagttgggaactaattaattcctctcacatgtaaaagggaataactcattagtttatgattaattaagtattagataattgtttttaaacatagattaatataattttttaaaacatatttttaaaaaaaatacaaggttggcaatttgaaaagcgtgtgtgcataaacgagagaatagagttgagaacttagtgcctcttagatttgcatgaataatgtaggatttttggaaaattctaatcctatggaaaaaaattcttatgaaaggcatttaaataaaggattgtatcctatcatatcatttaaaattccttttgagtctttgtctcttattcaattcctataattttttatgtagttcaatcaaacggttattcttattttttttataatactctattttacaattacatttctactagaatcatattcttttattcctattttttttataattcttatgattcaaggggactttagggggtgtttgggaactagggactaaatttagtctctcgacttatatttttgtgagagggactaaagtttagtcccaatttagcccctccaaccaaacaccaccttagactcccagacacagccgaacttgccaatttgggaaggctgccgtctgtaggaattaactgccgtccaaaaccgcagatcgatgtcagtgtttggtgatggtctcgttgtctgaactctgaactctgaagccgcggccgccggtctcggtctccagacatgtgggttcccgccggagaaagtgcaaactgattctagtgcttgtcgcgaagcgtgccatggcgagcgagctcgtcggagacgacgaggcagccgtcgtcgtcgtcggccgccgcacgcacgcaatcccgttccggcccaactaatgattagccggctgccggcccaatcgacatgggccgtatggcccgagttactgtttgctccatcggcccggcccaagctagcaatcccatatgggcccgagttgcgtccgatctatatatcgtgcggcgaagatcaaagggggttaactgcaaaaatacgcacgggctggccctacgttttgatggcagttttagtgcagatgaagtggatgattcttggattcagatttgtttcatcgagccacctgaagcgatgcacaatccagcttggagatgaagtctatctgttggagttttgcctcgaaatcgcacggggagtaacatcctgattgcactctgttttcaccataaacattggggaaatttgaagcagtgtcttatattttcgaaagatcaatgagaatgcttacggttttaattttttcgcttatgcttatacttatcagtcatgattttttttggcaagaatattaaacaaacggaagatcccttattcttagggcataatatgtagtgtttggttcgaccagtccgatcaaccagccaaacaaaacttcagtttagtaactgcagtattacaatcgatttgtgggaccagcaaaaaagaatcggccaatcactagtctgtccttcatgcatgcatacacaacaaataattttttactcgttccattcgattctaattcgaagttcaatttgtcctctgataaatacgattcgacagctacaaatatacattgttcaatatacattaaaattgatttaatgttcacactgaagatgctcttattcaatattaaaacaattgaccaatgtggtcactatgtttacaaaattaatgaaaacaaacttcccaaatcccaacccttatagtaatgttttgacacatgatgactaagctgttggacgttcgtcaccatgaagtataagaacaacaagtttttagtagttttttttttttggataacacaagtttttagtagtgatggcccttggtgcggccgcaccccatgatggacgccggcagccgcggcagcacgtcgacgccctcctcgaacaccacgcccatgcccatgtacacgtgggcctccaggtggcagtggaacagccacacgcccgggttgctcgccctgaacctcaccgccgtccaccccatcgggtgcagcgccaccgtgttcttcatcacggcgccgcccctcgcgctcgccgcgttcagacccggcccgtccacctccggcacgaacttgccctcgccgtagccgagcacccagaagtcgtgcccgtggaggtgccacgggtgcgtctcgctccgcccgttcggcggcgggatcgccgtgttctgcagcaccacgtcgaccaccgagcccagggcgaggcggtacgcggcgtggcgcacggcgaggctcgccggcggggaggagaggttgaggctcccgtggtcgtagctgtccggcggcggccgctggtcgaactcgccgcggaggccgtgcttcatggcgacgaggtacggcgtcgccgggaagctgagggagacgccgttgatggcccacttggtgtggttgtcgatcttgctctgcgtgttgaggaggaggagaacgcggtcgggcctcgccggcggcggctcgacgtgccccggcagcgcgcgaacgacctgctctgcgccaccctgctcgccgtgtcgttccaccgtggcccggtcggcggcggcgtgcgcgggtgatccacggcgcggaggcgtacctgacgacggccctgcccggcgccgtcttggtggggtcgcggctgacgacgtgcgacgccgcccagtagctccgggacgggtcctggtcggcggtgacgagcacggagtaggtctcgccggagtagatgaagaggttcttgaccaccaccggcgtgacgtagtacccgtcggcctccaccaccgtcatcgtgtgcccctcgatctcgaagctcagcgacgccagcgacgtcaggctgccgatgcggaggcggtacgtcttccccggcgaggcggtgaacagcgtcggccacccgcactcgccgccaaacgcattgcacgccgcgccaccgccattgctggccgccggcggcgagcagttgaacacgcctctgccgttgatcagaagcgactggggctcgccgacgaacaccatggggacggaggcgaggccgacggcttgctcgtacacgctctggtgccaccagtccatgaggaggacggtgtgctcgccgtcgtaggcgaagggctcggcgacgccgtcgggcaccgacacgacgagcatgccgtccagccccgccacgcgctgcatgccgtagtgcgcgtggtacatgtacgttccaggctgaaaccatcacaaaaacacccagaaaatcaatcaaaatttgctcatccaaccatccaagcaaagaactaagcatcgatcgatcattgcacgtactccctccgttttagattataagacgtttgaccaagtttattaaaaaaatagtaataattttaaaccaagataaatttattataaaatataattaattattaatttcataaaactaatttggtaatgtaaatattactatatttacttataaaattagttaaatttgaagcagttaaaacatcttgtaatctgaaactgagggagtagctgcttaccctgtcaacgacgaatctgtaggtgaaggtctcgccggggaggatggggcactgcgtgacgccggcggtgccgtcagcccacgggctgccaatctgcgacgacacattgccgttagaacaatacccacacggacgaacacatgatcgccggcgagccggcgacggcgagggggatggaacgaagatgaagaatgacctggcggatgccgtgccagtggatggcggtgttctcggtgtcgagcatgttgtggacggtgacgacgagggtgtcgccctgggcggcgcggatggtcggcccgggggactcgccgttgatggtcacggcgagcttcctgaagcagtccggcgacttgtactggtacgtgatgttccacgtgtggtggtgcgtcttcgcctccgccggcgccgccgccgcggcggcgcacaggcacgccagcacggcgagccgccacgtcctcatcaccgcgcacaaagctgacgatcgagctcaaggattgggattttgcgacggatcagaggcttggaaatgatcggtttcgtgagcaatcggcgaggtgtgtgtgtgtgcgcgctttgtgctttgcactgctctgcctcgaggcatcgagtggatttatatagtttacgcgcgtcaaagtgggtgtgattttgcgcgcgcgttcataactgggggctggggctttactaccaggtcaagcatgaagcagctacagagctcaggttgaagcgttcgacggtgggccgggccgtggctcgtgtgcgcgtgtgggggcatggtacttcgtcagatcataagcgtgtgcgtggctgtgttcgctagtttcgtttcagttgggaacatctcccatgaaaacggagcggtacataagcgcgtgactaattaagtattggtaatttttttaaaaaaatggattaatttgtttttaaaaataactttcatatataatttttttaaaagaaaaacacactatttagcattttgaaaagcgtgcgcgcgaaaaacgggagagggggagttgggaacatgagggaaagaacacagtcaagtgggagtatctgatatttagcataagattttatcaagatcttgaaacattgactatcaatagtttgtcaattaatagtttgtcaataaacgttggcatacgtttaaaattaaacagaatattaagtactagtagttttataaactttaggctccacttgaatcactggaatgaaaaaaacggagaaataaaaaaaacacatgtttctaataagaatataagtgcaaaacaaaggactaccgaacgtagaaaaaacacagaaataaccatttgattagaccgcaggaaatacaagaatcgaatgagagagatataatcgaagaaagttttcaagaggttggagctcttgctaaatttcctccaaaatcattatttactccataggatttttgaaggataggatataattcaatcatttgtttcaaagaaattttcctacaagattaattttttaaaaaatttctctgttttatatctaaattaaatgggcccttattctattagacagatgaagttagagtgagtatatcgtgtcctaatgaacattaattagtagtaatcctatatatttctttatacttatatacgttgctcacttagtgcaattcataaatactatttctcttttttcttataaagccacattactttaatactagtttctaatacttatatgattaattaatgatcttaattgtgttcctctttttacaaaagatacatcgtctcaattatttgtagacttagcatggtcaacctatggatcatattgtctcttgtctcttataaacaacatcatctggatcaactattctaccgttcttaataatagatcaaagatgcatattccgtaacaacgcgtagtatctagcatttccatatactaattcgcggtgatgatttccatgacaaaatatcatgtttatttcgaggagtgtggtcaacgaagcgtagctctactagggtttcataaatgctacttcccctccgtcaaaatatattaactttacaatttatcttaaatagagcgtttacctactcacttatctcaatcaaatatagccatttctcatttaaatctacgtatagaagctcaaaagtgctttatattttttggacaggaagaaaagatagtactacttagggcacccacaatggttatctataaactctctacaagagatccatgtcagcatattttcctacttggaagagatgaaaaaagagagcaaagctatctactaatgtgaagatagtctatagagaaaaacgaggcaatatattagagagctatagatacccaagtagacatactattaaggtggtttactattaatctagtctattgctgagatgtacatgttttacagagagcaccttactttactattgcgggtgctcttatgttttatattataaatcgttttgacttttttcctagtcaaactttttttttacgtttgactagatttgtagaaaaatataatagtatttttaccacaaaacaaacatattatcaaaatatattcaaatgctagatttaatgaaactaatttgacgtttaaaatgttacttttcttctataaaacctagtcaaatttaacaatgtttgacttagaaaaagtcgaagcgaattataatatgaaatgaagggactagtactttgtatgttttaaattacttgtcgttctaccatttaaaagttatgccaaaacacttgtcattctcatattccaaatcactttttaaatgcttttttcttcttacctttctctaacacaaccatgctagtagtagtctcttataaggaattctaattcttactttgaaaacatgattaatatgtaattaagaagaattgcaatgtaatttgctatgacttcgtacgattttctggaacgacaagtccaaattaaaacataaaacggaggaagtataaatatatatacacgcttcgttatgcaaactagtactaataagcaaactaccattaatgcatttggcgtttgaattaatactacgagttgtacccgttgtctatcagtggagattgtctacagtagcagccactgacatgtaggatcgggttcacctatcagccactgctactgcaaatgtagtactgcgaagatccatgtccgttgtctatgcgtgtcgtgcctgctctgctctttaattggtaaaaagtattggttagggctgaatgcaaaatgcatgtactcctggtcctggacgcatgcttaacgaagacgagatccagtcgaagccatctttaaaaaaaatgaaccatatatatgaataaaaagcaaatcactcaagttgaaatgcctgcatctacattttcgctcgtacgttcgcaatcacagtttcgggtcaactaactatctgcgactcggacaagtacgactgcttgacagcccaactacctgggctacttgcatgtttcttttccttaattttcatgcagaccagcatgctcaatttatgtacaacgacagctatttttttagacaatgatgtacaacaactaatcagttaacctaatactcctatatataaagaacctagaatgcacatgagcatggtaattaaacctcgacattttattatatttgacacactggatatatagtcaataaactttaccgcaaattatgaaatgtacaggcactgcactgtaccatacgtagtttttgtgcagcatataaccataggctgtcacgtacggccttttataccacatactagtccttgaacgcttaataataattaaaagtgcgtgcatcacatcagaaaagtttcaacacgctagcacacaaacacggaattactagtctcactcttgtaggagaagatcaatctaatggtgcgacttgatctgtgtcgtcacatccgtttttattggttgtcgcatcggccttcaggagttcagggtagccatgtcggcatgaaggcagtcacgcatgagttgttcatctgctctggagtaaacctacgaagagaatcaaattgtgttaagggtgtgtttagttcacgccaaaattagaagtttggttgaaattggaacgatgtgacagaaaagttgaaagtttatatgtgtagaaaagttttaatgtgatagaaaagttgaaagtttgaagaaaaattttggaactaaactcggcccaagttcatgtgtagagagcattccatacctttttttagcacagaataaaatagatacgcacgattgagtggacctccttagtaatctagtaaggctagaaaaacaccattcatatctcttaagcatgtgttaaaaaagcttactcacggatgtatgcgtgagtgggtgtacgcgcgtgtgtagtggtatatatgtgtacgtgcaagcttttcccgtaataatgaaaaaattaaactggatacacaattggtttcaagaactaatgagatcagagaaacgatcatgaagctgaaatgagtaacatgcattttatacccgatctgcaaggtgggctcggcggcagcttccagggaatggaagaatccgttgccaccgtgcggtggcacctgctggacggcatgaggcgactgccgctcgtagccgagtagggtggcgccgtgctcccacacttgtccatgcaactggttgctctcctccagcttttcctcgcaaacgaatcaaacattagtagtgctcgttattcttttctcacttgtgtttttttttttcatttcacagcatcattttggttatttcacagagctacgtaagcaggcgttagccaggagatatatatatatccgaggaagagatgccaggaaaacggacctaaatgcctaaatcgcaaccgaaaacagtgtgacctcgtcttgatcaattgttaatatgcattgcttacgtgtgagagatccttatgttaattaatatgcgcagttgaagtaatatgctgtctacgaagcttcatgtacgtattcgttatgtagaaataaccaataccaaatgttcttttgtaatatatacaattcatcctacaaactaatatgcatcaacgtacacaaacttgtccagtttctgttatacgcccttacaaaccatattttatatgttcacatgtttgtaagtttatgtggaaggaatatataaagtgctaactaaacactgatgttaacatctacacattgaattcctgatcagattaaatttagtactacatggatgcggggctttgattttgaacaagcacacataaaagtgaagtgtataaattacttttaaaaccacatacttagttcatgcagaatcttaagatcaagtaaatgcatgaaacttaaacgggacaaggaattaaacttacttttcttctgaggcacttatttgcttcacacaacatttgttcctgaaaatgatttaggtatataaagttagttttggaaataataaattttcttgcctgaaatacatagttggtaagttttatgtcaagcttgtaccctcctctggagatcagtgagctgatcaagcatatgctgtgtctgcaacaagattagagttaaatttttttcaacatttctgaaacatatgtgagaaacagttaacaaattacccttgtggatctaatgtgcctcaaggatgaatcaagttgtttctcaagctgctctagctcttttatgccaagtgtcccaagatcttcaccaagaagattcctgtaattgtcaacagaaagatctactaagttaggctgtatttagttccacactaaaattgaaagtttgaagaaattggaacgatgtgaacaaaaaagttggaagtttgtgtgtgtaggaaaattcgatgtgacgaaaaagttaaaagtttgaaaaaaaagttggaatctaaacggggccttagttctgtatattttacactgtgattgatgcatgcatctaattctctaagcaacttcagtatatactactgcacgcatctaattctctaagctagttctccctgagattactgttttaccacttgtaaaccctatataatagagacggcggtaggaccttcattggttcacatatattacttcactcttgttaacactagtcatatgtgttttttccatgcaatatagttttttttttcacccaaatggccaaaaagtatctagtgtacacataattgttcttgccccaatacacaataatttatctactttgcatatatatgaatgaaaccaattaactgtgctccatttcgtctttgataaaattgaactcataagtggaagcctgatattacctttgggtcctctgtaaattttccacccgtgccttcagtttgaggtactcattgcggctgctttgcactaactgaaaaataaatttaacttcagtacaaagaaataggaaacaatttagagattctatgtgaaaacaaaataatataatttcacatgcaaaattaggcttatgaatgaacaatttattagaaaacagtgatattaattcatgaatccatctatcatatcatggtcaataaccagtgactaggagcttttctgttttatattcagatctacatactagacatttcagctagcacaaattagagttgtaaatcagtgttattacatgtggaaacacaacaacaatactcattctagttatagcactctttcatatgcaaccttttgcagtgctctcatttttcattaaattttgagtcttgtagcaacatcacatacattaagaagcacagcgaatatattaaattaagacttcatttttaattgtactattcaacacgtgtatatagttggtaattaatgataatactaaaagcagcatatctaggatcaatcaattaaactgcatgaatcgaattgttgaagtattatccagtgagacacagatcgattaatcagaacacaaagctagtctatgcatcaacttaaatccataaaagcttgtcataactcactaaaaattaaaatatattaatagaatctagtaacctcattttccttgttctgtattgcagtatctggcccaccataactgaatttttggtatctttccaaagttctggtcatgctgcaagtttcaaaaacacaaatggctatgtttatggaaaaacgaaataaaggaacatatatagttcgcccataactaaatactaacaatctagggcacattcttttccggggaccacatcgattaattagtagatgaaaaatcttgtttctcacaaaacatgaacattagctccatgacacggatgaaggtgcttgcataattggagacaatttctaagaaacaataacgttttatcttaattcttgcatcggtagtttcaagttgatttataattttatatatgtccatgatatcaacctagaggccactttttgtaaagaaaatggagtacactctttaaagagagatatcaagttcagacgacacacaatgaaatggcataacttcacgcagactactactacagctataatgctcacccccccccctctaccgcgtcaatttagtgaccttttggctgtgtttagttcaacgcaaagtttagattttggttgaaattggagatgatatgactaaaatgttgtgtgtatatgacaggttgatgtaatggaaaaggactgaagtttggatccaaacacagcctttgtttaaacaagtcgtgaattcagatttctgaaaaggatctacagtacacgttgagtatcaatttgtcggcataaaatactccactgaactagctctagctagaactagaagagacatctgatgaagaccaatcttctgtactgacagctcagctacgagagctgaggagaccaatcgaatgacaatcgaaagctgtcactaactgtaccctgcagatactcaagtgagtcctaggaatattgtgtactcccttgcaggatttcttccgaggagcagaggagggatgtttcactcaccccatatccaaattgaattccctggtcaatgaaatcatgtactcttatttgtgaatatatttaatgttagaattttataggcgtattaattttaatttagtaacttaggtataatggaaaccatttaaacataactataaaaattggcaagcatgtactccctccataaaaaaagaaaaagaatgctaaagtccccatatacttacggctgattataagccataacggcttattagcaaccaaaatataatttgtgagtaaaattgtatatgtgtctttagcgaattaaaagttaatgctgaaaaacaatctacattgacaaaacattaaaaatcaacttctaaatcaagtttcgaaattcaaaatttgatattggcttataattcatagggtaaaagatgaggccctaacttctagctataaatctggacatagcctatatatgtccaggtttggcaaaaaagttggttttttctgcaacggagcatataataatgtaatcattatctaaaatatataatgatgtaatattcactatagaagatattattaaaatgatcagtgcaatacaatgagcaagaaaatttaaccttctaaagtttggaaaatgtatgattcaaatatgaaatgaagctcatgaatgcctgacttatctaccctaactaattgtttatctctaaacacaataccaaatgttttcttccccccgaaaaaaaatgttttctaattcaaaatcaattcaactagcttatatgcggcttgtgaattatgcctagccaatcagacgctctgtgtttctgaaagacaattatatatatagtagtatatgatttttcatatacttatctcaggagaaacagactttatatttattgatgttgcctttaatgatgcaaccataactcacttgaaaaacaatactcccccgcggccatcccttaaaaaaacaaagagacaaaatcttaagtgaaacccccaaatcttgtaaggtatgctgcctccaaaccgtggaattcatgcagtgaacgtttgtttagacacacatccggtacatggctaatgatatgcatgatcccttcacacaccccccccccccaaaaaaaaaaaatcatatataccctaaaaaaaattgcccctcaaaaaactaaaaattgaggaaaaaaacagatcccaagggaattcgaaactcgcataccctccattaggagatcgataaaattaagattcgaagcttccaacgattaattttctccgtaaaaatcgacttgctgatccaggcttaaatcctgaatgtcccatcccatgcatgcacataaattaatcgcaattaaaccaaactcaaaaccattaagcgcgccatctcaaaaccactactaccacgggatcagaaaccctcagatctacgtatttcaccactccctattacgctagctagcacccgatcgaacgaacaaaaaccctaattattcccacagaattccaccaacttccttctcccaaaccctcccaaaactcaccaaaacacgagcacactcgcagatccaccatgtgcagccccagatccccgcaaaatcgccaccaagaagttcacaaaaccatcgtgcgctccagatctggaggcgcaggcgcgcgcaagaaaccctagctagctacgttgcaagcagctaccgatctagctatagcagatcgaggcgcgcgcccagtgcgtccatgtatatatacctttggccgctgcagaactcgtagagcttgccgcggttggagaagatgatgagggcgacctcggcgtcgcagagcacggagagctcgtacgccttcttgagcagcccattcctccgcttcgcgaacgtcacctgcctgttgatcttgttctcgatcctcttcagctccaccctccctctccccatcccgatctcctcctcctcctcctcctccacctcacctcaccgccgctcgagctcgatcaatcgcgagatgaatcaaccaatctcgcgaagcgaaagagaggggaaagctaaggcgaggaggaggaggaggagggggaaggggatgaggggtttaaaaagggaagggggagagggtgggcagcggcggtgggggctacccggcattgccatttccggcaaggtggtggaacgacgcggaaccctaggcggcctcgatcgatccatcgtacgcaaaggcaaagctatctaggttaatttcgcactaatctccgacccaattcaatgcgtctctcactgattgctttggattttctctctctctctctctctctctctctctcctcgtcgacgcagcggtggcgactgaggattcgacaggtcgagaaattaagcgcggaaaagctggggaaaagtgagtagagttgggcgcttttgcacttgaaacctcggagttttcgggtttcgggaaaaatacccttcttgtgtccactaggagccggtgggtgatctgttgggagagcttaaggctttgtttagtttccaaaataaacaattttcacccatcacatcgaatatttaaatacatgcatggagtattaaatgtggaaaaaaaaccagttacacaatttgcgtgtaaattacgagacgaatcttttaagtctaattgcgcctgatttgacaatgtggtgctgcagtaaacatttgctaatgacggattaattgagctcaataaatttgtcttgcagttttttgacggaatctgtaatttgttttgttattgtaccacatttaatactaatgtgtgtccgtatatccaatgtgacaaacaaacccaaaaattttccccaactaaataaggcctaagattttgggaaatagctagttagtatcaagcttctgagaatatggagaatgtggatttctcagcttctgttttctagttaattttttagattctataattagagcttttgagaatttggatgaaaaactagactatgtagagaggattaatatgattttgagagaagatacagcggtcagaaaatccccatacagacccttacaacttttctcttgggttgcagttgcaaatcaaagcagcaaaatgaaccaaggtagcatagtatatatctagctagctagcgatgtggttgccaagttgccatagttcgtgtagacaaaatggagctgtttgggtttggatagagagaggcttcttcgatcggtatatctctttgcctgcagagaactttgccgttgcagtgcttgcagtagtagatatatatgtgtgtgtaaggtttgaagtcttggctaggcaggagtgtatgttctttcattttacctaattggtcgtgattctgaagagatcgatatatattctacctgggatatataggaactgatcaaaggattaatcattaatgtgtatgtaactttggtgtggtaacgtatcacagatgttaagtgcaaactagctagctagagatggacaaattaggctgcaggctaactaattttggttaagttaattagtatccatgcatgctgggaactcaaattagcaagagggggagatatatgaaaagcaaaataactagtatatgttataaaattaatgatgtattcatgttgtggttaatttaattaggggttgactgttggcacggggtgtccagtttataaaaagaaaagttaacatatgaatttgacatgtgctatgtatatgtgaaatgtcaatgaattaaaccgtccctgtaaactttttaaattgtggcttattcagcattataattttttttacctttttttctagtccaacatttcaaaggctgaccaagtttataaaaaaaacatactaacatttttaagataaaacaaacgtagtatctaaatatattcaatgttagattaaatgaaactaatttgatattttagatgttgctaattttttttataaacttgaaaaaaaaagtcaaatcaacttataatatgaaatgtagggagtagcgtgcaaagattacattaattttgaagtgcattgcaaattttgtgcttgtggatatatccggttcaatttatcaatacaataaagttgaatgttcaatatgtagtatcatttgcactttaaagcttagattaataagtatataatggtgcatgctaggtatatctatattatacatgcatgtttttcctcttaattacaactaatccgtacgtatacgcatgcagaaataaccccaacaaaattatgtacgatacagtagccaacccaatgtgttatataccacaattaacacggttcgtttgaaaactacaagctcaggtcagcttaggcatgccaggatttggcatttcgcaaaaaatggttggtcatcggtttgtgaaaaccgatcaatattagttggttttcgtacggtgttaaccaaaattcatcagtatttaacggttctcaatggatcggtttgcagtaaacgagtggaaggtggttctttatttcaaaaaaaaaaaggtaattaaacatgggtatgcaagactatcacatacggaataatagctcagcaaattgagccgttcttttcttcaaattcctcaatttcattagcacttttttcaaactatttaatggtgtgtttttttttaaaaaaaataaaaattctatatagatgttgtttgaaaaatcatttttaagtttataattattaatattaattaattatatgctaatgaaatttctcgtttcaagtgagcagaaaatttctctccaacttgaggatataagggcatccgcaatggttatctataggctctatacaagagatccatgtcatcatatttttctaattggaagaggttaaatgaagagaaagagagagagtaaagctttctactaacatggagatagtctatagagaaaaacgatgtaatggatgagagatctatagatacccatgtagacataatattgaggtggtttactattaatctagtctattactgagatgtacatgttttgttttatagaaagcaacttactttaccattgcgggtgttaaaaagctacaccacccacacccatcccccgcacgcaacaacatggttggtgcgcttgactagaccctgaagcccccgtcatcgcgtcgtcggcaggcacacctgcgagcccaacggtccggaccgggtgctcacgagatatctgcaggcaattttaatctgggctatatatatatatatatcgtcccatctcgcgcgcgacttgatcgatcggtgatcgcgaccggccggcgtgacggagtacgtacgacggacggacacgtaccgggtcgatcgatcggatgccatcatgccgcgatcgtcgatacgtaccgggcccatggtattcgtccgttcgatgtatcgtcgtacccaatgccatggacgcgcgacgaacgatcccggccgccggctgatccatggatggatcgatcgacgtgaggacgcggacccagagcagggagagagccgtgtgtgcgtgaaaaaatcccggtagattttggacggcaaaagccacgaaatggcttggctagcttgctagtactactccctccgtctcataatgatttatcctagaattacgaatctggacatatatagttcccatatagtccatatattaggttacaacgttatggaacggagggagtagtaggcagcttgaatgcttgatctatcggcgcgtcccgtccggcccggtgcctgcccacaaactactcgcgcttgcttgttgctgccttgcaatcaatccatcaatcaaacgtctcaacgatcaatcagttcaatcagtattatgtgtgtgtatgcgacgcagcgaccgtgtcgtgttgtgcttgtgcagttgtgcgccatttccattggcgtcatgtgactcatgtcacatgggcccaagacgacgacctaacgtgggctgcagatgggccgagttaattaccactggccgagaaaaagcccagacggaacagagctcctcctcctgctgcagtgctgccagtgaagtttctgtacaggaatttccatggaattctctgccgctatactcttttaatgaattaaatttgaaaatatagtgttcattcaattattttttgttagaaatatttaggatacagcacaaatataccatcggtctcgtacaaccattgtgcgaaaatgacgcataaatgatttcacgaccggtatcgtgcagtgaaagtgcgagaccgtgcggtctcgctcaagcaaacaacgataccgctcaaacaatcaacgctatcgctcaagcaaagagagatatcgtgccttgcctatttaattagcggttaattatactgattattaattaatcactaatcatgataattaatcactaattattattagttaattgttaattaagtacttgatcactaatcaaatggatcccattggacaatgtcacagatggcttctgcagtctcactcttccattccgcgagagaccgtgcggtctcgcgctttcgccgcgcgataccatccgtgatgttattcccgcgtcattttcgcgcaacggaagtgcgacaccgatgatatatttctgcataattttttgcatcccaaatattccttagaaaaaattgaatgaacggtacattttcaaatttaatttctcttttaatcaccggtgaatgtccacccgtttattgcatgtcatctaaattattattatttttttaaaaaataattgacaagatatgtaatatatcactacacaaacatgtaaattaaaatttaatttctacaaattgtaacataaacaacaaataaaactcaaagtagtgtatatatatttgcagttaaatttctcaattttgttacagcttgtaaaagttaaatttaatattacatgtttgtatagtgatatattacatattaatctatctagttaattttttaaaaataaatttataactatttagttgatatagttgatatgcaactaatggatggacgttcacccgatgattagaatcaatctccattctctgccaatttctgtgaaactttgctgctgctcagagaggtaaggtaactaaaacggaagcaccacaagaagagatcgaataacactgcacatcacaggtagtagtagtagttactaattacgggaggaacagctactgatactcttaactcttaatgataattactggggaaggctactaattaagctactgccacgagaatgggagcgacggcgacgtgccgtcggaggagccctcgccgccgacgtgaaacatgccgtggtagttcatctcgttctcgttggagcccggcaccagcacggcgttcagctgctgctgctgctgctgctcgctgtccatgctcgggcaggcgaacccgccgccggcgacggccgcggcggcgggcgagctggcgaaccacggcgagctgccgccgaactgctgctgcaggttggggaccaacggctgcgccatggggatttggtggtggtggtggtgctcggctcccgccgccgccgccggtgacggctggaccatccggctgacgtcgacgctggaggagttggccggggatgacagaagagagagagcacaatcggagtcgagcacttggtggtggtggtggtggtggtgggcggtggtcgtcgtcgtcgtcgccgtcgtcagcccgtcggaggagaacatcttgttgctgctgctgctctccggtggcggcggcgcgacgacggtggtctggcacaccgagatctccagcgtcgccgccgccgccgcgccaccgccgccgccgaagcttatctgatcgccctcatggaggaacgggaaccgccggccttccttgggggagaacgccgccgtcgtcgccgacgacggcgagccgacgaaatgcggctgccggctggtcatcaccggatgagggtggtgatgatggctgtaatatggggtctcctcggatttgatgatcccaggccagcttggctctggtcttggaggagtgaaggacgcgaaccttgtccctacatttgaatacagaactaaaatggccgtcattaaaacaaatccgacgaaatgaaatctccattatgtaaaataaataaatgaatgaatgaaacaagccctagaacagctactaaattgttcggtgtggaagaagaaattcagtccgttgatttaactttaaagctccagttaatgtgggtatctggaatttcatctcagattccaattcttgaattaagtttgagtgattaactcaccatgcccactaaacacaataacccattcatatatgataataataataataaatctgacaatagtatcagaaaggtaaatatcaattgaaacataatactatgcacaacaagatataattttttttgctgttttaactgaaacataagggttgcattgtgctctctaagctccatgtaatatataggcaaacctatcatcgatttacacaggaggaaactagtagaacttgcggaatacgtaagtatcaggtagattactgaacctcggttctacatgctacattttatgagcaattggggtataatttgcagtggcatattggtggagtctagatatacattactttttgtttgctttacagctcagatttctggtttaagcaagagaggacattacataatttattttcaactatgtcattagcattcaacatactcttcaaaacaacagtttttaaacaagaataccttgttgacttgtcataaagctgccagaactcatgctatctgcctgtggcttcctgcggcgtcgattgtgcccatccaagcgttttctacaactacgcttagcctcatcaaactccccaagcaagtgaaacctacagaaatgaaaagctatgatgagaattccaaacatcaaaatccttttttagtacttaataaatctttataaaacaaagcttgattgttatactaggaagtgaaagggaaaataaaatagagctgctttaatgctgaaaaggtagtgtgagttctaattgaagcaaaaacatattcagatgtacttgttttatctcagagataaataatacagtacatacgaatacttcaaaattaatggggctcagatgctatttaaaagaagaggaatgatacgtgtatttatttgctgaatattcaataatagcacccagcttcaattaaataaaatggtacacggctggaccaatcgtatttcaatgtgtcagctaataatttcaatgcatggggattcagttatataaaagttttgtactggcctgtcaagcacaagagaaaaaaaaacagtacaactttggcctctgggacatttggaccacggtataatggttccagcaggtatatggcagtatgcatcccaccagcctgttgcttcatgaggatcaccttttttttttgcaatgagcactgaggaatacttgataaagactggcaagcaatatggcattttaattttgctccactgggcatctgggagagggcaattaatcgttgcaaaggagtccccacaggatataaatttttcaggaggtggcgaatgattggctgataatatttgtactgtgttaaaggtaacatgatgcagaggtaatttgctcattatagctcaacaacgtaaaaggacatcacaaaaagtccacaactgaactagagatgaacctaatacaagatctcggcttgcgtagtatttttataaaataaaaaattgacaaattggaggcgcgcattagctccagagagtaggattcatatcggcagaaagtggaccacattatactcagttggtaagagtaagcattatgcttggaactaatttagaaaagcagctacagtagttgttatgtcctgaaggaaaaggattttcttttttttttttgtttgtggaagcaaatgattcagctggaaaaggacgaccatgctttaacaactgttttatttcagttcagtagtcaaataacaaggatgatgttcatattcctggaacaagatatactcttgaaaattaaatatagcttttactgtacagccaaatcggtcaaaatttcactgatatcttacccaaaaaatactgatcgaatttgaaaaggtgcacacaaaccaaccccaaaacacacaaaaaggggtaaggcaacctattgggtgtatttatctgatttgtaattagttaaccattgagtagacattggtatttgtaagggttatctggttgaatgcactatacagactgtagttagctttcaaacagcaaccttgttggtcccaacaacttaaataaagagcatagctaataacctgaagcaaagcaagccataatataaagcaggttgcatgttcaatatcatctttacaaatcaacagtccctcataataaatactgttgcacaaggatccacggaaaaaagtgaaataacttgtatggatctggtcactgattcagaaaggaaagatctaagcagaaaagggagctaggcaaacatgtcagaaatggggcctaatcaaccagggtattacttaactaagagacattctgattcttaaactcctcaaagcaaaaaaaaaaaaaaagaaatcacatagatcctaaactacctacctaatgtgttggaactccatttttactcttaaattttgcagctgaccacaaaagaattgctacctgatgtcaatgacactacccgtgaaacataataaatttcttcggcgatacaacgtaaaattcacgaatttccagttcattcatcactttcaaacaaaaaccatgaagaaagtggccccagggataatgtgcacatgtagcaggtatcataacaaaagacccaactccatctgatctttggcacatgaaatgcatcagtggctttttagggataataattaccactgatgggtcagaaagttactagtgcagaaataggaaaagaggaggttataattcaggtataccggttgccaaggtaaagtgcaacaggggaaaaacttgtggtacatcttatgaaaaggctgaaaagttggcgccggaaaaggtaaagctgtgcatccttggaacaagacagccagaaaaatgttcatctcatctcatctcatctaatctctagtgataaattttcttggaacaattgtgccagggaaagggaaagccgaggccaaagaaagaactgatttggcctattcactttgaataaagggaataatcagcagtgaaaagaaaaggatgtagaagagataaactgaaccccaatcagtcagtgtgtgttcttggttgcggccaatttttattatttttttccatcgcacaattcaggcaatgatcttttgcaaatcacaatccgacgtgacacgattgcgggcagtcatcgattcgggaatttaatcaatgtgctgaatttagcatggctagaattggatatgaactgaaaatttgccaaattttacccgattttcttgtgcttttttttctttttttggttcgtcagattggtttacctgctgcactgctggcagaagcgcatctcgcggccggagacgacgacgacgggagtcttggagtgcggctcgcacaccttgtgccgccggtggtagtcgcggtgcttgctcaggtcggccttgcagccgtccacggcgcacgacgggcactgcccgccgccgccgccgcccccgccgcgcggccgcttcagcgtgctcgtggacggcggcaccttcgccaccgaggcggcggcggcggcgctcgacaccggcgccttcgccgcggcggcgggctccttgagcgcgtccgcggcgccgaactcgccgagcccgccgagcttgaggtcgacagagcactccggccggcccggcgccccgcgcgacgccgccaccgcggcaatgcccggctccgccgcgctcgccgccgccgccatgttcggcacggcgttgtgctccagctcggccaggtcccaagaaacaggcatcttgagatcccaatccatggcacgacacggctccactccacgccacttgttggcaacttggacacctcgtcgtctacctctcgctttcacggtgaggccaccaccaccaccggaggaggaggacgaggaatggccggtttgtcgccaccgcccgtcgctctcatcccacggacatgccgcggcgaaggtggcaactagcggcgaacgaacgaaccaacgaattattgatcgcaaacaccgagataccaacaaatcgagcgccaagaacagggcaaatgcaacagatcagcagcagaagcagaagcttatcctgatagggatgagagacacactgaaacacacacacaaaaacacactctcttcacacagcagaggagaagagagatgaccagcagctgcagctgcagctgatgctgatgctgatgctgctgctgctgctgctgaatgagcaagtgaaattgatggtggttgtgcttggctttgctacttgtagctgctgctgctacacaacacagcacactgcacagatgcagcacaagtgcacaacacaacaagaatactctaccaccaaggaggagactagtagtggtaggcagtgagtcagtactactcctacttggtttttgcagaggaggcaagtgcagactgcagagttgtgtagtgttgtataggcagtgagtgagtgatcttcatcagtgatgaggggaggaagaggaggaggagaggtggtcatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggcattataatactccttctgtttacagataaccatcggttttgactttgagctgttttgcttccatcaatagtggctttagaaataattttggctattaccatcaaacctgtatcattcaattgaggagtcaaatgtattttttaggaattacttacattcaaatctatctgcttgtacatcgcttaaatcgtacattaaaaaaatatcatgctgatgtgtttaatgaggctagtcctaatattacgactgtcatttaaacagtagcaaataaatgtggtttttggtgtattgccagggcctttcagctcgatgacgaattccttagaaagtcgtttacctcaattgaataaggtctggtcgaatgagttgtgtttatacaacagacgggtaattgtttgtggtgagggtgttttaccctctccactgtggtttcctacttcttaataaagtgataggcatactcatgtatattaaacaaaaataacagccagagtttatctacctctaatcaaaacaaacatatatttgtgaccgaaaggagtataacatacattattttacatggaaaaaattcttatattttgggtagaggtattagtaatatacttgtagtaatatgttttctagcttggcttgttttttgtttgctgcatggatggtctgatgcagtgtttgcattgcattgcagccattcatctcatcaaatccctgacagggattctaaagggagcaaacaatgaatgggggtgggatgggggcccccaagcaccacagggccatgttcatcctttaacaccagcatggagccattgtgccgcaataattggggaggggttggtttggttgaggggaggccctggcctcttggaggccaagtgcaattacttttcttggcttcttgttagcagaggtttggtggtgtgtgttgggatttattatttaggtgccacaaattaaaacaaatcaaatggctttactgtcctgctacagtagcaggggttgtgatgtgtgcagctcagtgttgctatcttctgtcttggggtcattgtttgatagtttgctctctaccttactgaaattcgagaaatggggtatataggtatatttggttcggtaggagaattgtatttacgtgagatcaaattatgatttttttataataaattgaaaacgtagaatattttttattgtgactctttcaccgaattgtatacggaactttcgctgttataaatagtgcgtgtgatttagatagttgaaggttacagttaagaaaaaagtttctttcatggaagaaaagtcaaatattcatagaaaactctaactggtctatgttttctgatttcataagtacattatatatatattatggttctttatatgctatatgctgttggttcttgtgtgttcctagctagctactgtgtgttgaaatctgattctttcttttcttgaaaatatgcaagctgatttctcactgggattgtagtaacaaatggcgcaaatgtcacccaaacttcgtatacatctcattgtcaaaaacaaataagcttcacaattaacacatgtcaacttttagcccggtgattcaagctagcgtgaaaattatcacgcgccacgtcactgttgtttaatgtatggttgttgggttgaactcttaacaaacattcatgctaatcattttgtgtcaaaaactccatcttatagaaaataataaatttaataattaactagctctacatgaaggatgttttaaattgtcttgacacttatccccttgacagagaaaaggacatcaaccttaaaactaagagcctatttgcagctgctttgtaaggtgagtaggagcaatttttaattccagaagtgtgtagaccacacattctgactccaaaaaaaatctatctgagcaaacttgcacttgcacacattagtttaaccctaaaattcaagatgttccaactgcacctctcctgcaggtcactggtccatttgatctaaaaaaaacagtatatcatggtccatttctccatcacaagtacatattattaattttatatatcactagtttatatcttgtcgccacatgtagcaccagaccaattcagaatttggtgttttttatatacacagaaaatacttttaaaatgctttgggggttcttgtttgggagggagcctgtcctttgcctattgccaaggacatggggctgatttgtttgtttgttacttttgggtgtccttgacttcttgtgtataagggataaagggcttctaggtaaaaaagaaaagaataaattggatgataggtgaaggattgctctatcatgataggccactctctctcacaccatgtagcctttattttgcaaaaattgtggaggagatagaatgattggttacataatgtttctcctttgtaccttgtgcttcttcttctattttttaccgcgtttccatctgccagttaatatggcaaaattttccccaatatatacactccttacataacgatgtatttccattgcgccttataaatcttctgacaaatattaaataaacaatggaatctcagaaataagtaagtagccattacttgggttgttgataaccatgggaattatttccccacaaacaatagtttgctatacatgttttgcacaatttttttacccacaagcaacatcacttccaaatagcagtatcctcaatatgcacctttttttccctttaggaatacgcaaaaggcattcatataattgcattatgggaattatttcccaccaacaataatttgctatgcatgtttgtacaattctttttactcgcaagcaatgtcacttacgaaggagcagtattctcggcatgcatatcttttttcatgaatacgcgaaaggcgcacatatctcattacattaagagttttgatgtgtacatttaacttccagaatttttacacgatttgaatttttggggtgtggattgatttgccgaatgatatttctccttttgtacatgttcttttttaaaattttactgtatttgcctccttccaacttgtataagaaattaagaataacaatagcttgtgccacataacctactgactaataatagtataaaatacaaatgggattttagtaacaaagtacgtatagtcagtattatgataattgataaccatgataattactatcatttccctagcaagaaaaatacacttgatatgcatactttaatttgcataattctttatacacacaaatagcgtcgcttccaaatgaacagtatcctcgacatgaacattttcgcattacgaatctcgactctcgacgtgtacctttagcctttaatttggattgtttttccacatttttttgcacgcgttcgctaaattttacttctaacaattaattaaattggcatccttgtgtccaaaacaaacaggtagcagtaatagtaaaaacaaaactactccgtgtgtcgtaacaaaatttaaatttccccataattaaatgttggtcgctcgattggcagattggcaagatgggatgcatgtgtccggggagcaaatgcgtttgcagaaacggccaagctgcgtacgagtgaagttgacgccaattgtcaaggcatgaatgtcactgtaagctccaggggtatccaacgaactttgtctttctttctccctctcttttcttttgggttagttgatgtataacaaacttgcatctcaaaagtcagaactactataatggcatccaagaagccaaaaaaaaaggaaaaaagtcggattaaatgactcaaaaaaaagtactattccctccatcccctaatataagatattttgacatttttgcttatgttgtttgaccattcgacttatttaaaaaaatttaaaattattatttattttatttgtgacttattttattatccaaaatattttaagcaaaactttttgttttttatatttacatataaactttttaaataagacgagtggtcaaaccgtaaaagtaaaatattaaaatccctactactacggcgcattctgtcaacatgtggcttcagaacttatagctagtactggtcctagatgtagtcatgtagttgtccaaaacatctagtagtacctaatttgggttagtgactaatcaggaaataatcgctaggattatgcccttgccaaactagggatgggttacggtgataatgtactggatgttcttaattaacagcatatcgattaatccttaattaacagcacattaattcatgtagatgatgattaattgtaggacagacgcatgcatatgatggcacaatgaaaccaaacttgtttttcttgaccaaaattgcacgaaatgggaaaaatctagtacttcatggtgggtgcctaaagtcctaaaccgtgggtattatgctgcaagttatcaagctgtaccggcaaagtacctcttccactgagctagctttttcttgtttggtgggctcgtaaactagatcaactctcgtaatcatacgctctctacggtcacgaaaacatatcgttttgaacattgacacacacaacatgtacaactaatttctgttgcccgaattatttgaaaactagataaaagtaataattataagtttttttgggagacaaacttatacctatacattcatctaactattctatatgttttttttctagataataactattctatatgttattggcttcttcaataattttataatatatcacatccatgttcgacattttcaaaacatgacttgaaaatggagggagtaattgtcaagctacgtacgggaattcataagaccaaagcttggatagagtacaaaagagaagaaaaaaatctcgtttttcacgtgcgtgtttcccaaactgataaatagtgtgcacttttacgaaaagtttctatagaaaaattatttcaaaaaatcatattaatctatttttcaaatataaattaatactcaattaatcatacactaataactcattttgttttacgtattttctcaaccttcactcttcctctcctctcaaacatagccgataaggagacgtgagttggcttctagtaatagctggttgcggtgcagctgcaaccaatgcttctgaatatgcctttagagatcatatagttgtcaaccgcttcatcgtgtgtttccaccagatttaaccgttacgattatcacggagcgacctacctaaaaaagaacacgcaattatgatagtaaatatttccccctttgaagtttttactacccaaagcgacaagtttttacccccgtaacaaattaaaaataaatgagaccacatgcagccagtagcatggcgtgcaagtgggatattgagggaactcatcaatggacagttggattggttttcccactgtttgggaggcaggcggtggttccctctctctttaatgtgcccatcgctgatgccagggctttctcttccttccttggaggacaggaccacccaaaataaaactcctctgcctctgccttggctagtgaattcatacagccaggttcataatccccatgacagataaaaaaccgcttgaatgatatatttggatttcacgaaaatcgttgataaaaaccgacaaaaaagggtagaatacaaacaagtattgttaaaaaaaattatttaatttttttaagttgaaggaaaaacgagtggtttgtggtccagaaattcatatagaatcgtaaacgtgagaagttcttttaacaacacatagacagtgtgatgtttcgtatcgatatagcggtaaaaatattataagtctacaaaaggctttagtcatgaaaacggaaaaaaaaacacaccacgcgtatactactagaagccactactgaagagcaaaactcttcagcaaaacacaacaccctaaaaaatatatttcaaacgatacctcgaacgaggatatgataccaatagcgtaaaaataaattattcaaaaaaactaatgtaacacgctatgattgtatcttgaattttcataactacatattgaataaactaagcggctaatatctctttgtttgtaaaagtttttgtaagaatttattttaccatgtatagcatcgctcttctttttcccttgcctctgttaccctctttttaactcttctagaagtaaattcatatgccatgttaaagaaaaaagagagggagaggaggcaaattcatgtgccactcgtgatagtgatgcaggtgcttcgtagtccacacaagcgtgcgtccctaagatactgatctgcacgtcacaaaaacaagccccctttttccaataccgcctagctcgaaaaccatcaaatgatagtatactcccaaccatgacagtctaagtcgaccaaatccacacaatctaagagcaagtttaatagtataaccagctattgtacctgctctgagacacatacaaactccagcaaacctctaccgaaagatcctcatgatgttagagacacattgatagctttctataaacaccagtacacatacccatcaggatgtccacgtatcagtgactcatcaacatcgctagtgtttgataaattaacaccattacatacacccttctgacgtgagatgttcacatatcactatattagtgactcattgacgttgttagtgtttgataaacaccactacatgctcccatctgatgcccacatatcagggactcacagttggtgtctgccaattggcatcccacttgttagcgagacgtggatgttatttgcctttttgttttggtttattggcttagacttttaagtcagtttaaattcatttttcatccatcccacacatatcaatacaaaactaaaaaaactggaacacccccaattctagtgtaactattttccatcttatctactcccaatacaaatattccctactttcacaaactccaatgcagtgactacctttaaagtaaacttattttgaaacaaataaaagagattaaaaatgaacctaagcctcaataaagaggcccttaaacgttttgactcataaattcgcttataattctaaaacaaagggcatcatcttttctcttatacttatacttatcagtcaaatttaaatttttaaccttaaatttggagttgattttggggttttttcattgaagtttatttttcagcctttgcttttagatcgctaaaaacacatatatatatgaaagttttattcacaaattatttttcatttacaaatacgccgttttgcttattctccgaataagcgaaacgatggggtccgaaagatggctccaataatttttgttcaagccaagaatgcatatatatagccggaagcccggaaatatatatggatgcgtcccattcggacgtagcgatctcgcgtcgcgtcgccgtcgggcgaggggcgagacgcaacgcaacacaagcaagcggaggcgaggcgagcgtgcgtgcgttcgtgcgggcggtcgctgggcgcgcgggcgggggggagcagtggcggcgacggcgacgggtcgggtcggtcgctttcggggcacatgcgcggggggcaggggagaaacgacggggtttaatgccgcttttgggcgatttggaaatttaagttggatcacctactggtggttgctcttttatttcttcacgggttctttcacacctttgctctgcggctgccctgccctgccctcggtgacgagctcgggtttaaagcttaaaagtttcttttaaaactcgagaagaaaataaaaagattatgttggcagaattcgaaatggatgtttgtaataatgttgcaggtgcttgtcggatgcgatttttctttttctttttctcttttttttttggggggggggggtagctgatctgtttctggaggtgtgaattgtaacaagaccaaaatgggaggatcttgggaccagaaattggcacatttaatcagcccccttaagacagcactgtgcgccagcgattgtaggttgaaacttgagagagagagaacagcacacacaaaaagacagaccagtgaattactagtactacctttgccttgtcaacaaccaacttctgtggctgttactcctactatactgtacttctgagtgcatccttccattggatggagttacaatttaaagcaaatattatgccagttttgtgctaaaagtcatctgattgggaaaaatccagtgacatggacaccctacaggcataacaattctccaattagcccaggggaatcagaaatcaatcaatctaatcagctcgatagctagttgctacgaaggagtattctcctacaggtagatctctgtttcaggctttctatgttatccgatcaggaggagcaaatgcacggacatgtaatcggatcaggtgcaaaacgcaaggacatcaagttgcagcgacaaggcacggatctccacacagttgagcgcaccaaccaacattccggactccagaggacagctctcttcttggaaagaaatgctcccttcttttattacacttgcatatggcattccacttccacaccaaatatcatccttttcaggcatgtggcaataacatcgactctttcagcaaccgcaacgcaattcaaagttttggacccccaaaaaagacaagcggctgcgtcctagcagaactacagaaaaccgtgaccacaatctgcgaacaccaaacagtggacgaaagtcaggaatagttgaagaaaaataggcaggtccgtctagtaccctatattagtacttggagaaaataaaagcagtcccttctaagtacccaatataagattgattgtaaaacattgggtgccatgagcctgtaacatgtcagttattagaaagtatcaaccataaatgtcttgctgtagatagagtgcgtctattaatggcataaaacaattctactaggagtagtttgtaaaaacagtccagtgacttttagtaaaatatacgtataattttcaattcttggatatttaacttaaatgctttcaattatccttattaaccttgattgtttaaaaggattcgtaccacaaatcatctggcaaccatgtagatctgttcactgctctacatcaatgtctgactgttcacctttattggaacctacgcgctgcaagaggaaagaaaagcaggcgtatgagagaaatatatacatactccctccgtcccaaaaaaggcaaaccatgggttttcgtgccaacgtttgactgtccgtcttatacgaattttttttataattagtattttcattgttgttagatgataaaacatgattaatactttatgtgtgacttatctttttaatttttttcataattttttcaaataagacagacggtcaaacgttggacacggaaaccagggtttgtctttttttggacggagggagtactccagatacaaagaacagagaagcaaatagtcatagcacaaatatgatcaagccatactctcccaaatactgaaattaatagcaaagcaaagagattttcctatttccagctgtcaacataacacttacagacagtgagacaaattattttgctaacagcatataacaatttaagtgagaaggttatcatgtaaaagagcagatgtgatttaccatccgtttgcttatatatggtttcatctcaagggacaacttgttgctcttctcttcgtgaggcttatggtttttctcaaactctttccttgattcctttcttgtaccagattgccagacaccaccaaagttagggagccaactagaatcagatgtttctggaacaagttcacctcgtttttccatctccatttctgctcttctcctctctgcccatgcagctcctacacgctttgggttaagctttccagattttcctttccgagaggatggacgagcataaccactaagtgactcattctcctgatcacgctcgctagcttctaaccagggaggaggagcacccatgtgcacatttgctttcaagccttcataacataacgatattatgttaaatttcacacaacaataaggaactaaaaatagatatctttcatttgctagagctgcagcctctttctgcatccaaattagtgacatgcttcaacagaaatcgttacaaatatatatatatatatattagaaaaactgtaaaagtgtgtagtaccctgactggaatttccaccagagtttctctgttggacctgaaaaaaattaaccaaataggaagaaagcagtcatatcttaatcatgcctgacatcaatgatgtatacatgaataataatgcaacaaagtacgagacaatatcaacgcttgcaactttgcatcagaagagttgtgggtaattatgcttcttttaaggaaattggaacctgcaagctaacagagaaggcttttttttgggggggtaaaagagatactgttagcactaagatttgaaactaaaaaaaatacgtttagcatccccacaactaagatacaagatacccaaaagataaaattgacatgctcctgctttgaacgacatcgactaaatcaattttttttccttgttcgaaactctgaatagaaaacactcgcttagttgttagctttgcctcaaatttcacagcaatgaaacacaataatggataacatccaaaggaccatttgcaatacctttttatggaatatacgcatgtgcacgtgttgcttacttacatgaacagaacaagaaaccgatgaatttggtccatttccgaggatagtaagttgaccacctgtggagaaaaggataattagcaaaatactactaatcaaatggtaaaataatacagtaaggagcattttaaaactcaggttcacctttcatttttgtgcctgcactttgaaacaagtctgtacccagcataacctgttgttcatgtaatgcaaccgatccacaaggtatgatgggcactccgaaagtctcaaatggagcagaatacggaatacttccaaaggaggaagatccctggcatgctgtactattggggtagtatgccccattagtaggactttgtaaaggcataacaacattagatgcagtattactagaagacgggatgtaagtttctgcaaaattatccaaatgtttagaggtagatttatttcggatatctttcagtggccccagagatggtccaatcaacccttcggtcgacgtctcttgttctgtactcgaagactcgcagcacttctcccactgaaatatcagaaacaccacatattaatacaccctccgcggctctgccacacctgccacacctagagtgatgaaacaatgtacttggtagcataaaacagacagcagtgcaccttagcaagctcatcctccgaaatcctaaacgaatccacctgatccatcccaccaccatgcttttgcaggaaagccttcacgccatttaggtgatcctggcttgcgagatgataaatagcattgctactgcaatagaataaaattgggctcagatcaatatagtaatatgtaagcattgaaacttctttctaatttaccctcaacgctaatgtaatgttgctccaatagcgccctagccctaatgcacgggaatccgacgctactgttcaatttgagaactcctaagggcaatccgaactgaaactagaaccaacttatccagatcgaggaaaccctaggagcaaggggacgagttgagtaccaagcgaagcggctgtcgaggtcgacgagtcggcggagcagaaggggcaccagaggcgggagcgggccgcggaggacgggtggcggagcgcgcggcgcaagtcgaggagcttggagcggaagcgggagagcgcggcggcgagggcggcgcggtgggcggggaaatagcggtggcggcggccctggtcgtggttgcggcggcacagctcgcaagtactcgaagccgccgcgggcgcggcgccccgcttcggcggcatcggcggaactcgccggcggtctcgtcggctcgccgcctccgccgccgcggcttccgcgcttgtgtttggtgctcgttcagaattcagagttcaggaggttggggatgggggctattggaatttcaattttggaaaatttcgtgccgtttggaacaaaagaaaattttccgttcaaaagaaactctttttcacattattcttttatataggagtttacataacaccggcccatatgtatttttttttcaatttgatatcgtataaatcgcgatttgttattttttattttttgctgaatcacagctgcttgacatcccagttctctaacgagtgatttccccactttgcacttgttgatcttgcatcaatttatcactctttctctataaacaactctacacatttcacacttgtatattggggtaagtacctcctgctgagctgcacatgctcccgctactccctgggttataaatgtactccgttttaacttctactagcgtttgaaatttattcagaatataatatgatttattgttttctatttagcctatcatagccacatttaaaattttaaatattaattttagagttgatttttttttaaaaaatatgttctagcattggtttttagccataaaaaacatatatagacaaaaaatatctataaattattattttagtggctaatatgtgttacgacttataaccagctataagcagaatgctcaaactctcgtctcaaccaatctcaggtttcacagccatattgtatttaattaatctactacttactcatctcaatcgatcataattatctcccattaaatttcacttacttttatctccatacaaaattatagacactcttgcaatttgagacagaggaagtttctctattgcttgtcgagagcatcaaatattttgcaaatgaactgtaagctcctatttggagtgtttaagattttaagaagcggcttgttcatagctctaaaaatgttgggtttctaagagtttattttctgaattttacagttaagtattcctggaatgtgggtatttcaatgtttagggtagttgaagatccttgaaaaaaagtgggacgtaaatcctggtttaaaatgcaagaggccggttctcgtcttccttatggatgccttgattgtacatgtgtagaaacacagcacactacaccgaccaaacgaaacgaattgaccgatattaattcgtgaaaagatggacgctcttgtagtcgtagacaactctccagagcatactattccggtcccgtacgtaagaaacgccaacgaacatccattgccgtgacacgcgcgaggcggcaggtgtcccgtacatgctcctgtgaccggcctggtaaaaaaaaaccacagtgcaacgcaaagtacacatcttactcccatatactgatgcggcggcgatgtccatccaatccaccacaaatctaccagacgtttctgtacactgtgcactgttgaggggcaccatcaatgatgcataaacaaccggcaccacattactcccaggaggcgtgaccaccgcgacaatgaatataacttgccaacttgggatggcaaccacaggacgcgatcgatgccctccggctcccccccataactcgagtggttagcgcaggtgtaccgcaaagaggacggcagaatcgaaaaccaaacgcaggaggagcagccgcgatccaggagaaactgtgccggccaacactgttcaggcggagaggagccgcggtcccctcgggaggcttccgccatacggcacggcagccaagccgcccctgtacgcagagaagggcacagtagctgatgtactacctggttcaatcaaagaaggctcacctgctgtctccttcactgttgcgtcgagagacacggggctcagctggctgcagtgacgagctgcagtggagtgatttgaaacataatcgaagacgcaacaaacgtgagatgcgttttgaatgcttaatttgagtgtgtgttagcacatagtagcgtctatctccatttgccatttgggacagcggcatggacagatatctacgtgtgcgtgagtgctctctgactatctgcacaaacttgagcaccggaactaggaataggatggatatatctacttgtggtcttctgcacctgaactacgatgttagttgctcctgacgcttgcgacacgaaccctcactgaacttgaacttgaacttgggacttctggcgcttgacgtactggaggatcggctccttcacctgcggtcattttcacgggatcaattaaactcaacttgattacagcgccaaatgccaaatactagtacatgccaaatgccagatgtttcagttcagagttgggacatggagagtttaccgtgctggccttcctgaatcgcttgtcctgcgagcactgcgtcccgccagcaccagccaaagactttctgaccttctgcccgagaaccccactctccagggaacaaacggacgcctgctgcaaaggtatcacacagttcatcaccttcagctctacgtttgtctgtgatttaatttacctggattctgagtcgcatatggctcagaatcgtctgtggttagtaggggatcaggtttcggttatacctcgcgcacgcttgtaggagtcctgcttggatccttatccaccgtggaagcttcctgcccgctctgcatggacacgttctgctgcggctccggaagctcccgggtgcgggtgaggtcagatccgacggactggaggcaacccatcgtcgatccatctctcatttcatggcctataaagagaaacatattggacaatgtcatgttagtactatatacgcaaagacagatgccaagtccatggagatgcggattgttgttgccattaccactcaggtggtctttgcgctcaggctcaccaggttctgcattggtatcaatggcctgcatgatgaagcagagtttcagattaaccatgaataaaatgaatgttgtggaatgcaaagaattactagataaaaacttggtgctgttagatatgattatggtaccatttgttcggctatatcgacttccagaatcttttttatctcaaggagctttctgttggtgacttcagaatgaatgacagctttgcctgtaaaatagagtgacataggccataagatggtatggtgcacagtagtagtgaatcagtcatttgctcaaagattagtactagttctattagtacaatgcatggcggcaatggtcaatctgaaaagataagagtgatgtatctgaagttcctaaaatcattagttttcatctaaagcagcaacagcttcagtacatgtatattcttcacaagtattacagttagacaatgtttttcatgaggcatccaaaatccttcttcaagagaagttgttgacagttcttcatataataagtgaacatgacaaaaggtaatcacttgaagttgcacaatctatgtagaaaatgacactcagttggcatgttgattcagttattctcctttcacagttgtaacagaattgagcaaacaatacataacttgctcctggctgacagactaaaccagaaaagtaaataatgtaccatagaatagaagcatttgagattttgcaagagattagttcaaggtgttacctagtcttcggttggctgaattcttgacatatccgtcttgcaccattttttcaatcaacttacgaaccatgttctggctggcctccccatctagcttgccatgaagtttgcctactgacacataatccattggaagtgcatggtacagtgcctgtagcaacgatatatatcagcagaaatgacatgatgacctccaaatacaagccaagggtaagcgacagagatacaccttcatatacatcagatcaccattgctatttttagttccttcagtaggtgagacattttgcatgatgacctctttctttatgtgtggtgttgtaggatcagcaatctgaagccactctatgatgctagtgatggacagtacaatatgccacagggtaaaactaaaatatagcacatgaagaaaatgtttggttgaccttattaacagaataactatccttttttgctctggatagtaaaccatctttaagtagcctctccataatatctgaaaagtgagtcattagtcaagtatttcaaggctttagtgagagtgaagaaagaatgcctggtaagcacacataagtttttcacaccactaccttcaaccatttcctgcaaagcattcaacaagatattgttaatagccagccatacagctcatacagtatatcaagatattgtttgatttataaacactgatgacataaaagcgggtaaaagtttgtgacctacttgtaagtctagcacaaaacagtaaatactctaaatagctattttattatataaatgaaataccagtaggcattaccattgatatgtcggggaaattaacaaggacatctgaaacctcaagactttcagtgtctcttgagcatatccactctcttacttgagctgttagctcttcctcgtgaacaggatcttgagtatcatctgcaaacatacaaagtcagagaaacgtatgaaattttcaggtactacagagtcagagaatgttgaacatgtattgcacacttcatgaaaaattaaatgagcatccaaacatttgaataataacttaatagttgacataaaattcatttgtatggaaaaggatgcacagatgaagctctcagatcaaattaactgaccttctgagattgtaccattttgacctttgcaagtcccatctattttgataagtatgttagcaccaaaaacagaaagtacaacaagaatacaaacaaagaaactttaccatttggagcaacaatgtaacgctctgcttcagatgggcgaacctaatagaattagcgattcagtctatactacaggtaaaaggaagacaaaaatatgcgtatacatcgaaaggtggcatcacagcacactaaggagaaaattaagagaatctcactaataaagatgctcaattatatgttctcttaggtctttacctcagtgtcagaaaaatcattatcttggtcagattcattatccaagctcatattatcatcttcactgttgacattgttatcatcacaagggtcaaggacactcttgacctgcataaagaataaaaacatatgtagcaatgagtttaattgagaaaacagaggtttcctggtccaaacgactgctatctccataatccactaccttcaaagctaacacgagatgcttgctattgacatttccaacttccatcttcaaggggttcttgttccatatatttatggcctcgttgtcagcgcaacacttaaaaaagggtggctcgtaatcttcaggctgcaaatagcataataaattaactgttttcgattccacgaacaaagttctatagaacagaaaaggttgaatccttcatttgttcagagcaaaaataattatctattatggcggcttcaagtttcagtaaatagcaagaacaaattgctgcactcactgtgacatcatcgtagtatagcagcttcattagaatggtcctctgaggacaaatacaggatagcattaggtaagttcaatccattgtaacaaatctgtgaagtgcaaaaattacctcctctggcatttggtccaaggtcctcataagtgaaaccagtgttcttatcatcttacaagcagagctcctgattgggaaccatatgatcatgtcaggatatcagcagtgactagttaaagcttacaataattactttgcaattgccatacacatataaaaaccaataaacaaccattaatgagcttatctaaaggactaaattgaaaccataccttcagaactagaattctgcaagttgtggaagaatatttaagaacaactcgcagaaaagttggactcaaaattataagcccaactatgtttttaaaaaggatttacatcatttattgccacctcacagtcctatgtacctaaatttacaaagttactggaatctatgtacctcactttttcaccacattccttacatagaaaaagaaaatctgaactccttttagtcatcaatttgctcctacttctttgaaatcataaaattttaaactattgttatgttgggactgcaacttcattaaacaaacactctccaaaatgtataatgctaagcaatatgaaaaattaaccattaaatcgtagcatttagctaagcagcatggataactaactagaagtctagaatgaatcatagcctttaaaagggatatgtatgagagaacctcatctgatcaggagtgacttctgctgcatttgatttaaatgtagcactgtttttcttgctccctgtgcggctcaagttcattgcaacttcatcaccgctcgtgttggggtagctaaatgagactgcaggggagtttgacacagaataagaaaatgtttgacatatgacccacaatcactgatgtaaaaccaactttgtatgctagaagttagccatatttcacatggtaatactcacatgcatactcctcaatcattgggccttcctccttctcacagatgcagaagagaagggtcttgagatatttcttctgtagtgcatcatagacacctaaaatttatcacaaaaatggattaaatgaacaaattggaaaattaaaaagatttaacacgtaaaacaggacatattttcacctttttccatccaatcaatcaacctcctcgactcagtatccatgggcattagcttcttaatcttcatctctgcaataaataaaagggtgttccagctaataatatcatatcatctgaggaatttggtgtataaaagggttagggactataggtaatgtgacctagtgccggaaccgacttatcattgaagtacttctcagggaatagacctctgatgtagctgatgttgtatatagcaatgcggagcaaattccttgtctgtttggtcaaaatatcaccacgttatcacaatagcgttctaccatacataattcaaagagagttcagtattcaatgtaatagaaatagaagggcaataaaatcatcacaaattggattactgattaacaagtttaggccttattggatcctggtccacccccagggatggactgaaattgtagttcagtttcctagcccatcctggagcatggcccagggttttgggcttgccaaacaaggtgaggcacaaaagttcaccaaacaacaaatgtgtcatgcttttcaatactttagcacatgttgaatcaaatagggtaccagtcccattcaaacacacacctgcaataaatttcttaacaaatgcataaatgaacatggaccatacgatatatttcacctactatgcacttgcagtcatgggatcctaagcacttctaggcaaagtgcagctgaccatgtgagcaaacaagtactagaaaagacaaagaaaaacattatttgattggatataaaccaactggttttttgaaagtacaagaggtaccaaagtttggtgatcaaccagtaatcctaaaactcatgtggcaaagccaatgtccacttattaaaccgagtatctaacaaagatgttaaaataggagtgagagtgggggctagtctaaaaatcatgccagcagaggtttaataagctggcatataattcctaaaggcataacataaattccaaattcaaatgatagcgcaacaaaataaccgattataaacagaagtgcagcttttcttatcacaaactaatgcaggattaagcaaatgtctgttcaaacccaaagtagtgtatcggaaatattttaaaaaacagaagaagaattaggtcatagaactatcagaacaggaaatctgggaataaccaaaccaatacgtgtggtactgtggtgtctcaattccacgtccaagcaacaagtttgaaaagagaaactaaaattactcatggaatctgctgctgccaaaaaaactctgaagtctaaagagataccaaaagcaagcacagcaagaattcaacgaactgaataaattttagatgcttctaacaatatgattcaaaacgattggaagtagaaactcttcacaaggctatggaagcaaggaaaaaacctttttaggccctgccaatttgatcgattcagtgaaccgtggggggtatgcacccatgattccagcatataatcatctacgcacaaatcatcaggccaatgctcgtgggtttcacaacgaaacaaaaacgaaacgggattatcaaaccagcgaatgtctcctagaattccaaccaaggtaggcaacgtttgttcaaaacccaaacaactaacaagcctactggaaacatttgaaaaaatcgactcatacgactgtcagaaatggaaatcctgaacaaccaggcccaggccaatacgagtcgtgtctcgattccatgttcaagcaagcatttcggaagcaaaatgaagttactcactgtaactgctgctcccaaaacacttcagaagagattccaaacgcaaagcacatgagaagttcaacgaactgaacaattccttagatgcttctggcgaaacagttcgaaacaacacgacttgaattcgaaattcttcgcaaggatatctaagccagggaaaaaaactttcaaccctaccaatttgatcaactacgcagactgcagagactatgcgcctatgtttccagcacgatggtctacgcacaaacaatcaggcaaatgcctgtgggtatcacaacgaaaccaaatcgaaacgcgattatcaaaccagtgaatgtctccttgaaatcccaaccgaatcaccacgcgagtagcaaaacaaagtgatgtgatccgttcaacaaaattctaatgctgagagaatcgcacaaaccagtagaaattctgctcaaaatttctgcgaaatttagcaaaccaaccagagatttttcacgagaacattatgtcaaaaaattttcacgagaacagattcggtgcctcaaaccagagaaacaaaactcacatcgatcaagcagcagggagaaaaaccaccgaatcatcattcagtgcgataccgaaacgatccatcagttacgcattcgagagatagtgctacacggagaaaccagaaaccaactccaatctgagatacccagaagcttttgaacgggcggagagcaccagaggaagtgaaacaaaaatcccaggactcatgctccaaacacgcctaaatccgcacgagaaatcggttaaaatctgcaaagcaccaatgaaatccacccaaaaacactagcaaagtgagatgctactgatgcttcgcactggccgcccaactagcaccatttggtagtcagcggacggagactaccagagaaagcgagaaacccaaaaccccacgacgatctccaaacacatccaaaatccgcacgagaaatcggttaaaatcagcaaagcaacagttaattccacccaaaagcactcgcaaagtgggggggggggggaaatccgacacgcgtgaccaccaacactcgaatcaaacccaaatcgaacgccagctactgcaaaccccagtacaccacacgagcgatcaaatccacagcgaaaaacctcccaaaaacctcggcagaaaaccctcgatcgggtgaaccgatccgatgtccggcaccgaaccaccgaaatcgaaagtcgcacgggaatcgaacaggagatgggcgaggagagaaaaaaaaactcaccagaagcagcgaatcctgctccgtgatctccgcctccttcgtcttctgagccatcacctgcatcgcaatcacccactccgatcagcacgcacacaccagcaagcgcaacgcgaaatcgaagcgagaacccaccatttcgtctctacggcggcgcgccgcgcgcgagatgagagaagggagaggggagaggagtgggagagagagagagagagagagcgagagaatttgcggggctttggagagctagttttctcttcttcttttttaagtactactgtatatattgaagatttaaagtgttatgaatttttacccgggtgcttttctttcgaggaaattaccgtacccgagcgccttttcttttgaggaaattaattaacttgtaaaacaagtactagtagtagccgtaaatttaattacgtgtctgccacgtcgacaggacgggcacgatgcgtttccggtttcctgcttccgagatttggaggacccgcctacgctgcgccagcctggcagcctgcctccagctataaaagtactccccctcgccgtgattcgccctcgtctcccaccccgctccaccgccaccgtcctccttgctcgcgtcacgccgccgtcgccgtgctcgcgtagtcgcgttcgcgtcccacccctcatccggcgcggcgcggccgcgcggcgcgccccctccgctacgccatggctcttccgacggcgaccgttgccagcctcccggagctgcgcgccctcgtccgggaggtggtcggggagtgccgcgtccaggtacgctccgtcgcggcgctgcgggacgcccccgagatgtaccttgccctctccgccctctccgtcgactaccagtggcaggtcgaggacggcgacctcgagcgcctcgccgacgtcgccgagctcgcccgcgtcctcgacctcatgctcaaggtccacatcccgcagctcaagctccagctcgtcgacgtcgacctgcggcgcgggctcctcaacgacctcgtcggcttccgcgtgaggggttctctcgccatccacgcgctcacccaggacatggcggacgatgtccttgctgccagccccatgcccaccgccggctccggtgccctgcttcttcagacgcactcccgtctcacggagctcctgctggaccgcctcctcctccactccatgcaggcgcgggctctcgcactcaggattggtcatccgatctcgacgagtgtgcaggcgctcgacgagcttctgcacaacgacatcgccaacggcgtgcgagcggaccgtctccctgaggcgactccaggtcaactcgatcgcgctctccatcgcattaccaacatgttgggatcgcctgtttgatttacctccctgtttgatttacgaacagaattttggatgtgtagtagtaagagattgtattgcttagtccccctgttttgatttagggatttgagagttgatctacgaacagaaatttggatgtgtagtagtaagagattgtatcgcttagtccccctgtcactttaaaaaacgggaatacgcaaggagcgcatctttgtattaagaggagtaaaagtctgtacaggtgaaagagaaaacacagcaggacacgggattacaggaagtcacccaagagcattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttctagatagtccatgctgcgagagtagcaatggtatcaaaacctcgccgttgagagctcggtaaggtttccctcttgtcacacaaccaggagtggaatgaggtttcattgacaggcaagcattccgagcgaccgattgccgagagcagtagccaccagagctgtcttgattctgggcatgcgaccaaaatgtggttgatgctttcctcgtgctgatcgcataggacacacatgctaaggtggggcaagcccctgatgcttaacctgtccgccgtccagcagcggttgagtgcgaccagccagctgaagtaacggcagcgcggcggcgccagcgatttctagatcggcgtggattggaacgggattcgaccgaggaacaatgcttggtaggcggagcgggaggagtacatgcctgaactttcccatttccaaataaattggtcctggtgatccgagagctctatctcccgcaaaaacgaccagagattgagatactccacgatggcctgcaatccgagggctcctcgtatatcgctttagggatttgagagttggatgtgtagtagtaagagattgtatcgcttagtcccctgtcactttagggatttgagagttgttatggttgatttaccaattgttacgatttgttgcatttaccaattgggatagaaatgaatgatgaccttcatgtatcagcaaaatctaccaactgggatagaaatgaaatgattctacgctcttgatgaccttcatgtatcagcaaattaaatccagtggctgccagatttttcttttcgttggcttgttacctgacttcttgaatgtgcaactaaccatggttgagtgttgaaatttgttttaggaattgaggtcaagctgtagatatcttgtcagcccaatgcaaccaaaaatatgttgatagtatagctggtagagcatctgtaattgaaattcaaatgcagaaacctcttattaacctgtttatcacttggtgtcaaacaaaaggtagatgttccagttaatgtcactagcaaaatttagagatgaaagacgaaaatgattcagttgtgtcctgggttaatgaagagaaacgcaagcatgtaaagttacaaaacttattggacagtattataataatgtagtaaatgaagagagaaattacataaccatctacgctggataaatgctgagaaaaacacaactaagatttaacatgacaacggctgcaaggcttcgtaacagctaatttaactgtcgagggaacttttcgctcgatgaatgtttcaattgccaataccgctctgttggcttcagtgagcatcttgcctataggaaaacatttcttgtgttcgcctgtagaacagctagaaacaccacgggttgtatctagtgttaggcacttgagtgaggttgtattgtcaagaatataacatgttagctcgatcaagctctttgcagagcagaaaccagtgatcttcacgctctggaggttgccatgacgatggtgttcaggcatctgcctcaattgcaaggaatctccaaaaattgagacatgccccatgcgttcttgtgatacctgaagatgaaaagccaatgtgcttcaattgatggttaccactgtaaatggccaatacataagtttaaagaatgaaaattaacttacatccagaaagaaagtctccaaggaaggagaagcatcaagaaaagaaaccagagaaaaataatcataggctggggaaaaagtgaccattccaacaagagaaatagtcaagcacttgaggtggaggaatttgctaggcaacattggtgtgtcgaccatctgcggaaagataatcagactgatgatattcttctaaagtactgttgtaaggatatagcaagtccataatcatttaaagtttttgggtgtacctcatgaggagagccaatggttagagtttcaagatttggcacattggatggaagctctgcacaagcataatagacagcaccaggatagcacatggataggctcttcatttgcaacgattcgccaagcaagagttgcacatgattaattccaaagtgaaaactaccaagatttggagcactattctctatgacttgcagcattctacattcaaacacttccaggtggctaaggcgttgcaacaggcaaggtatcttcacacaaattattccatagcaatagttaagttccaaccgctccaaagcataagaattagagagaacgcaccctaactcattgcctgtaatatgtacaaaggccagatgcagcctcgtcaagtttcttaattcaaggttgattgtgggatggaaagaacacctgctaagataaagatgccgcattgagcttcctctcccatcagataaaagtgagcacgggaagttgtactcatcatcatattttgaatcaaagtaatttgtgttgtacgataatatcccaagagtgagttcttcaatcaatggtgtaacagcaatctgaagccaactgtcgagataataactggtgctggcattgtaaaatataccagattcaaaccttaatgatttgatgccaatgcctgagtggtttttcagaatgcaatcaactttcttgatgaaattcaagtccggtgtttctatacgaaatataagattaggatgatatcgccagaaactacgaaaagcacgagacacgcacgcagcacgagcagcatcccgtaatggcattagggagtgtatatgactccagatgtcctgcatgtataatcaggaaaatattgtgaatgtaaactattgcctcagttggaagggaaaacagtactagcatatagggtatatccgtatagcgcattggaatttgtggtaggcaaattgaactgcatttttattttgctccttttctctttcaaagttttagtagagtctgtcctgaaaaggataccgtatgtagaccgtcgtcagtgactagtaatgataaactaatatgaaacttatgcttagttaggcaaggactagccaataatatattatatctgagcatatgtgggtaaactaagatgtatgaaatgatgtgttttttgtacaatagcatcctacaaattataaaagatagaaaataaatagaaaaaaatacacatatattctttataaggtacaattctcaacagatttggcagaaagccgatgtaagaaaccaatagctttggcagctacaccgtgagagataatagattgaacagaccaggaaaacaaaagaacgccatcctacaagaatattcacttctcccaccatttatactgaaattagagcgaacagtagtgaaaccacttcacatgaactgtgaagccagcaaaatgggcatggtttacttcaaagctttctcactctcctagtctagacatgttagttgtcaacaatcctgcaacagacatattgcccagcatctcaatgcccactgaagaagattttgagagcagaatgggatattgacaaacatttgtgccacatataactctggttaccagcagtgaccaaactcagatgtccatgggcagttctcatcacttccaagttgccggtattaacttctttatgaaagttagttttcaactgaactaggaaggcatacgcttgatggatgatgaggaagatactaaagacaaattgcaggccaacggttctgtaaacatacattaggaaactgcatctaaaccacagtaatagcagaaaaagaagtacatgaacccggtcactgataaggggagggggggggggggggaagaatctctaaaaaaccaactgcggatctaagacccatcaccaacagttttcagcgggaggggtaaaggtatacggaaaaactgatccgcgatcgatcgcaagggcgatctggtagcgatcagttgccccccctcctccctccacctgatttctttttttggcaccgcattactttcctattttagtaaatttatgcacctaaagtttatacacctcaagtttacacatctaaagtttagagaccaaaagtttatatatccgattcaaatttgaatttgaattcaaatattttttatatatagtatttctatacatctaaagtttatagacctaaagtttttagatctaaagtttatagaactaaagtttataagtcaaaagttttatatacatgtttcaaatttgaatttgaattatatctgatttaatttttaatttaaattcaaatattttctatatatagtatttctatacatctaaaatttatacacctaaagtttatagatccaaagtttataagccaaaagtttacatacccgattcaaatttaaatttgaattcaaatattttctatatatagtatttctatacatctaaagtttatacacctaaagtttatagatccaaagtttataagtcaaaagtttacatacaaattcaaatttaaattcaaattttttatatataatatttatttacataaatttttccaatttttgttttttttaaaaaattttgttgtgtactgtaacagggaagagaagaagaggaggaggaagggagagaagagagacgtacacggggaggggggtgcaggtatcacccgcgcattagcagtccccaaaggtataacagctagaacggagaaaaggtactcatgcagaacttttaggaggttgcagaaccagcactaaagatttgttcaaaaagttttactataggtgccgaggggtgcatttagaggctacttacagcagtgataaactcatagtaatgcttttcctctaatagaagtcttacattatcatcatttggtgtcatacctctggaaggttcaaccctgaatatcccattattttgccgccttcagaatttgcaagttgtagacagactgagccctttcttttagccactgaagcaataaaaaaaatctgcagcacatcacatgtgtacagacattaacaacggaaacaaaaaaatcatggtacaaataaatcagtttggttcccttgtccaacttttgtgaaagaacattcatggctataaatccaatttgtttccattagggaaaaaaaacagttcagtttagcattggtactttttgttgaaataaagaactctctcttttattctacacttctttagagcacatacataacatagtggctcgtcataggttctgcccaagcccaataggcattacagtgaaacttgtcatccagtggtatacatatttctccccaaaacttctcccaaatcttcttgtaagcaagatgcagattcttgtgaaatttcggtgtacagactgtgtagccagtttactagtttagctcaaaagagtcagtttgttctcctcacaaaaaaaaaagttaatttttttcctaagaaggaaccgtgaaacacaaatacacaatacctaaaggtttccgaataatttgctcaagaaacatatgcattaaattctgaacaagatgagagttgagagacactaaagagaggcagaaggaggtaggcttactacgggcttggatatgccgccgctcctgttgcacggacatgagccgcttgaggaccagcaaccccattgacaacacctcagctctgctagaaatcgatggcgccaacctctgatttccccctcctctcggtacccaaaacaagaaaaatcaatagtactatatcgctatttgcagaggcgaggtgagggattctcgccggcgccgacgcggactcccgcagcggaggtggaagggccaacaagccccttgtctgggtgttgttcttgccttctcggcctatgatgggctcagtcaatataataggggcaataatatggtccgtcagtggaggcccgatcacccacgagaaaaaaaaaacgattagtattggtaaaaatttgtcgacaaattttttttccgttaagatttgtcgaattttcagccgttaatctaaccttgacatccatgtactatttgtctcaacgctccatcgacacgcttaactcgctagtgctcgactaccttgtgcatccaatcgtgtagtgtacagtttcctatcaacttttcactctgccaaaaacgtataggggatgaaagtctagtaatgaagagagagagagaggaggtaagttgagaaaaaaatatagtgtaaatatagtacttttagagtgtaatttgtagtaattactttgtaactcatagtaaattacaatgttataatttctattagatttgtatgcaatttatttttttctatttttcactaaatataagttactctttatttttaactaaggttatctttaataatgagttttgtgttatgctaggtatgataaattatacatgctatttttatatgtgtattatgtaagtattaaaaaccctagtgattttggtttaaaaatccgaggtgatctataggtacttaaaatttaccccctcacataaacataaattgtttttcgtcaatatgacgctgacgtgacagtttagtcaatcaaaacaattaaagaaaataagtcgtggactcgtgggtatcactgttagtgctcctaggcccctagctctctctaaccacgcgagaaggccatgacgcatgacgagcaaaacggtggtggaagctggtcgtgccgagcccaaagctctgtgtccttttgttatggcaggtcgtgtcggtaacaccacccccgagcttcgtgtccggctatcagttgctacttgctagtcgtgtcgtgccgcccctctagatgaccaaatgggccgttcggtccggcctgggcccgagaccagctgggtcggtacggcccgacctacacgtcgggtcaagccatatccacccacgggctaataagactcttgactgtgtcaggctggtccaaaagtacaaaaacccatcgtgctcctctttgaaataagtctatttacatatgtcacctctttgggttgtgtcttatatggcttgaataaatctattttgcatccctcatctctttgggccgtggttatatggttagaataagtttatttacccccctcatctatttttacctctctgatcattggactatgtcgtgtcaggtcggcccatcgtgccgaggcagaggcccaggcaccgcccaacggtcggggtaggctagcatgggcttgactccagtcggtgcatgtcgtgcctgggccgagccaaaaccccatgccgtggggagggccctaggccttttggccatctatagccgcccctagtcaaatatgggtgatgagcaaggcaatgacaacaacgacagctgagctagcttgtcgaggatgaacatctctttgcctccttcctcctccctctctctcatccctatctctctcttagcatagatgacgaaggaggcggctctcaatgtggagaagcggcaacacagttgtggtctgaggaggcgacaggtctgcaagtcgatgacactcgggaaggcagcaacgagggaggtagaggaacgatggcgggagtggagcttgatgaggcaacgatgcaagctaagcaccagctctatgaggaagcggcgactaagctcagggaggtaggtcttggcaagacgggaccatggagctcaagcggcggagatcgatagagtggaggtgtatttggcctatagatggccaccctcccgtcacttgctcgagttcgaagcgctaacgtcgccatcacacaaggctctcccgttaaagtacaacctgctatctcctcgtcgatctagaggccgtgtagctagaagaatgggaggtagagaggagtacataacggggagggatagaaagaaatcacgagtagagaatggcaagcttgcaggtggtgggtagtggtccagtggtcctaataggagggtagcagtggcttgctaggtggagaaagtggaggagagggctagagagggtgaggaagaacgtacgcatgtatggccccccaatttgtatagttggcgctcgatatgacgtgatagtgggcctgtatagttggcgctgccgcagctgtacatataaagtactgttggtatagcctgcaacacagtgcaaataagggcagccaaacaggtccagtgtatgaaaactggtagaaaccaactgaagggtctttgaaagttagaagggtcggttatctttttttttttgagttgaggggtttgttcaaaacaatgtgaagagtcgagagggggaagtgtttgtaaaatggacttgcaagaaaaatgagtgaaatacatgtccgatctttaaagtagcatgataagatcgtttagatccttgatactgtaaaatacatatttagatccataatctctgttttatagagatggtagaaattctaaacttcctttaaccgtgtgtaattaccggcatatttttttgcactctatcctaacacacattttttttattccgactcctcccaaacacatactccctccgtattatattttaatgtataacaccattgactttttaaccaacgtttgactattcgttttattcaaaaattttgtgcaaatataaaaatatttatatcatgcttaaagaatatttggtgataaatcaaggcacaataaaataaatgataattacataaatttttttgaataaggcgaatggtcaaacattggaaaaaaaatcaacggcgtcatatattaaaatatggagggagtacacaccacggcaaagaaggccaagattccaccgtcgctcgccatcgcagaggcgtgttggggtttttccgatttgcccccaaattttggggccaatttggattgctaccaaaaacatgccctaacaatattttggtaatttaaatagtacttgtgtttgatttggattgaagcccattcattggtaatagctaatctagtttggcattatctagaacattctttactataatttaacattttgactttatgttggtagcaaaccaaatatgataaaaacaatcttaccttatcaaatatttggtagtaccaaaacttatctagattttgatactaccaaaaagggtaacaatacaaataggcccttggatatcacgcgccccctctcctcacggctgcggctataaattggagcccccttcccattccccgcaatccccccactgagtccagtccagaatcttcccacccaaatttactcctctcgttccctcccccaccaacggccgcgccgcgggtgtcacgatggcattggtggtgctcgcgatcaccagcctcgccgaggcggaggcggtggcgagggagctcggcgggccgcacagcccccacgtcgacgtccgcgtcgagtccgtcgtcctgagcgaggcacccgccatggcggcgatcatgtacgcgctcttcgacgactacggctggctcgtcggcaacctcgacaggctcctcgacctcgccggcgtcgacgagcacctctccatcgtcgccgacgtcaatctccccaggctcgcgcgggacgtgcacgaccccaacgccctcgcgcggctacgcgacagcgccgccaccatcatccgcctcgccaggagggtcggcgggccatccaccgccgcctacaccaacttcggcaaccgcatcaccaagctcgcccaccacatccaggaccccaaccgctcggtgctggagctccgtggccgcctcggcgaggccgccacccgcgtcaacttactcaggtccagccacttcgatttctgagccagacctgaatatcttcaaccgcatctcgctttttgccgtgaggattcgcacgtttcatgtgagagaacagagttcgtcccctagatttgttacgactacctgaacatgtttcaaaatgtcacaaaaaaagtgaaaataatttctgggtggtgttggtatttccctgttcgatttggtataatttgtccccccccctttttttcctttcgaatgaatgagagtatgattggttcatctttacattttctcccatcgtggatcatcctattgcttgctgtctctcagttaatggtttggaattttggatgcactaggatatgcatgatttctccagttttctattgatcccactcctttcggcacttgatgcgattagcgtgtgctacaagaatttggtggaataccgacccggcgaaaattagtttggtcgaatactatcatgtgctttgatcctgctgcattttaaaaaaaaagtaaatggcgtttacagtatacacttgcggggctctggtctctagagagtgttttttttaaaaaaaatcttttacccgagtaattttcctttcgaggaaattataaagtggaatgttcttttaggaaattaatggcgtttacagtatatacttgcggggctctagtctccagagagtgtttttttttaaaaaaaaatcttttacccgagtaattttcctttcgaggaaattataaagtggaatgttcttttgggaaattaatggcgtttacagtatacacttgcggggctctggtctccagagagtgtattttttttaaaaaaaatcttttacccgagtaattttcttttcgaggaaattataaagtggaatgttattttggaaaattaacttgtaaaacaagtagtagtagtagtaagtttaactagaaacaaaggcgcggcattgccacgcccagctgaaattcagcgagctaatttgtccaaagtaacagtaactattacttcatattaagaaggatccatcatatgcccttccaaagatctccatgcggcatatgcaccgtacgtccttagcaacttgtgattttgctaggaaccagcactactttccttgtgtaaattgattaagtccaggaataacatatacaaatactatcacaacctgacagacaagatgaggtactaagactgcatatttatctttcctaaacattatgaattactaatataacaaactcatttgccaatcaatcacctcttctgaatgtatactcaatttgtgccaaacatagatttgttgtagaatcttttcagtgtattcagtacaggctgaaatttttagagaaaccttcgacactacaattcaaagccaaatcatacaatattttaggacctgtaaactggggcctgcctacccaatcagggagcaaaaccgtagctcagcaatcaccatgaagtagttggcagcctctgattggcctgatccttgcttacctgtctcttgttttttttttttgggaacaatcaccggaggggagaggttccccacctgtattccattgcaaaagcactgaggttaagagtacaaattatctcttgttgacccagcttatacttttgtgagagggactaaagtttagtccctacttccgaaacaccaccttactatatggctgaagatagaccaccacaggtaccacttgctgctgatgttgctgtgctctagaactctttggccatggcaagtcctggagacctggagtggtggccattgtttccactttccacagcatgagcacttattgatgatggaagatggaaccaatgacacaacaataagcaaagatagacttcttctccgtgtccctgtggctagaaaattagtctccccatctcacaaaaaactcaacctaggagggtcacattcccttctaaattgagttttttttttgacagagaggatgtcacaccccagtctggcaccgccgtacaacggcacatgataggagcgtgtcatagaaaaaacggcgcgaaccgcttcctacgaaaccgcgatctcagtaccagtcccaggacatagtgctggtacccacggtgacaaatatgattcattgcaaatccttaaaataaatagatgacttatttaccttaatttaggttgcagcttagaacagcctgagaaatgcaaccgacgacgcaaacgaggaaacaccaacaacagcagcagcagcggaaccaacggactaacacccaacaccacaggcgacggctgggaaccaggacgaaaccctaatcttcactttacttcatcttcaacttcagggtggaggaactatatatatttatatagagcaagggtgagtactttcgtactcagcaagtcacgggaatttagatgtttgatgcaagcttggaagagaggcaaggttgttttgcaaatcttttgtttgaaatcattttgaaatcactaagtgaattatttctttttaggtttgggtcgaaaagagacttgcgtctcgattcggcttaagagatgcttttcaacaacttaattggtaatgtaccgacctcccgggtcagatcattacttctcggctcccagagccatttcacttgattaatcggctcccagagcctttttcattttctcgaactcccaaagtccagctgcccagcagcacaacattccgcttccactcgggaagcctagtctatgatgcccgtagacatcccgaatcacacagattcgtttctgaccactcaggtcatccatctgccacataggttgattctggttacgattcccacaccacaacaacttttcacaaagcacatgcaaataaatctacgcaacaggaaacatctcacatccgcccatgaccgtgggcacggttgttcggacagttagttaacctctgcagagggggtacactttacccacacgacattactaacccggatgtagcgcccgttccgtcgtggcgcctagcgggaaaaactatctcttaaaaaccctatttgcgaaatcagtttccttgcttgttgtctagtgtccgtgccatctcagatctcaaatccccgatctatcgtcaagttcaatcccgaatccaagtccttcccaaatcaaatccctccgcaaaagtctattttgcctccctcgggttcgatgggccgaatccctctcggcccatctccccctccctctctctctctctctctctctctctccctctctctctctctccctctccctctctctctctccccgctctgcccgtgaaccgcgtcgagctctccctctccactctcgcggctgttcccgccgatgccacccaaatcgccgcgccgcccgcgcgtgcgcgcgcgccgtggtggccgaccggccagtcgccgccgccgtcagcgcctgccgcgcctgccccgcgtctgccgcccgtgtctccgctccactccaaaccgccccgccgtcatcgccgtcgtcatcgactcggccccgcctctccccgcgcgtgcctccaagggacgggggcagagctcctcctccctctgccgcgtcgccctctctccctcctccttttccccaaagcggcaaggaggcaagccctctttctttccccctttttcccttttccctcccgccggcgtcatcctccccccctcctgtcgccgttttggccgcgagcgccgagcgccagctcgctcccttgaccgcccaaggtcggtttccaaaccgacatcgccgccctataaacccaagcgcctccctcttttccctcccaatcttccccgtttctcgcccgcgccattgctgtctctcccgccagccgccgccgtcgcgtgtgccggaggagccggtgcgcgttaggacgcggaaggggactccgggcgctcgccttcttcctcttccccgacccgacgccggagagatcactcccgtgccgtcggcctctcgtcacaacgccccgcctcatctcggtagtgcatttccccgttctccctcctcgatccatctcctccccttagttttcggtagtagcatgtgtagccttcccgtagctagctagcgccgccccaaccgttgtcgccgctcgctgtgtgctcgccgccgtcgccgccagtgctccgtagcgcccgctcgtcgccggccttgctcagcgtagctccacccaatccgacgctagcaacggattcccgtagccgcgtagatgctctcaccgccaggaatcgacccctcatgacctcatcgccgtttcccccttccctcgccgccggttgccgccgccgtcgagctccctccggcgaatccgagccgtcggctcgtctcccctcatcctgtgcaacatcccggtgtgctcgccttcgcctgtatcgccctggttcgctccgccgctcgccgccgtcgtccgccatccgttccgaccggcgtcgtcttctacctcccgccggcccgcgtggcagccacgtaggcgccacctcggcgccacctcggccgcgaccggatcggctgacctggccagccgctccctccgtttccccccccccccacgtgcgcgtggtccacggtgagccgtgaggctacgcgtgcgcccgccgcaccgcgtcctccgcgaaccgcgcgcatgcgccgcgtctccctccccaaaccctagcacgccccgcgtgcacctcgctcacgatgagccgagtcgccgacaagcgggtcccacccaggaccacgcgggatggacccggcccaccggctctctctctcccctcctcgcccgtgcgcgcgccttgggccgccttcttgggccggccggcccattaagctcggccgagccgccccattctctcgggccgcgccctagccgcccgagggaagtctaatttccctccctcctccttttcctttcttttctttttcaaaaaggatttaaataaatccttttcctttagaccaaaaatccaataatctgagaaattcaatatcttcccaaccgtaagtccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacccgtagtgcgaggatttcgaggatcaagctcaagatctcgagcaaggcaagccacccttgaacatcttgagcctatatttgaacttaattatgttgcttgaaaaatattatgcattgataggatcgcacttaatccgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagatttggaaaacccgacacctgggccggtgcttgcgaactaaatgaatttccaaaaccgcggaccgggaaacgtaccgggtgtacggtttcccgctcttgcacttaaggaccgtttccttggaatttcatccgaacataagacaagtgcgaccacatgggtgaaatgggacacccctgactgagtaactagcttatcgggggagccatgatgctaagagacatgtggattcgccggggtggtgtcggggaggacccctgggcttcctggcatagtatggtctgagacctaatctggtgttggtctgggacccctctcgttggcatatggtgaacctgtgtcggctttcgaaatgccttgtcatgaaatccttaaggtctctagtcgtggccgttctgcacgggctggatgattcgggttagtaatgtcgtgtgggtaaagtgtaccccctctgcagaggttattaaaactgttcgaacagccgcgcccacggtcatgggcagatgtgaggtgattcctagcgtagttttgtttgactactgctttgtgaaatttgctgaagtggtttgggattgatgtttggaaaatctgcggctgatgggatcagccaggcctgggtggccgtttgaaagctgttggccgggtgccaatcttgatcaattcaaaagactgatacattgcatatactccgaccggacgagacgcactgtctcatccgtgtcgtttgagaagcactcacttagttgtttcagaaaagagttcaaataaaatcaattgcaaaaacaacagcccttccttgaagcctgcattaaacacttatttcccatggcttgctgagtactcccgtactcacccttgctctatataaataaccccccagttgctgaagaagatgaagcggatcccgctgacgaggagttcttctaggagcaagccggttacgatgagttttagggtttcggcctagttctcaagtcgcgcctgagatgtgtggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttgaagcgtcacgggctagttccgctcgggactagttcggggcgtgacaccggatcacccagctcgtgagatcagccacgtcgggagaccttaaggctttcatgacaaggcatttcgaaagccaacacaggattgccatatgccaacgagaggggtcccagaccgacaacaggttaggtcccagaccatactgtgccaggaagcccaagggttctacccgacaccaccctgttgaatccacatgtctcttggcatcaaggcttccctggtttgctatttactcagccaggggcgtcccattgcacccgtgtggtcgcacttgttatatgctcggatgaatttcccacaggaatcggtccttatatgcgaatacgggacagtgccacacaggcacaacccccgcatcgcgagttttcacaatttattttattttcaaacacgccgacaccacatgtcgggttttcaaggcttctcaaacccatttcccaagttttcgacaatcaacggtgtatgtgggatatttggtatacgcactcagagagcacgaataccgaggtaccacaagagtggagcgacaaggaatcagggtagtacagcctataggaatttgtgcgactactaggtaggtccgtcggtttagcacgcaaaccgaggccaagcaagttaagtgtgtgattctactaatgcaagttgcaacaaaataataatgattttccaattataggagcaattggtcaaagggtgacttgccttgctcaaggtcttcacgaagctggacgagggatgtatattagactttttcgggcggcaagggcgcggcccgagggttgaaggaggctcggccgagccatttgggccggcgcgggcgcggggaaggtggcccattagggcgcgcggaagagagagggagcggtccggtggaccgagtgcacctcgcgggttccaggtggggcccgcttgtcggtgacacggcccacggtgggatgggcgcccgcgagggcggcgctagggttcggtggggatggcgcacgggcggtgcgccggatggaccgagacgcgtcgggcccacgcgcagcctcacggctcgcggtggaccgcgcgcgcgagcgggagacggagggagcggctgaccggggtcagcttgacctggtccggccgagctggcgccgacgtggcgccttcgtggcagccacgtgggccggcgggaggaggaagaaggggaggccgagatggacggcggacggcggcacgcatcggcagaacggcggcgaggcgcggcgagaggaagggggaccacaggagcgatgagcggagcgaggaggagcgagccaacgggacagattagaagaggaagggccgacgacgacgaatcgtggcagaggtcaccgctggtgagaggaagagggaaactcgccgggggggagagggatcgattcacggtgggggaagcacctccggcattcaaggaatgtgtttccggcgccggatgggacggaggtgcaccgaggagggccggcgacgagcggcggcctccgggagcggacgacaatggcggcgaggccatgccgggcggcagcggggctcggggcggcgtccacgcgcgttcgatagagctacgggtgctagctcaaaagataagggcacgagagagagcgggagggagaacggaggaggcactaccgagccgggcgcagtgatgggcggccgacggcgcggggcgagctctccggcctcgggccggggaaggggaaggagaagggtggccggagtccgcgtcagctcctcgtgcgcacgccggcttcaccagcacgcgcgacggtggagggaggcgaggacggcggcaagatggcggggatggtggttcggcggcaatggcgctgtgggaggaaacgagtgggaggtcgagacgctgagggggctcgggtttttatagcggagggggagaggtcggtttggaggagggaaaccgacattggcggtcaagggatgcaggggcgacgagctggcggtcgtcgacgcgtgcagccaaggcggcggcaggtgatgacgctggcggtgtcgggcaaaagtggaaaaggaggggaaaaaaagggggctctgctctttgccgagttggggagggagagggatgggagcgggagctcggcctcacggttttggcaggacacgcgtggagcggctcgggcatgcgctgcagagctcgcggcaggcagcggggccgagcggcagcgcggcgcaggcgctgacggtggcggcgaccgggcggtcggccacgaccggcgcgtgcgcgggaaccgaaggcggtggcgggttcaaatggcggcggcgggaatcggtgacggggagagaggaacagagagagcgagagagagagagaaccgagaggaaggagagagctttctctcccgagcggctcgcgtgcggcgcacgtgagaagggggaaggcagctgagggagggaggagggctgagggagagaagtgggctgatgggaggaaatccggcccatccaaaacaagaggaggcaaaatagacttttgctgggaaatctgatttggagagaaatttgatatggagtttgaatttgaatgcaaaatgggaatttggatatttttggagtcgtgcggatatttggcaaggttttcaagagaggatttgaatctcgaatacttgaatcggaatagggatttcgaggagaaggatttgatggcgacgagagggatcaaggacagatttgaattgagatccacggcacaacttagactcgcacacaaggaacaaaaattttcgcaattaggattttgccgaattagtttttaacgtctcacgaaaagcggagcgttacagaggagtagtaagctggtgtgtgcaatgtgttataggcttatagctagaggcttaataaaggggcagtaaaatgtggtagatgctacttggaaaatcatctagcactcctatctgaaataaatggacatcttggcatcacctccctatcgccactaatcacctagtaacttgcatggaattcggtataagagatatggcctttttttaattaaaaaataaacatgtgtttagaaccaacagaatgagtacaagtttgtgttaacatgaaaatgggatagtatacatgaacgtattaaggaaatacatcaagctgctaattaaggacaaaaaggaagagcacatgatcaagtgagttcaacaggcaacagcaaactttacttccatagtttcactatcatcttaaacactgctatgatattctctgtcctcaatgcgactgtaccagataacaacacaactcttgttattattcgtggagaccccatattgcagaatttcaatcacttggtactaccggccactactcccagccaaggctccgagcatcaactactcgccaagagcttcagtcacctgcccagcactgcgcagcccagatatcatcatcaagtaggtgaccatgtctggctgtccggggctataccattcgccaccatccaacacacaacctcattggcagagtcaaaacaatcactggaggcgtacaacccgacgagcatcgtgcacgccgagtcgggcgaaatgccatccgcagccgtagcgtccagcacggcgagcagtgcgcccgggtgggaagcgtaagagagcgccgcggtggccgtggtgaagcaggcgtgcggcgccggaggatgcccatttcgtcgagcaggtggaaggcgcggtccgcgctcgcgccgttccccgacttgtagttgcaggggttcggcgaccgtagtgcggctgtgtcagggtaggcgacgtaggccggaaggacagctgcttggcgaggtcgacgaatcggaggaggaaccggtggtctcggaggaggaggcgatggaagggggagcgcatgggtggtgcggaaggaggatgcggcggaggcgacatctatcggagagcggtggttggttgtagccttgcaggatgcagctcacggcggagcgcgctacgtttgggcggcggacaacggccgaacgacgggaggagcagcgctggcggcgaagcgagaggagtccgactggcggagctgccgaagatggccgagttcagattaacgcttttgcaaaaaaaccctccgcaaactacgtactccttccgtcccataatacaagagattttgagtttttatttgcattgtttgaccactcgtcttattcaaaaaatttatgtaaatataaaaaataaaaagttgtgcttaaagtaatttgaataataaagtatgtcaaaaaaatgaataataattccaatttttttttgaattagacgagtggtcaaatagtgaaaaaaaactcagaatcacttatattataggacggagggagtatattgcaacgaggtccaccgcacgagatgagacccgatggctgcgcgcgactcaatccgcctgcgccacgtggcgccgctaatcgcccggtaatttgcatggaattcggtactcctgccaccctcagaaatttctagaacagcctacggctataactacacgccatgttccgtggcatgcctggtgacctgtaaattctctttcctctcttggctgagtttgatgagaaggggattgataagattggaaagatacgcaaaacgagatgagtcattagtgtatgattaatttattattaactattttaaattttaaaataaatcaatatgattttctaaagcaactttcctatagatttttttttcaaaaaacacactatttagtagttcgggaagcgtgcgcgcagaaaacgaaacaaacaaactcacaatgtcattgtgccgaacacagccggtcggctgtttgccgacccggcgaaataattcccagaaggggagagagactccgtaatctatcatggtctttggggttaatgaagagaacgtgaccaatgtaaaatacaaaattaaacattgaactgtacaaaatatacttagtaatttgagacagaaattaaagcatgagagaacaaacacacaagataatcatgttgaaaaaagaattacaactaagattcaattatatggcaacgggggcaaggtttcacaacatttaacttaactgtggaaggaacttttcgttcaatttatgtttcgatagccaacatagccctgttggctttagggatcatggccttgtccataggaaagcattggctgtgtttacctgtagaacagctataaacaccacgagtagtatccagtgtaaggtactcaagtgacgttgtacagtcaagaatacaacatgttagctcgatcaagctcttcgcggagcagaaacaagtgatcaccacactctggaggttgtcatgacgatattcttgcatctgcctcatatttgaggaatctccaaaaattgagtcatcctccatgctgtcctttggtatctggagatgaaaagccaaatatactttaattgatggttactaccatagacactagataactttgcagaatgaaaattatcttacacccagaagtaaagtctccaagaaaggagaagcatcaagaaaagaaactagagagaaataatcatatgcatgggaaacttcagcaagatcgatagtcaaacacttgagatggaggaatttgctaggcaacattggtgtgttaaccatctgcataaatatgatgatcatcagactggagacattcttctaatgtgtaagtattgttatatgaataccgcaagtgtattttcgagtttttgagtgtacctcgtgatacgagcaaatggtgagagtttcaagatttggcacattgggtatagactctacacgagcataatagacagcgttgcaatagtattgcaaagatagtgtcttcatctgcaacgattcaccaagcaagagttgtacgtgtttacctccaaaatcaaaactgcaaatatttggagccttattctctattacttgcagcattctgcattcaaacactttcaggtgattgaggcgttgcaactgacaaggtaccttcatgcaaactatttcatcacaatgctcaagttccaaccactccaaagcataacaactgaagagaaggcaccctaactcatctcctgtaatatggacattaaacagatgcaacttcatcaggcttctcaagtcaaggttgattgtgggatggaagctacaactgccaagataaagatgtcgcattgagcttgctctcccatcagacagaattgtgcatggtaagttgtactccacattttatgaataatgagatagcctaagggagagtttttcgatccatggtgtaatagcaatatgaagccaactatcaaaatgatggctgatgctagtgctccttctagtattgtaagaactatcatattcaaagtttaccgacttgatgccaatgcctgagtggtttttcacaatgcgatcaaatttgttgatgaaatccgagcccagtattccaatacaaaatataagattgggatggcattgccaggaacgatgaaaagcacgagacacacatgtagcacgggcggcatctttgaatgccattagggagtgtatatggcaccagatttcctgcatgcacaagcaaggataaaagattaaaaaacaaactattgtgaaggtaaacaactggttctattggaagagaaaacaatactagtagcttataaggcataggagcactaaagatccattcacaaaattttatctaggtgacatactgacataggaccaccggtgtgcacagttagaggctactagcagtcatagactcatagtgaatcctcacttctaatatcttagaggctacttagagtcttccattgtcggcttttggtgacatacctctggaaggtctagccctgaatatcttgtttttttgttgccttcagaatttgcaacttgttgacagagtgatccctttcttttagccgctgaatcaatcgaaccgtctgcagatacatcaggcatggttatgtacagacatgaacagggaaataaaatagtaaggtggtgtccttaacagctgtcctatacccaaaacctccttatatgctttcaaccaaagcagggtactagtaatctcttgcttcaatagaaaaaagtagtgaactgtgtcaagttcttgcttatattggtcattggaagcaacaaatgcaatatagttttatgggtgcttagcttcatcggttcccccatggagacattgcactccttcctagttcctcccaacttaaccccatatttacccccatacaacccatactacagtaaaactaggcacggaggctcccatgttatctttgggagatttgctccgatccaataaaaagtacatcgagctaccggtaccgtgagacatcaaatcgtttttaatcgttggaacggagcaaatctcttggatctaacaatgccaatcctacctaactagatctaacgatcaaaaatgatttgatatcatgaggtaccggtaactcgatatactttttgctagaccggagcaaatatctatcttttcacacctaaagtcgatctcatattttttttagtgcatggatgatgacagtcaaaataaacattgctcatcgcactactgcacgattgattttactggatgcccccctttttgtttccatgcggtccataagtggaaccacacggaaaaatagggaaccggcgctagggtgtcgcccgcacgggaaaattgattttccggtgcggacgtcctaatccaaccacacgggatattcctccctcctttccctcacacccacttcaaatttttcctatctctctcttcctttttcccctttattccctctcaatcactcccctttctctctaccttatctcttcttttatcccgtcctctctctcagcctccctcaaccctctctctataccttatctcttctccctcaaccactccctcaactggctggggcgaggtggcggcgctcgggcgcggcggcggcctaggtgaggcgggggccaggccgaggtggtggccgggcgaggcggccaccgggccgaggccggtggttgggcgtgaggcggcggtcgggcgtggtggcggctgggcgaggcggccgccgggccgaggcggcggctgggcgatgcggcagtcgggcacggcggctgcctgggcgaggcggcagtcgggcacggcggctgcctgggcgaggcggcggccgggcgcgacggcgagcagtgaggcggccgtcaagacgtcgccgagggcgctgaccgcatggccctcaccgtcgacgaccacggggctgtagccgacgacttctgcggcgccaccgcctcaccttccaccaccgccacaccttccaccacctcgtcgagaacgcctacctcccccacgtcctcgccgagggccgcgccgtcaccgtccgcaaccgccagcgccgcctcttcaccaacgggtgcggcggtcgggcgcggcagcggcgtgggcgaggcggcggcgagcagcgaggcaaggcttcgtcgtcgcttgtcgtcctcctcatggtcgtcacgtgcatcgtcaaggcagcgatgcggcggccgacggcgatttttgcttttttttttttggttttttttttgttccgggtggaataacacaaccgaacggatatatcggtcgttctgcccgcacacaaaaatgctgattttcacagacacccggctgcagacgggccgtacaaccgcacggggaaatcttgtctgtagtagtgtcggtctaacaaaaagaaaactgcgaatatcacacaaacattgccgagtaaatgttgttgcgacggccgacagtaatatgaacaggttacagatggcaaagacggtatatatggagattagattagagaggcaggaggcacgatggagggaagcttaccacggcctcggatgtgccgccgcttccccatgacgctgacgcggcggagggatccgatatcaagcagagaaatcgacgatttcgccgctcttctccctctctctccgcctatatatttcgcttgttcaaggggagaggaggaggaggagatgagaactcgccggaggccgtacgtcgtcgtcgccctgatctggagcctcgcggagttgcgctgctaggtgcgagagaaaggagatatttaactcatcgtaatatggaacggagggatttgtagtactacggtctgatactctgatctattcaggttcatagtcctaataccgaataaaaaccttccatagatgatactagtatctttgaattttgcccagatcattaatgaactgataaaatctggacaaatgtcgttttaataaaaaaacaaaaaaaatcagcttttttttttgacttacggagaaacacgtacggccgctgcatcttatccagtcctgttaagtttcttctcattttcctagcaaagatggcgattctgacacttcgtttgtcggatgggaatgtttggtcgcaccagtcattgcgagattagatcttactctttactctctccgtcccttaatataagaaattttgacatttattatattgttttacctttgtcctattcaaaaaactttggaattatttttttttgacttgctttattatccaaagtattttaagcataactttttgttttttatatttacacaattttttcaaaataaaacacgtgatcaaacagtacaaataaaatatcaaaattccttgtattaaggtacaggggagtagtttctttggttttccttcctttatcatgtccccttccccccttttgtattatccctgtaaataacttttacttctccttgatacaaaatgtgcttcttatgtattccaaaaaaaaacattattttcattttatttgaatcttggtcgttcatattttctaatgataaaacggaaacttgcaaatattctccgcgcgtcagttttggttacacctttttttttgttaacctgacactttagaacaaatattttcccttctttctgttaatataagggaacttgcaatacatctgatgcaccatggttaaaatttcacaagcaaaagttatagtaattgtattatcctgttcaagatttgatgataaaagcaaaactatataattatctattggacagttctaattagtagttcaagagagaaagcaccggacactttaaaatcaccgaattaccaagaaaattaagttgaagaaaaataataattacaaatatgattcaacagcatggcaacggctgcaaggcttcacaacatttagcttgaccgtggaaggaacttttcgctcgatgtatgtttggatagccaggactgcccttttggcttccgttatcatgattttgtccataggaaagcatctgtcgtgttcacctgtagaacagctgaaaaaaccacgagttgtatccagtgtaaggtacttgagtgcaactgtattgtcaagaatataacatgttagctcgatcaagctctttgcagagtagaaaccggtgatctccacactccggaggttgtcatgacggtgtcctggcatttgcctcatatgtgaggaatctccaataatcgagtcatgctccatgtggttctgcgatatctggacatgaaaaccaataataaactttttcatttgatgggctagtcacttaatcataagtttgcaggattaaaattgacttacacccaaaaggaaagtctccaaggaagggcaagcgtcgagaaaataaaccaggtaaagataattataagctggggaagatgagataatggtatgatcaatggtcaagcacttgagatggaggaatttgctaggcaatattggtgtatcaaccatctgcataaaaagcataaagatcatcaggctgaaggcatgaatattgttatatggacatcacaagtctatgatcatttatgttttttgagtaccttgtcagtcgagcatcagagggtgagagtttcaagatttggcgcattggatggaagctttgcatgagcataatacatagcatcggggtagtgcaaggatagtctcttcattcgcaacgattcgccaagtaagagttgtacctgcctacctccaaagtcaaaactgcaaagatttggagccttattctcaactacttgaattctgcaatcaaacacttctaggtggctgaggcactgcaacagggaaggtatcttcagacaaattattccattgcaatacataagttctaactgctccaaacaatgagaatttgagagaaggcaccctaactcatctcctgtaatatgtacattaatcagatgcaaccttgtcaggtttctcaagtcaaggttgattgtgggatggaatccacaattgccaagataaagatgccgcattgagcttgctctcccatcagctagaagtgagcatgggaagctgtactccatattgaatgaagatagagataggctaatggtgagttcttcgatccacggtgtaatagcaatctgatgccaactatcgaaatgatggctgatgctagtgctccttctagtattgtaaaaactattatattgaaactttaccgacttgatgccaattcctgagtgatttttcataatgcggtcaaatttgttgatgaaatccgagcccagtattccaatacaacatataagattgggatggcatcgccaggaatgacgaaaagcacgagacacgcatgctgcacgagcagcatctttgaatgacattagggagtgtatatggcaccagatttcctacaagcactagcaaggataaaagtttttttaaaagaattgtgaaggttcaattggaagggaaagcagtactattagtagcttataaggaatagctctttgggatttgtggtacgcaaactgaacggcacattttcatttttctccttttccctttcaaagttttcttagtggctatcgggaaaaagataaagcagattgtagccagtgactaattatgatcacatagtatgaaacctattcttgcttgaagtatgcagcggtagtcaacaatgttatgtatgaaatgatgcttttctccctacaatatcatcctataaattagtcaaaggtaatgaagaaaaaaataaacatgtatcttaaggacaaatcgcacattgggggttctggtaaacataaacattgatcatcaggaaactggtcgagaccagagtaatcacataaaagaagtacaggaacccgctgataagtgaggaagaacctttagaaagtgaactgccttaacaagattattaaggtgacgccatcacaaacaattttctgcttgagtgataaaggtgcaacagctagaacagagaaaaggtgccctcatgcagaattgtagaagattgcagctataaatatctgttcataaatctggatcaggctcctctaacttcaaaggcacgtgcctttgtcactaacatgtaggcccaatgaaccatggacccatctgtcagtgacaaagacatggtacctttgagtttgaaggtagaggatctcaatccttttgatctagccaccatatgaccaccagtgtgtagttagagactacttagagcagtcatagaatcatagtgacccactttgcttctaatataagtatttcttatcagcattaggtaccatacctctggaaggctaggcactgaatatcttgttcttttggcgccttcagaatctgcaacgtggtgacagaatgagcccttccttttagccagtgaagcaattgaacaaacacatcatttgcgtggttatatgcagacatcaatcaacaggggaaaacatcagatcaaagcacatgaatgaacacgaacaattcaatttggttcagttgtccagctttttgtgaaaagagcgggtattcactccaatttgtttcattacttcctacaaatcaaattcaaccgagcattgctaccttttacctcccaaaagaaaaaaacaattctacactattttgttcctaaattccacagatcataatgtcccattgccccttcttgaattgcttgcaagcgagatgctctttttttccccaaaaaagcaatcgtggctatcaaacacaattgctgaagaagaagaaggtaggagagggagggctactgcggggtcggagttgccgtcgccgccgacggcgatgccgctcctgtcgcgcagacatgagacgcttcggatccagcatcttccccatggcaacgcggcgaatacctcgccggaattcgcgccgtcgccggattcgcctcgctgccaccgccgcagcagaggtggagtccgaagacctaagggcaaagggagtccgacatgggccggtcctgtgctgatatgggctttctgggctgtgatgggctcggacgatagagtccggccttcacaaccaggcccatgtcggtggcagcttgacaaactgagtctattcttttttgttaatgaaattcatttctgatcttcacttcaaagaaatcacaactaattactacaaggttatacacggctataaaattagaaaaagtgatactacctccatttcatattataaaacattttaactgttttagtcaaacttatttaggttcgaccaaatttataaaaaaaatattagcaacatgtacaacaataaattaggttcattagatgcaacattaaatatattttgataatatgtctgtttagttttataaaatgttgctatatttttctttaaacatgatcaaacttaaagaagtttgattagaaaaaaaaatcgaaacgagttataatataaaacgggggagtaggcacatgaatactagccgaggcggatcaatgttacgttgacaattcaagagatggtgaatgaccatgcatgagattgaattagctgcaaattaagctaaagggacacacttggttaagggtatgtcttcacataacgtgttgtagaagtgattagagcctttgatgttcagggacgaatatactccctccttccctaaatgtttgtcaccgttgacttttttaaacatgtttgaccgttcgttttattcaaaaacttttgtgatatgtgtaaaactatatgtatacataaaagtatatttaacaataaatcaaatgatagaaaatgaattaacaattacttaaattttttgaataagacgaacggtcaaacattttttaaaaagtcaacggcgtcaaatattttaggatggaggtagtatatagctagtctgttgcaagtcaataccctcggagaaactgccttggatgaaattccttccttccctataaattattacaccaaactatacagataacataggcagtgacacgaatcatggcatatccgaagcataactcgcaattagtccgcgacaccgaccaatacgcaaataatctaaattcttacgagtacgtgacatgggatcagcggatatatcatatatgaaccggctaattaatctaaaactctaaacttcataactctcttttctttccccaagactaacgcaaaatcatatacacacgcaaaatttaggaggaaattgaacctatcgatttattttggccgtcgaatgcatgctgagattatggatacgcgctgaaagcctgtttggcacagctccaacttcagttccacctctcctcaagctggagctcagccaaacagtttcagctccatctaaaattagtgtggagctgggtggagctctctcacaaaatgaacgagaggtggatttaggtttaaatagcttcacaactccactccagacttaactcttgcagctaaatttaagagttggagctttaccaaacagaccctatgattcgtgtaagttgtaagggagaaaaatcgcgtgcgggggatgactataaaatgcccttgctccagagcgagcaaattaagcaaaagaacttggtgggcacctagcactagcagcgactgtggtatatatgggaggaggaggcggcggcggcggcgcagcctggctggcgtggctgctcgtcgtcgtcgcggccatcgccgccgtggggcacggcggcggcgtgcagccgctgtcgcgggtggccatccaccgcgcgcgcgtcgcgctcgacgcgtccgccgccgtgcgggcgtcgccgtcgctcctcggcgcgcaggtacgtacgtgagcgtgcgcgtcctttaatccagcttttgctgtgcgccctccgttcctgccgctctctgcgttctctgcaacgcacggcaaagctactacctccgtctcaaaataagtgatgtcataagtatccgtctcaaaataagtgatgtcgtaagtatctgtgttcaacgtttaaccgtttattttatttaaaaaaattaaaaaaaatagtcacacataaaatactatttatgttttaccatctaataataaaaaaataatcataaaatttttttaaataaaatgaacggtcaaacgtttgttttgaaacgagtgaagtactcgaccacactacgcagtagcaacattgcgcgtacctaattaggtatactcgctccattacatcttacaagtagctttaaccttttctactcaaactttttttgagtttgatagtatcactagaaacatttagctacatttataacatcaaatttaaattagttttattaaatttaacatttaatatattgtgataatatttttgtctttgttgctataactttgtataaatttgatcaaactttaaaaaaattgattagaaaaagttaaaataacttataatgttaaatggagagagtttgcattagcttctcagttggctactaccccgtatttcgtaagtgcattatccaaaccattaagttatatttttttaaaaaaaacttttgtacgtaattttttattaaattatgtttaatttataataattaatattcaattaatcgttgggtaataactgttcgtacgtaccaaggaaaagccatccattccgttgtatcaaaccgagcctagcagtgtttgaggaaaaagaaatgagaagatattcaaaacgagataaacaattagcacatgatattttaaacttgaaaaataattactatgaactatttaaacaagtttcctatatttttttaaatttaaaagacatattcctccatctcaaaataagtgcagccgtatgattcaaatttgaactacagcgttacacttattttcgaacgaaaggtgtatcgtttaacagttttaaaaacatgcactactgtaaccactcatctgaaacgcagccttagcgacaccacacaagccaagcctggtttagttcccaacgttttcttttcaaacttctaacttttccatcacatcaaaaattttatacacacataaactttcaacttttccgtcacatcattctaatttcaattaaacttcaaattttggcgtgaactaaacacacccgagcgatttacttcaaattttagaggatcagatccgacgaaattcaaactaatcaaatgaaagtgtaaaaatccttcatcacaagtaatgcgaataaaaatagtgaccggtcaaacaataccgcgcgtcgagtcaactcccggccccaaaacttatcaatctgtccccgcgcatgtgaactcaaacccatccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaatggcgatgccgctgggtgggattctcctcctcttcctcgtgctcctcgccgccgccgcggcgggcggcggcggcggcgtgtgggcgttctcctcgtcgtcgtcgtcgtcgtcgtattccaggatcggcgagcagccgctgtcgctgatcggcatccaccgcgcgacggtcggcatcgacgccgcggcttccgtgcaagcgtcgcctcggcttctcggtgtcaaggtaggtacacactcgtctcttcgccctgctcgccggaatcccgagctccggcggtggttcgccggccggtttcgtcttagctcagctcgccgttgtgtttggcgcggcgaggagagacgacgacgtgtttgcgcgatgaaccgtacaaaatttggatagataagccaatcgccgtcgccgttgcagttcggaacgaaatcaaatttctcaatatctcaaacatctcctaatgatatcaatcgttcttcctctcgccagattggattttcttttttttttaaaaaaaatggagaagatgattacatcactagcctctgcatgagtcatgaacaaaagctggggatcggggccctgtttagattccaacatttttcttcaaacttctaacttttctattacatcgaactttcctacacacataaattttcaactttccgtcacatcgtccaatttcttcaaaattccaattttagtagtgatgccatgtttttagtggcgaaatgtaccatggatattcttcgaaattgattgattgattgattggtggatgggtttgagtgtattgcccatgcttgtgctagattgctagtgtggtcacaggccacatggaattgcttcccacgcctgatagggtcaaatggtatttgcttcgactttccatttgtcagtgtacggttttgatgcactacgatctgcatgattgatcccatttcgtttttatcttaaattattgttgctcctattggtattcgatgtgatcgaatcaagatttgtctcctcgtaaaaagaaaatcaggatttctttgacccatttccattgtttatctgacactgttgtggatacagggggaagatactgcctgggtaactgttgatttcgcagctccgcatgcgagtgacggcgattggatcggagtattctctccttcaaatttcaagtatgaaacaagtatatttgccatggatttcaaaatttgaatagtgagaccatgtgatgtgagtttgtagattacaatcacaatgaccatgatctgatgaactcttgcactttcctgcagcgcgtccacatgccccggtccttctggatcagactcaggacctgttatatgctctgcaccaataaaggtttgtaggaataatagcatcatgtttgtaaaagttctgcaaatgaactcctaaactgattttttttgtatgtctggtttcagtatcagcttgcaaattattcttcagattatggcaagacaggaaaaggcactctcaagtttcagttgatcaatcagaggcaggacttctcctttgcactgttcactggtggtctctcaaatgtgagttcaaaacatcacattgtaatttttttttagataattcacattgtaattttatccagtccttattactaaagaaatggcaactgacttaatgtatttcatttccagccaaagcttatcgcagtatcaaataagatcgccttcgcaaacccgaaagctccggtttaccctcgtctagctcaaggcaaatcctggaatgaggtgaattatcttcttctctctgactcacatttgcaaatcatcctcttctctctgactcacatttgcaaatctagatatacagatctaatatgagatgcatcctagcttaaaacgtcaaatctctgaagaatttgttgctttgtcttgctagatgactgtcacatggactagtggttatgacatcaaagaggcatatccctttgttgaatggggcatgaaatggagccctcctacgcgcacagcagctggcaccgtcacttttgatcgcgaaagcttatgcggtatggaccgtataaaagatcccttttatgcattatcttctgtatatgcatataatagcatgaaatttgtgaggagcttgcaaaaatgtcaaaattacacaatcctagatgtccaatcttgatgccctgatgtggtttaaattgtctgaagttagtacattgtgttcctcacagtagtttttgcttgtgcaggagaacctgcccgtactgttggttggagagatccaggtttcatacacacagcattcctgactgatttatggccaaataaagagtaaattacttcctatggctctatcaacattttttttcaattgtgaatactggtcttctgactatgccatttttcctgctagatactattacaagattggacatatgctacctgatggaaaaattgtatggggcaaattttactccttcaaagcacctccttttcctgggcaaaagtcactgcagagggttgtcatttttggtgatatgggaaaggtaaaatatacaccagcgcaaaatgtatcgatagttttagtactctctccttcaaaaataattactccctctggtcaaaaatatttatcgtttgggacaagatttagttaaacttttaagttcactgcttagctcagtcctgaagcaaaactacctcatgtttcttctgaattcacatggttttatcacttgcaggccgagagggatggaagcaacgagtacagcaactaccagcctggatcactgaacacaactgacacactgatcaaggaccttgacaacatcgacattgtatttcacatcggtgacattacctatgccaacgggtacatttcccagtgggatcagttcactcagcaagtcgagccgatcactgctcgagtcccctacatgattgcaaggtctttcttgatgaacatctttggtttattaaatctccaagccggttaactaattctatgataattactaacatgtttgatacgattggtttgattcagtggaaaccatgaacgggattggccaaacagtggatctttcttcaatgggacagattctggaggggagtgtggggtgcttgctgagaccatgtactacacacccacagagaacagggcaaactactggtaagtctcagactctctctgtatatataatcaactcaaatttcaatttccatttttttaaaaaaaaattgaatacgtttgtactgaattttgaatatttttttctaaattttagttggaggcacattcttagtttataaaaccaacagaaaaggcatttttgtttttgaaaaccggatgtttcgagtaaggtcgagatcacaaactggctcggtgatgctcaaaaagttcaaactaaatctgaattttgttggcaaaatttggtcaaatttcatcggtagtcaacggatttcatgaaaaaaaaataggggaaaccgtttcagaaagcagttcagttttgcggactctgcacgtcctactgggatccaccgacctgaaattttcattccgaaattgtgaaccctgctgtcaactggttgccattgtagaccggaatgcctgaattttgaacaaacaatcttttattttttttgctaaaatttaaaatattcgaaatttgttctgaactttgttgggcaggtacaagacggactacgggatgttcagattctgcgtggcggacagcgagcacgactggcgggaaggcacggagcagtacgcgttcatcgagagctgcctcgccacggtggaccggaagaagcagccatggctggtgttcatcgcgcaccgcgtcctcggctactcctcgggcttcttctacggcgccggcggcgccttcgcggagccgacggcaaggcagagcctccagaggctatggcagcggcaccgcgtcgacctcgccttctacggccacgtccacaactacgagcggacgtgcccggtctacgacgggcggtgcgcgtcgccggagaggtcgcgctactccggcgcggtgggcggcaccatccacgcggtggtcggcggcggcggcagccacctgagcaacttcaccgccgaggcgccgccgtggagcgtgtacagggagatggactacggcttcgtcaagctcacggcgttcaactacacgtcgctgctctacgagtacaggcggtccagcgacggcgaggtgcacgacagcttcaccgtccaccgggagtaccgcgacgtgctcgcctgcgtcgccgacagctgcccgccgaccatcccgccggcgacgtgatccagctccggtgattccgccggcgagtctgccggcgacgtgtgcactattgctgcttggtggtgcttgcgggcctcgtctgtaatcttgacttgtcaatcgtgtgtaaattgaattgcgaaatatttcgaaattaagtcaaataaagaaatgttacaaaattatgtgttttaaatccttaattactcctcgtctgaaaattaaacaagttattttcaaatttgaatgcaaacgaagcagatccccacctctccgggcttgatccgcaccgcacaatgtggatcggacggttcatggccctcaagggggttcggcgaataaatctccgaacccctcctcgcctcgactcgtactggttttggttggatcggggcaagaggaattcacaacccagtgaactataattaaaatatttagaaatatatatatatatatatatatatatatatatatatatatataatcaaacaattaaatccttaattacctcgtagaattcacaactcagtcagctaattcattataatatgaacagttttcctactgatctactccatgttcatgtgaaattcaaatttttaatttgaatttggtgaggcgacgattagttagttggccaaggtgtgggggtcgcaggcgtcgacggcgcaggcgagcacgtccttgtagcccctggtgatggagaacgcgtcgagcacctcgccgtcgtcgctgcggatgaactcgagctccagccgcgagtggtcgcgcgccgtgagcttcacgtacccgtagctctcgctcctcgccgcgctccactgcggccactcgccgccggcgtaccccctcagcctggcgccgcccgtgccggccacgacgtggatcgtgccgcccagcgcgccggtgtacgccgccgccggcgagctcccgttcccgccgccccccgccgccgccggcgccgccgtgcaggtgttctcgtagaccgggcacgtccgctcgtagttgtggacgtggccgtagacggcgaggtcgacgcggtgcttctgccacagcggctgcagcgtccgccccatgggctccgagaaggagccctccctggcgtagtactcgttcgacgagtagccgagcgggcggtgcgcggcgaacaccagccacggctggtgcttacggtccgccgccgcgaagcaaccgtccaggaacgcgtgctgcgccgtgccggggcgccagtcgtgctccgtgtcgccgacgcagaagcggaacatgccgtggtcggcggcgtaccagggcttgccgcggttcgccgccgccggcgcgcggaagtaggtctccgcggggacgccgcactcgccgtgcgagtcgtcgccgccgtagaagccgccggtgtcccgggacgtgcgctcgtggttgccgctcgccaccatgtagggcacccgggaggcgaccggcgagatctgcgccgtgaactggtcccactgcgccaggaagccattggcgtaggagaggtcgccgatgtggaagacggcgtcgtagttgggcaggtccttgatcagccgctccgtcgtcacctgcgcccccggctgaaatccggcgagctcattgctcccatcactttgcccctgtcccaacaaaaaaaaaaaaactcagccaatacactccaaattcaaatttacacaaaaaaaaacatgtatagacagtatattttaaatttaaacagaaactcttagccactacgtattaaatttaaatttaaatttaaacagaaactcttagcttctacacttcaaatttaaatttaaaaaggaactcttagatactacactttaggtttaaatttaaagttagacaccaaggaatgacttagtgtcaatggttttaatggtttcaaggagaagcaaatattcctagtgagcgtgctcaacaagaatcgaatcaatggtttttcttccttgttttttttatctttattttcttccttccttggcataggccggtctggctgagtgcgtcatgtaacaaaaactatattcttctaatatattgacgtgcaatccttttgcgcgttcgcaaaaaaaaaaggtgcatgccggcaactcctgccacaacgctatgagcgcatctcagaattaaatttaaacagaaactcttagctgctacactttaaatttaaaatttaaagcatattacaagtctacaacatatggaaacagatcagcacgcattttcaaataaaatgtgaacattgtcatcagaatgtgcacaagtttgatgaaattcttacgagtcccatgtctccgaaaatgacaattcgctggagtgaagcttgtccaggggaaggtgatgcacggaaggtggacgacttgccccatactatagttccgtctagtagctcgtgcccaatctgataagaatacctaaaacaaaagcatgaaaattacatgaatattgtaaattaaaattgttgctgagaagctcaatgcatgttctctcagtgttcttactccctgtttggccacaagttcttcaggaaagctgtgtggatgaagcctgggtctctgtaaccttctgcattagctggtttacctgaaaatttttccagcaaaacagagtcaacttacctgtaattctgaattgagcttttgtactatatgtaaaagttttttttaacatgatttggatgttttttcagtaagttgctctgaactttaccacacaaatggtttcttgtgaaggtgagggtgtcggccggcgaccgtctagctctagcattctccttctcgttcattgtccactccacaaaggggtaagcttcatcaacgttgtaaccacttgtccatgtcacagccatctgttatgaacaccaattacatcaagaaaccaactaaaaatttatgcaaattatgcaaactcacctcattccatccttttccttgtgagagacgagggaagactggagctttcgggttggcgaaagagatcttgtttgaaactgcaacgagtttaggctgcaaaagaatcatacaattagctacattatcctagctcctagctgctgtttttcagcaaagaagatcaaatcctaatcatagttccaatgttctaaagtcatgcagtgtaaatctgaactcacattgtccttgccaccggagaacagcccgaaagcataatcgtagcgctggttgatcagaagaaagctggtgtcgccgctgccggagctcatgaaactcggcgagatgttagcaaacttgtactgatgaaacagacaacaaaaacaatcaaaacaatcaatgtcatccagccattgagatgtacacacaatctgtatcagaatatacatcttgtttttcttcccccctactactccctccgggttgataatatttatcgttttggacaagagcacggtcttcgaaaaataactttgaccattatttttaattataatatgtataaaagtgttaacaaatatatgattttattacagtatttttaggactaatctatatatgtagtcaccatatttaaaagacaaatatattaaaaatgattcataataaaaaattataaagtttgacctcacctttaaatatattaaaaatgattcataattaaagattctaaagtttgatctcgcccatgtctaaaagggccagtattatcatgccggagcaagtaatcaccaaccttgatgggagcgatgggtaatccagcaggtgcttcatcttcacctgctgcattgattctgctactgctctgcttccctcccatgatcaaactgcagcatcacacacagagtggaggggtcgtcagattggattaggaaatttgaagctaacaatgttcagttgatcgatcttgatcttgagatggataacgagtttactcgaaatcggcaggggagaagagcgcgatccagtgcccgtcggtgggcgccggcgtcgtgaagttgacggtgtcccagaccgaatcctcgccctgccggccgccgcgagaagaaaaacaggtgagattcagagatctcataagcttgcattgcgcgaggctgtgtgatactcacgttggtgccgaggagctccggcgaggcgcggatggcggagccggcgtccatggcgacgcgcgcggcggccatgttgagcgtcaagagcggctggatgttgtccagcgtcgcagacgtcgagttcaccgccgccgccgccgcggggctcaccagcaagaagtcagcgtcgccgccggcgagaagaagcgccgcctggagcacgccgcgcgcggcgcccatcgtcctctctgctcgccggcgaacacacggcgaggcttgaagaagaaaactatggcggggaggaggaggaggttgaaggctttgcaggtcacgaatttatagggattttgctaaaagtttgcatgaaattcgtgtcgttagtcgttaggcatctggttattctggttagtttcgtttgaaattttatcccgaactaacgacgcagataatctacgtgattttctcaaggctttgctataaaatctgaaacgtctctcctacctcgatcttgaccgcacgatttagatcggacggtaatgtaggcccagttctgggttacctatcctccgaggggcaaatggtaatattcaacaattctagggtcctatatgcaaatgtcgcgacgccctttctcccgcgccgatctgcaccgtgcaagatggatctgacggctgtaagcctatgttaggggtacggagaataaatctccgaactcctccttatcctactccctccgacaaaaaaaagataaacatgggtttccgtgtccaacatttgactatcccgtaattagtattttcattattgttagatgataaaacatgattaatattttatgcgtgacttatctttttattttttttcataatttttttaaataagacggacggtaaaatgttggacatggaaaccaagatttgtcttttttttgacggagggagtacggcgcaaaagctc

SEQ ID NO: 81083 - DNA, 3785 bp, Oryza sativa
tttgttagatggacgtgttgctatttatttcaacttgtagcccgaattggctaattcatcgaaggtcacgattttttttctctctaaacaattccagcaagaccactcccatttttaaaggaatagaaccaattccatcatgatcatcagttcatcacaatgcacttgaaatcaaggaaaggttcatcaccgttctaaccatctgaaaattctagacacaatttaaagaacaacagaacaccgaccaaccgtcaacataattgtagatctaaattaaaaaaaattatgaagctaaaattactcaacttctagaaatcttggaactggagttgtgctaaagagagcagcctaaccagctccagcctcaagttgtcggcatggccgtccatctccaccgccgcgcgagcgaacggacggctggatctcccgccacggcaagaaacaagcggctccgcctatcactggcacatggagccctccttgccaagctggatggaaaacggtggaaccactcttccagcagcaacgcagttgcagcaagcaacagcaagaaacgggcaagtccgcaatccggcgtgtgcgcttaccatttgcgccgcccatcgcgtccagctagcgcctggcgcggctgcagatgcagctgctgagctgcaggtgcatgcacctttcccacccccacctccctctctccccttcgtcttcctctatagcccgcgccgcgcctccctgtccccgagtccgaagcccgaatccgaagcgaagtgaccgcaagagctcacccccgagtccccccctcgccggatcgcgcgggccgcctacctcctcccgtcgcaccagctaccgcggtgagttgctcccctctcgatctctgctctgttaggttcggttggttcgtggccgtgctggctgcggcagtgttggggaaggacggggggttttgggggctagtttacgattcgattttccctctgctgtgtttgtgtttttcttttccccagcgaggatgaaactattacatatgactatgtggttatgtggtatcgaagcagatcgaataattgatccggaatgtataggagtagtacttttgttcgaatcgacataggcgtttactagtttgtgcggttgggtacaaacaaattttgtaagaggaagcttaatagtgtacccaactactagcttcaattcatctatagccaatcaaatacatcattcatacaatagttacatactacactattaatacttggtcccacctgtcatacacacacttcgtcttggagtccgtgctacactgccattctttctccttatttttcttcttaaaatatgtttgcagctagcttatagcctgctattgtacataatctaatggctaataaggttctcgccgcggcggtaactctgccccttgcgtgagctgagctcagaagatgatgtcaccaagtgcactaatgactcatgtattcttgatgatctttgttgaagtagtttactatttggggtagtataaagtctaaaactgccatttggtgctaatcagggccgttgtagctgtttcttttttcattttgatgccttgatgctctccttgagaattaagatactacaataattgtactagccaaaaagggattaggagtttgaaagatgatgaactggggaaggactaaagtttgtaatgaatggccgcataggtaatgatttgatctgtggagaatttgtaaaggaagttaacaaagtttgttctattcaagaaattgttttgctctcatctctttttccatattcaacatcttttattagattttattgtgacatgacattttgtttgtgtatttgtcataacagaggtaccaaactggatatatgattgagtcttcatctattactttttgtcctgaagtatgggggcctaaatttttgtcattaatttcagggaatgcgaagatcttgcgatggaagctagtcaaatctgatttcgtttaagtacaagtaacaacaatggcaccaaacaaaatttcctcaatggatgctggagcagcttttgatgacgaagatgctagttccagcaattcactgcaggagttgtggccagttggcgagatagatcctaagagagcaagatttccttgttgcattgtttggactcctcttcctattgtctcgtggcttgctccttacatagggcatgctggaatctgtcgagaggatgggactgtcttggattttgctggttcaaatctggtgagcatggataattttgcatatggttctattgcgagatatctccagcttgacagaaagaaggtatgcatgattcgaatatttttcatttcttcatttggaatggtgtacataattcaacctacttgatagtagtttattcatccaaaatggcaaccctcatagctataggatccatgaaaacccttgttgacttaaaaaaaacacactactagtatgttattttgacatttacttcctgtgtcaatagcttcaaaatgatttgtgctgctgttgcaagaaaacaatctgaacttcctctctacttaagttgcttgaaacaaaattttcatgatcttactgttctttaaagagaacattttccaagctaattcctaaatatagaaatctttaaacagtgggctatttaagtaatgataaaacatattttaaaatttccatgcttgagaaaaaagtgaaagaaatataaaaattatgagttggggacactgaacctggggcttcagccagtgccaggtatcacggactgatcatgacagtacatggctagaacaagggcaattgggcaaaggctgaatattactagcgtttgctcatgaaaatctgttgatcaattccaatatttatttaatgatagcagtgttagtgtgttatttacaaataacttgtcaaaaacgtcaaatatgtgctgaagttgcataagatgtttttgtatcatcttaatccatagataaacttcttgtcaattgtcatttcattaaaaaaaatagtagtgtcatttcaaataggttagttttcttgacactctgtatgttctttttttctcttgactagtgttgctttcctgttaatctcgcgacacatgtatgtgagcggtcctacaagcatgcagaagcaggaacggcgatttcctgggacgacgctctgcaactgggcatgagaagtttcgggcacaagttctataatctgtttacctgcaattgctactcatttgtggcaaactgcttgaatcggcttgcctacaatggctccgtgaagtggaatgtgttgaatgtggctgctcttgtttggttgcgtggccaatgggtggataaaatgtctgttgttcgttcaatctttccttttctaactgtgacatgcgttggcattttaatggctggctggcctttcctaatagggatggcagccttctcttctctcttgattggatggtttgtatttgctgtatgctgcatgaaggatctagtgtgctgactcttttaaagaacattggcactgaatcctgtgatgaaattatggagacgagaccacaagaagacttcagctgcagaaatgagtatcactttctccacatggatgtattcactggcgactgagatcacctttcttgaagaggaagacactctggttaccatacgacatacgcaagtggctcacaatgttatgagtgtaccaatgtttttggtgatcgtagatctagttggttgcatcttgccattggtgcactctccctgttcttattagggtttttttttttt

SEQ ID NO: 81084 - DNA, 682 bp, Oryza sativa
tagcacacagtgtttgattgtgtcaaggatgattaactaggatgaatccatgacttgtgtttttacctttgcttttaactgaatgcactttgtttttttctcggatgccaatagcatcgggtgtaacatatattggtattattcagatgatgctaacgctctagacgatactggaaatgaattgtggcctggtcaatctctcgatgtctcttctcgttttttaatcgattggaaactgccttgctcctcggcaaggtcgctgcttggaggccagccaggccgtgatgcctaattgagcttggctagatcaacatccaactgtgcctggatagacacgcattcgccggtgtccatgacgcaggcaccaccggcgaggccctgcgtgcctctgtgtgggtgattcgagatgccgccggcatccattcctacagcatggtggagattggtgatcgatttgggaaaaatgttgaataagagaagaggaaagccaagtgaggtgttacctctaaatttaggtggaggggtgtgggcggtttcgtgcaaaaatatgccaacctcagtttgtatccgttggattggaatcggagggcctacaatgactgagtgcataagtgcattagaggtagcgtgtggataggatacgttgccctatacattgccctattagagtagcattggtggt

SEQ ID NO: 81085 - DNA, 672 bp, Oryza sativa
tttgcatagttatcaattttcactacctgcagcttaatgggatgttgcggaccaagagacttccagaaccctgctccctccgtcctccatatcccctcctagggggacttcttcctctgccaccatagcccctcctagggggactgcgatatggtgggctgtacctcctcattgttttgtctgaagcacataacagaaaatgttaacagaaagaagacggatggaacaaaatgagagaaattagcgaatcaattagcgtataggcacaagatttagaaaattactgcccttgaaagtgttaagtgtagagtcaaagagaaaagcggaaatataatcagaaaatatgttgggccaactattgcaagcataagactacattgcagagcttttcaagtccagaaaaaaaaaactacgtcaattaaaatcttactttaacacaccgcacagtttatatacattcaggtcatcagatatgcgtaaagcaagttcctcatgcattgcaaaactaaccaaagtttacaatcatagtagtagcatgccaaattgccaaacacgattttcatgccatgacattcccgtactactttatccataggaaaaaacaatacaatatatctaggagtaagagaatgatcgatatattagataaaaaaaatattcccctcccaacgg

SEQ ID NO: 81086 - DNA, 2876 bp, Oryza sativa
catcgtaaagcagagcagctgcagatcatcctgtggtgccatccgatccatgttggtgttgatgctgtgatgctgttgaaggcttttccatcttttgccgcgttgccaaaattttgaattttgaaacctgattctttttttttaacaaagtttgtttttcagcatttggcttttaaatcgctaagtacgtaactagaagtttatcatatttttttcctaattaagccagtattaggacaaccaatgtttccaaaatactataaggaagtgaatgatttaaattttaaattcttcctcgcaaaatagtacaatagtttatagtatacttgtttgattaatcatctctcttttattgtcttaatccaagtaccctccaccccttctccatggctcctccttaatctcttctcattatattatgggggtggtgccatggagacagtaactagaattggacgatgcgtctgaacagaactctgaaataaagcaatttttttttcatatagtatagttggtccgattacaaaaaatatgtagttcaaactttaaaactatagtgagatacataaatttgttcatgtctaattttaagatttaatttgagtaatttttttaagggactctagttgacaaacagctgatttctcttatactcccaccgtcccaaaataagtgtagttttgcactatttacgttcaacgtttgaccgttcgtcttatttaaaatttttttatgattagtatttttattgcattagatgataaaacatgaatagtactttatgtgtgactaaatattttcaattttttcacaaattttttaaataagacggacggttaaacgttcggcacggatatccacggctgcacttattttgggacggaggtagtaggtttcagcagtttttcttgaccgtacgatacccacgtgtcgcccatcgctcttgtcacgggcctgttcagaatctcgttttgttggttgtagtagaccttgctacttttgtggcccacaagccacagtccagaaaaggaatgactttatgccgactttgtataacatccctaatctaatattagaaatctttaccccttaattatatacccgtcacaagtacaagtagaatgcatgtcaatgagggtagaaacgccatatcgtgtgcctggctaggataagacggacggaaaacgatcgagaattgacggaagtgttaaaaatgggaacggggtgaactttgggtgctattaaagtgaaccggtatctttcggtgctataaatcaaaaaacgtgaactttcgatactatataaccaattttgccttattatataataaaaccgtataatttgggtctctgttttcgttgagtcagcaaaataaaaaaacaaaaagattatgaggcctacatgtaaatgaggtggatggtgggagatgggggaagagaagaggtggcggcggcgatggtcccatcctcctaggtcgaccgcgactccgcgagaatggtagatcggcagcagcacgcgcacatccgacacagcgccatgggtaagctcccgcggcggcggactcgtcgtctacgacactgctctggcgggtgcaaacgcacgcgcccggcccaactccacccaggtcgttggcttccaactccacccaggtcgttggcttcctcacgctcaccgtcctcctgctcccgaccaggctcacgctcaccagcaccgtcgtcgtgctctgcccatcgtgctgctcactagccccatctgggtgcatgtcgccatcgtcgttgcagacgaggcagcaacaaccttccatagtttcatggtcaaaaaagaagcactgaagacatcgttgccaaggccaatcatctgcttcagcgatcgatgtgtaagcacatcattgacagttcgacagttcgtaatcaaacttgagcagtaattgaaacaatttcagccaaaaaaaagaagaaaaaaagagttcgagcagaaaacggactctgtttctgacgttctgcaatctgcattggtggccgggtgaagatctacagcggctgccagggatagtacaggttgggcccggagggcgcactgcgtgtgccatcggaggcggcggcggtggaggcgttctgtggcggaccgtgcctggtgcttggctgcgtcgatgccatcatggacagcttccgcctcacgctcgaccttggttgtggggacaccggtaatcccatgtgttatacagtaccacttcctggatcagtaggtggtacacacatagcacagtataatattataactgacatcgtttaccggtgtttctataataataatacaagggtaaccttattgggtcccgaaatagaccaagcatgatcacttacaatacaaaataccaaagcaatagatagaacagcggaagcgaagcaacggcggtccatcgaactccacaagcaacgactggtgaacctatggtccctaatccatcatcttcaacacgttcttgacagcagcatggcataaatctaatcgacgccaacttctttctaaaagatttaattaagcaagagttagtacatacgtactcagcaagccaccactacaaaatgaatctaatgcacacagggttcaaggatggcttagtttatttgcataaggctagttttcacgattcatttcacaagcctattggcatagcagttttaactgaaaaacaacgttattgttgaagttgtaattatttaggtttcatccacctctccaagccctgcttagttcggtttaccctcatatttcgtcttattaactctactatactgaccttcccactctatgggcaaggttcacatgtctctcataactactctaagcagtattcaaatctataagtctagtca

SEQ ID NO: 81087 - DNA, 26838 bp, Oryza sativa
ccacatgtatgacaaggatatctatgatagagttttgggatggtaggtatttttcttcttctcaattgtttgatttcaaaaaagaactgccttgctctctgttatatttgcattatttgttctgcaggattgatgaaatattggagaactatgaactccttgagttccctaaaaggtacgtattcaatactactagactactctacacactattgtgctttggtcttaaaaataataaaatggtagactggtgctgatctaagggaacacatcctatgcacacaaggctttttcgtgtacacaccaactaacaaatatcacaaaaattctggaaaaaaatgtacatgaactttaagtcgtattatatatatgtgtaaaatctcaacttcaaattcattatatatagggggtaacaaaaaagacaattctggcatatttactcttaaaactgtcagagtttttatcttatttgttacgtctaaaatgtattgaatttaaagttaagactttacatataagtgtaacactaatggaaatacatatgtacaatgttttctaggatttttggtctaatttgttagttggtgtgcacggtgtgtatacggaaatcttatgtgcacaggatatgttccattgatctaacatcatcaatatatttcttttagttgttcaaatctaaatattctgctagttaaggaaaatacttgtgaaacatgtaattgaaagcgaagcttctcaagtaagaaaaaactttaattacgttcattaactggtattctccaaaagtttttctaacataaggcgcttgtgttccagctatgaaaatcaagacctcaaaactactgaacggtatgaccttaaggctaaactcattctccttttgctttctttgtgtatattcttcattgttgggcttgcgctttcttctctctacctttacacaacctgttatcaaacttaaggggcagtttggcagagctccacctccacctctcctagagctggagcccaacctaacagtttcagctccacccaaaaagggagtgaagttgctggagtgctctcacaaaatgaactagagagttagagttggagtggggttcaggctgctccgcaactatactccaaacccaactctgagttaaatttaagagttggatccctgccaaacgggccctcactatattatttctgctcttgctcaatcattaatgacatgtacacccatggattaacctctgaagaacactggaacagtaggtcataaagataggaatgaaatggcacagtaaatcctttgttttctggaatagatttgctgcagtagccacaagttgggtgattcattttgatgttgccgctagctgtgtcattttcttagactattttggataagttggcaaagcattagtgcaatgctatatgtgaggtaaagactacaaataatgaatgctcgagtcttttgtgaacagaatgccattcgaaggtagcaatgagccaatgattgtgatggattttatctgtgattattactgaaattatctttaatgttttttatgagccatcaaaatttaatgcagtcattttaaggccatactactctttcatgtcttgtatttcttgttattactgtgatactgaactaacattgtcgcctacataaacaaggaaataacaagagaacaatacactcgtgcatattaaataaagtgtttagtgttcatatgtcagctcggcatcaacatgttaggcctagccagtagagataatatgtacttaaaacaactataaggttactttccaggtttcactggcaactataagcttatttccagttttcactgaatgaagcctttgcttggtccttatatatgaacttgtctgttcagtgcattcatgaaactttgtgattcattagtgacttactgatacatatgtgaccatgtgcgctggatatgaaggttcattccaagcactagtcatatgtaaaaaaaaggtgcaatatgcacctgataattgtagtgctgtgtatgtacatttaatctaacatagttagtagttcattagagtaattagagtggttcatgatattagttcattagttactctaaacatagttatatgatgtgatctttcttgtgatttctgttgtgttacacagttacggcatagattttcctgctataactccaacaggtcacgatgatgccttccccgatcctcacaggttcgtctccaatcacctaaagtataggtaaatcatactcacatagttaatagtttctgtttttgtatgcagtggtattggtggtggcagcagccagcatgttggtaatatgacacccatggaactctcaaaaatatttctttttatgtttctgcatctctacagtcttgttttaccacttatttatacaacagatccaaatgatccaagcttctttccttctaatcccttgcatgtacccttaagtggcacagggtaatccactttttctttttattatcttgtcattttagtacacatgaggtcatttttacttatgaatggactttaatatttgaaaataggagtgctccaccgagtggtcattataatccaattggtccaccagatgtgccagggcttgagccttcttgctctgcgaggtaatatagttgttgaggaacagtatttatacacaatattcttagcaaatctgtaagttccaagattgccagatactgtacttggctgcgtttaaaacccatgaccaacaaatcaaccttctttttcatatacttcaatttctggcccaacctcctgtttccttagcaaaggactatttatatctcacctcctgttgtaacaatatagtaataatgttggattagcactatcctacataattcttatattcccttggcattacaaagctctaaaagagtgtccatttacatctagttaaaactgtcaaaatgattttgggtgataccattttgattgggagttgctcatcctctgatcaacaggcaatgctaacctaatatagatttttctttacatgcaggcgtccaaagcaggaggccccccttcaaaggccaccttcctaatcgtatttgaagcacttcgaactgctagattgcaaatagcttatcagacattgcctgtaaaaacgtatgcaaactcctgtatttatcatacccttgcacaccatatgctcgatcacagtttacacacatatgcaatcgtatcaacctatttccgttacccttgcacacctaatagcgacctgtgggatggaatgtaaagcacctctcgcagtcgttcgaaggtgcatcatcgtaaagcagagcagctgcagatcatcctgtggtgccatccgatccatgttggtgttgatgctgtgatgctgttgaaggcttttccatcttttgccgcgttgccaaaattttgaattttgaaacctgattcctttttttttgaacaaagtttgtttttcagcatttggcttttaaatcgctaagtacgtaactagaagtttatcatatttttttcctaattaagccagtattaggacaaccaatgtttccaaaatactataaggaagtgaatgatttaaattttaaattcttcctcgcaaaatagtacaatagtttatagtatacttgtttgattaatcatctctcttttattgtcttaatccaagtaccctccaccccttctccatggctccttaatctcttctcattatattatgggggtggtgccatggagacagtaactagaattggacgatgcgtctgaacgcgcctgaactctgaaataaagcaattttttttttcatatagtatagttggtccgattacaaaaaatatgtagttcaaactttaaaactatagtgagatacataaatttgttcatgtctaattttaagatttaatttgagtaattttttttaagggactctagttgacaaacaactgatttctcttatactcccaccgtcccaaaataagtgtagttttgcactatttacgttcaacgtttgaccgttcatcttatttaaattttttttatgattagtatttttatcgcattagatgataaaacatgaatagtactttatgtgtgactaaatattttcaattttttttacaaattttttaaataagacggacggttaaacgttcggcacggatatccacggctgcacttattttgggacggatgtagtaggtttcagcagtttttcttgaccgtacggtacccacgtgtcgcccatcgctcttgtcacgggcctgttcagaatctcgttttgttggttgtagtagaccttgctacttttgtggcccacaagccacagtccagaaaaggaatgactttatgccgactttgtataacatccctaatctaatattagaaatctttaccccttaattatatacccgtcacaagtacaagtagaatgcatgtcaatgagggtagaaacgccatatcgtgtgcctggctaggataagacggacggaaaacgatcgagaattgacggaagtgttaaaaatgggaacggggtgaactttgagtgttattaaagtgaaccggtatctttcggtgctataaatcaaaaaacgtgaactttcgatgctatataaccaattttgccttattatataataaaaccgtataatttgggtctctggttttgttgagtcagcaaaataaaaaaacaaaaagattatgaggcctacatgtaaatgaggtggatggtgggagatgggggaagagaagaggtggcggcggcgatggtcccatcctcctaggtcgaccgcgactccgcgagaatggtagatcggcagcagcacgcgcacgtccgacacagcgccatgggtaagctcccgcggcggcggactcgtcgtctacgacactgctctggcgggtgcaaacgcacgcgcccggcccaactccacccaggtcgttggcttcctcacgctcaccgtcctcctgctcccgaccaggctcacgctcaccagcaccgtcgtcgtgctctgcccatcgtgctgctcactagccccatctgggtgcatgtcgccatcgtcgttgcagacgaggcagcaacaaccttccatagtttcatggtcaaaaaagaagcactgaagacatcgttgccagggccaatcatctgcttcagcgatcgatgtgtaagcacatcattgacagttcgacagttcgtaatcaaacttgagcagtaattgaaacaatttcagccataaaaaagaagaaaaaaagagttcgagcagaaaacggactctgtttctgacgttctgcaatctgcattggtggccgggtgaagatctacagcggctgccagggatagtacaggttgggcccggagggcgcactgcgtgtgccatcggaggcggcggcggtggaggcgttctgtggcggaccgtgcctggtgcttggctgcgtcgatgccatcatggacagcttccgcctcacgctcgaccttggttgtggggacaccggtaatcccatgtgttatacagtaccacttcctggatcagtaggtggtacacacatagcacagtataatattataactgacatcgtttaccggtgtttctataataataatacaagggtaaccttattgggtcccgaaatagaccaagcatgatcacttacaatacaaaataccaaagcaatagatagaacagcggaagcgaagcaacggcggtccatcgaactccacaagcaacgactggtgaacctatggtccctaatccatcatcttcaacacgttcttgacagcagcatggcataaatctaatcgacgccaacttctttctaaaagatttacgtactcagcaagccaccactacaaaatgaatctaatgcacacagggttcaaggatggcttagtttatttgcataaggctagttttcacgattcatttcacaagcctattggcatagcagttttaactgaaaaacaacgttattgttgaagttgtaattatttaggtttcatccacctctccaagccctgcttagttcggtttaccctcatatttcgtcttattaactctactatactgaccttcccactctatgggcgaggttcacatgtctctcataactactctaagcagtattaaaatctataagtctagtcaagagtagtacaggtctcggcgctcattaaccgcgagcacagctattcgaatagatagatttactcacactgcagtggatgtacgcttttaatcccgcactccgtggcttgcccaacacataagcctagtcccaacatataagacttgccacggcacagcttttcagtcgctctcgcatttcggcacccgctccaaggactatgaacccccattgcgccccggcactcctaacccctctgccggatagtgaggggagtcctggcgctctagggaattggggatattatattatatatatagttatagggttcattttaagtttataccatggcctttacctttccgacactgcactcatcacaacacacttatacagaactaaccatgactgaggtgtcgccccacaagagcttcctaatccgctggtctatacccactgaagaaatgcggtcgtactctgttcgtttctcgtatagcttcctgactcggtccataactgactagggtcggcgactaaccgtttccagacccacccatattctattcatgccgccccagtcgaaatggttttgttgtattaagttttggttttcgcagaaggtttgtgtgtggcgggtggcactcatgtctccacccgcaaatcatcaatcactcacatcgagtgatctcacacccataatcatctagcataaatatagagtgtacgtatgtctataatagcatcgctaagcaatgtcaataaatgaccacacataaataaacgactcagctaatcaaaggtatacaacatgtataaaggtaatcaatatcaaatgtaggcataatcgagcatagatacgcactttataaatagcatgcaatttatttgtaaacaaaacatttataaatctaggatcaatatgttcaaggaagggagcgtagtgacttgccttgctataggttcctaatgtcttcgagatatccgcattagttagaatacccgcgatcgataaatatccgacacgtctgataaataaccgaagaatatccacgcataatcctaaaagaaataaaataaagcaacattcaatacaactaatggtgccaatttaatagatctcgaatttagagagattatggatgttggacggagtcaatcggggttatggtccaaaagatatgaatttccgaagttgaaaggttttataaaccgaggagggagtgctctcgggaagggaggtgatttagactttatgatagggctctgggctgaaatgaggatgtgtatggactttagtgtataggtaggccgatggtgggctctggaggataccaattagacttctgtaggtgaatgaatccctcgggttctgctagggggaaaagtacacgcaaggtccctcaacttgttagccatatacaaaatcgtcccttaaccgcaaaaccggacatccgacgtcccccaacttacaaaactggtcacaataggtccctcggcggttttcaccctggttttgtcccacgtggcggctgactcagcgtgggacccacgtggaccccacatgtcagtaagccacgttagcaccctatctctctttctctatttctctccttcctctcgctctttgctctcgcacaggcggcggcgcgcgcggccgaaaggtggtgcggctagcgacggcggctcccgggtggcggtgcgcgggctcagggcggtgcgagttcgccggcctccccgtccccctcgtgcggtcggcgatggcggcgcgcggctacggccatcataactgacgcggagagaagggccgatgcggcggcgtcaccgacgcggtggagaagagggtcggcacggccgacggggaagaatcggcggagaggaggagcggcggcaaagctggagccacacgcgcggccggcggaggcgcggggaggccggtgagctcctcccaagtccaaatccggcggcgaggcgggaggaacgcggtgacgatggcagggaggcacggggaggccagcgtcggcatcgaggcgggaggaatgcgtcggcgttggctcaggggagcaaggcggcggtggcggcggtgaggggagcaaggcggcggcgtcagcttcctctccgtgctcgccgacgagaaggagcggcgggcgaccgcagcggccaagctggtcggctgggcggtggcgacgaggcaggaggaacgcgtcggcgtcggcttggcggtggcggcgagacgggaagaatgcggcgacgacggcgacaccatgatggcgctcgaggaccgaagccgcgatgccctcgacggctgccacccgtgcccagctccttccccggtggctgaggctgggggagacgtcgacgccgtcttcctcggcttcatctacaaccacgcgccgctgccgcccttcacgccgcccgtcccatgccggtctgttggccgtcgcgaccgcgctgggctgccgccgcccttcccttctcccgtgtcgccaccgccgcgtcgccggtcggcggtcgtcggacctcctctcccgcctcaccccgacgacatccccacccaccgcccgggccgcccagcctgtcgagaggagataagtgagagagagaggaagggggaggaaagatagagagaggtgatgacatggcttactgacatgtggggcaaaaccggggtcaaaaccgccgagggaccttttgtgaccggttttgtaagttgggggacgccggatgtccggttttgcggttgagggacgattttgtatctggctaacaagttgagggaccttgcgtgtacttttccctctgctaggaggtaaatagacttcataagagggcctggtcctttggacttacacactaaagtacagggaagtgatttagacttccatgggggaagtcaactcagggaggaagggtctagactgcgggtcccacttccttttcttttcctctaaattttcttcctctattctctctctttcttatcccctttcttccttctttctcaattcttctcgttctcttctctgcttcccgcgcacattgcaatattggactgcaaatatagggcttcgttgttttgacactccgagtgaataacaaatgagtctatctgtgtctataaaatataggtccagtgtcattatagcaaaggttaatgtttgcagtgtcataattgcaaaccctccgggtgagaggggcgggggcggcggcgtcggggaggtgtgcggcggaccggtggtgaggtggtgctcgactgcagggtgggctggcgcggcggcggggaatggagaggggagggccggcgtatggtggctgagggcagcggcgcgatggcctggcgcggctcggctcggtggcgtccgggtggcagcctgggggcgttggtggcggggcgacgcgcgatggggatgcggcctggccgaggagggaggagggggcggcgaagtggcggtcgggggcggcgcagcgcggccaggtagtggctagcggcagggatggatgggagatgggggcggcggtagtgaggtggaatggaggggaggccgtcggcgtggtggcggctgcggtctggcgacggcgcggcgcggttgggcagcgcccgtgcgcggcgccgcagccatgggggaagggaggcggcacggaagtcgaaggggggagcggcgtcggggcaggagggtggcggttcgaggtggaggtgatacggcgatgccgcgcatatggcgcgggtgacgaagcggcagtgtaggggataaatgtcagtgggttagtgcgagataagggttaggggttagcgtgttagcgagtcataggtcagtgaaacggaaaatacaaggggtcagtcggcccgtttggttggagggagtttttagtagggattgggagtttagagggatgaggctattaagtgtcttgtttagttgggagacatgagaattttggtgagatggagatgaggaattgaggaaggaactccctccttttcaatagctgggtaggggcaggtaattgggaggaaattcctcctttactttgtctaagcaaatctcgaccatccgtttttattaatgatctaatctccaactaaactccctatcaatttctatcaccactaccaaacaagatattgggattaaaaatcaaattcccatcttaatctcatcatcaattccctcgtgtaaacaaaccgagtgtgttagaggttagtgaaacagaaaataaagagtcagcgggttagtgagttagtgcaacagaacaacaaagggttagatgttaggggttagtcgttctcaggtcattcaatggcgcggcggccttcctgtcctcttgctcaactgaggcccagccggagccggctgtggcggagcaagcggagaggtggcaggcagcttgtgcgcgagatggaggagtggcaatggcagagctcgagttgggagaagggagaagaaatggagaggagccgagctgctgctgtctttggtagggtttatatagctttgctggctgcctgagcatgggaggcaatgtgagggtgggcagggagcagtgccgaaacgtcgacatcgccacagtaccaggtacgcatggcccattgtacttggctttgccacttttcggtgtgaacttggtgttgctcttctcagtgaacttggttctgtggtggcatgtatttagtggagggttttgtggattgggttcatggtgaatgtgttgctgctgttgtggagggacccctgtcatttggtagctgcaaaagtaggttcaattcactgtggtggcttgtgggcaattgatcgaacacgttctgtgcatgcaggtgttcggctgagggaataggacagcaatacatgcatgtttttttcggtgaactcggtttatcatcttagtgtggatttgtgtctcctgtgttgttggtgctttggggagggtcctgtgaattgggatcatgggtgcatgggatgttgtttgggagggaccctggtatttattagctactgttgtgagccggcaaaggtgggtgcaaagtgctgtagtgtcttgtgggcttatgtcgagcacctcctgtgcatgtctgttggttgttttgggcagggcaggcaaagcagactttgggtggttggctgagcaagtgcacaggggtgggctgtcagtcggctgggggaggaataatggacttgtgtggtgaaatgggctgtgctagcagagggggagatggcccaagtgtaataggagcttttgtattttgtagggatttgaaaaggaatggcgtctgtatttgagctggcacacatacagtgtatttgtaatgggactgtaatttgaacatttattttggctctgtactcagactgtatatatggaactgtacaattggactggacttggatcggtattagaaatagaatatgcacaaggattggattattgaactgcaatacgagatttggtttgcttggatgatacaccgcatcttcgaacagggaattagggatgacgcccgataaacaattccatcggcagtcttaggatttcgtcgtgagcgctttgcacgaacgggcgacggaaacaaaacagtgatttttgggacgacgcatggcatacaaatccaatcgtcgcggtaggaatagaattgaatatatttgaattgacacacaataaataaatacgccgatcaattgtagacattcgaaggatttattgagttgaattaatacaacggtttgaaataaccggagggtaagaattgagaaagatatgtcgtgctgcgacataagggaagattttcaggttaaatattctgtgatttggtagcacttaataaatcagaccgtgaagatatgggaaagaaaggacgttggactgagggcgtccctttaggagatatgatttaatcgagatctttagcacacaacctaaatacacacaaatgcataataaatcccagcatgcaaaaaggttttaaaaagatttttgattattctgagtttttaattccgtatttcagaatcgaaattttcgggatgttacaaccttcttcgccagccgcgttttgggaagaaaagagaagaaagaggaggatagctgtcatgtgggctcccacgtattttttttgttatctttatttgctgagtaggatgtcaaatcaacgaaactggacatatatgttagagtatatggtagttagagtcatattaggatatgattgatttgtgtagactccttccatatctgtaattctttcttatctcctctccatgtactcttatatataccagccccctgaggctcaatacagtcaatccacgattcacaatatcctctctacctatactatccaacatggtatcagagcttcggcttccacttcgtcgttctaccccacgcatcatcggcttgatcacccgttcaaacggccggctacgacgacaccttgctgctaatcatcttcgactacgcgtctacgccatcaagcttcgggctgccgctgcgtcgcccccctcgggccgcagttccgctgcctgtggtccacacctccactggttgttgcagtgctgacaggcgccctccttagcatggctacatcaccagtggacttctcgccgctgcatcgacatggaactgcagttgtgttgtcttctcgaaccacaactttgccgctttcgtcgttttcatcgtcgttagcgcttcgacaccctcgtcgtccgcattggtcatcgtcagccactcggatcttctttgtctacttcgagcatcgccgccgcgtctccaagttgccaccgtcgccgctctaggccggtagtccagctacctctacatggctactgacgttgccgtctaggccgttggttccgctacttcgccttctttttcgtccatcatgattcatcgccagtgtcgccgtatcttcctcgactacactttgctcttctccgacaactacatgctgctccggcaattctccctctacgtcgttctcgcgttgcgaccgttccggaggtcttctctgctagtctccttcaacattggcttatgattcatggtggtcccctgcctcgcccacgcggtattggaaacactggcgtgcgcgttcgtcccgagttgtcccggggtctggcaaaccctgtgtagcgcccgttccgtcgtggcgcctagcgggaaaattatctcttaaaaaccctaatcgcgaaatttgtttctttgcttgttgtctagtgtccgtgccatctcagatctcaaatccccgatctatcgtcgagttcaattccgaatccaatccttccaaatcaaattcctccgcaaaagtctattttgcctcccccggggtcgatgggccgaatttttctcggcccatctccccctggctcgccagcgccctctctctctcgctctctctcctctcactccgctccgctccgcccgcgcgttgcgcgggcgtgcgcgggagccgcgccgagcgcccctcgtccctccgctctgccggcgcgtgcgtgagccgccgcgccaagcgcccctccctcctccgctctgtctgcgcgcgtgtgcgtgagccgcccgcgccgagccgagcccttctctccgctccctcgctgccgctccccgcgctcgttcgcgcgagcgcgcccgcgtggtcctcgcccgcgtcgcgtctgcgccgcccggccccgctgccctgccgcgcctgcggccgcgcagccgctcggccccgcagccagcgcgcgtgcccgagccgcgcctctcaatccgccgcgccttctgttgcatcccgcgcgcgcgtgccgtggtggccgaccgcccggtcgccgccgccgtcagcctctgcccgcgcctgtcgcccgtgtcgccgctccgctccaaatcgccccgccgtcatcgcctcggccccgccactccgcgcgcaagccgccaagggacggaggcagagccctcctccctcagccgcgtcgcccccgctcccctcctccttttcccaaagaagcaaagggcgagctcccctttctctccctccttttcccattttcctcccgccggcgtcatcctccctccgccctgtcgccgatttggacgcgagcgccgagcgccagctcgcgccttgaccgcccaagtcggtttccaaaccgacattgccgccctttaaagccccgggcgccctccctctcttctcctcccatcgcctccactccattgttgccgcccctctgtttcgccgacgccgttcgtcgttgcgcgcgtcggaggagccggcacgagcgaggacgcggaaggggactccgggcgctcgtcttcctcctcttccccggcccgaggccggagagattactcccgcaccgtcggcctctcgtcacagcgcccctcctcatctcggtagtgcctccctccgttcttcctcctcgctccacctctccccctaaattttcggtagtagctcgagtagcctccccgtagctagccggcgccgccccgaccgttgccgccgctcgccgtgtgctcgccgctgtcgccgcccgtgctccgtagcacccgcttgtcgccggcctcgctcggcgtagctccgctcaatccgacgctagcaacggattcccgtggccgcgtagatgctctcaccgccgggaattggcccctcgtgacctcgtcgccatttcccccttctcccgccgccgcttgccgccgccgcaattcgtcgccgtcaagctccctccgacgaatccgagccgttggctcgtctctcctcgacctgagcaaccacccggtgtgctcgctttcgcctgtatcgccgtggttcgctccgctgctcgccgctgtcgaccgccgtccgttccggcaggcgtcgtcgtctacctcccgccagcccgcgtggcagccacgtaggcgccacgtcggcgccagctcggccaagaccgggtcgagccgaccccggtcagcccctccccgtgcgcgcgttccaccgcgagccgtgaggctgcgcgtgggcccgccgcatccgtttcaccgcggaccacgcgcgtgcaccgcatcccttccccgcccgcgcgcgtgcgccgcgtgctccctccgcacggcgagccgagccgctgacaagcgggtcccactcgggaccgcgcgtggtgagcccggtctactggcgctctctctcctcccctcccgcgcgcgcgcgtcttgggccgccttgggccgcccagcccatttagctcggccggaccgccccaattctctcgggccgcgccctagccgcccgaggaaaagtctattttccctccctcttttcttttcttttcttttcttttccaaaaaggatttaattaaatccttttcctttagacaaaaatccaataatcttagaaattcaatatcttctcaaccgtaaatccgtttgactccgttcaacttccaaaattcctcaaatctcgagatctatctaatggcacgcttagaggtcattaatagggctttattttcgccgtttgttgagttgtcccgttttgcgtatagtttcgaagcccgaagacccgcagccgtgcccacggtcatgggcggatgtgaggtgattcctagcgtagttttgtttgactactgcttgtgaaattgctgttgtggaaaggggtttgatgtttgaaaaacctgcagctgatgggatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagttgtttttagaaaaaagagttcaaataaaatcaattgcaaaaacaacagcctttccttgaagcctgcattaaacacttatttcccatggcttgttgtagcgcccgttccgtcgtggcgcctagcgggaaaattatctctcaaaaaccctaattgcgaaatttgttcctttgattgttgtctagtgtccgtgccatctcaagatctcaatccccgatctatcgtcgagctcaaattccgaatccaaatcttccgaatcatttcctccgcaaagtctaccttgcctcccccggcccatctctccccggcccttttccctctctctctctctctccctcgcgctccctcgctctctcccgatcccgccgctttgcccgcgcgccgcgcgcgtgcgcgcgtgagccgcccgcgccccgcttttccctcccccgcgcgccgtcgcccgttgcctcgcgcccgcgcaagccgagtggccgaccgcccggtcgccgccgccgtcagctctgcccgcgccagtcgccgctgtcgccgctccgctccaaaccgcccgccgtcgtcatcgccggcccccgccactccgcgcgctagccgccaaggcccggaggccgtgcctcacctccctctgccgcgtcgtcgccccgcgcccaccctctttttcccgaatcggcaaaggagagaattcctttctcctcctccttttccccttcctcctttttcctctcccgccggcgtcatcccgtctgccaccgctttggccgctagccgagagccagctcgcgctcttgaccgcgcaagtcggttccccaaaccgacattgccgcctccttaaacccccggccttccccttctcctttcctccccattttcgcctcctccactgccgtctctattttcgccgtctccaaacgtcgccgcgcgtgtcggaggagccggcacgagcgaggacgccgaagaggactccggccgcgcctcttcttcctcttccccggcccgaggccggagagatcactcccgcgccgtcggcctctcgtcacagcgcccctccttcccgcggtgatgtttcgcttcgttctccctcctcgctccgtctcccccccttagacttcggttttagctcgagtagacctcccgtagttggccggcgccgccccgaccgatgccgttgttcgccatgtgctcgccgccgtcgccgcccgagctccgaagtagccgcacgtcgccagcccagctcggcatagctccgtccaatccaaccctagcatcgagttcccgtggccttgtagatgctctcaccgccggaaatcgacctctcgtggcctcatcgccgtttccctcttctcccgccgccggttgccgccgccgcaatccgccgccgccgagcaacctccggcgaatccgagccgttggctcgtctcctctcgtcccgtactaccgcccggcgtgctcgccttcgccggtatcgccgtggcccgctctaccgctcgccgccgtcgcccgccgttcatttgcggtcggtcgtcgtctacctcctgccagcccacgtggccgccacgtaagcgccacgtcggcgccagctcggctgagctcgggacgggccgaccccggccgatccctccccgtgcgcgcgttccaccgcaagccgtgaggctgcgcgtgggcccgccgcacccgagtcctccgtaaaccgcgcgtacaccgctttcccccttccgcccgcgcgcatgcgccgcgtgctccctccgcacggtgggccgagccgctgacaagcgggtcccacccggggccgcgcgaggtgagcccggtccaccggctctctctctctcctctcccgcgcgcgcgcgtaaatgggccgccttgggccgtccggcccgtttagctcggccggaccgagccgaatacctttgggccgcgccctagccgcccgaggaaagtctagattccctcccttcatcatttcctttttctttttccaaaagggatttaattaaatcctttttcctttagaccaaaaatccaataaccttagaaattcaatatctttccaaccataactccatttgactccgttcaacttccaaaatttcccaaatctcgagatctatctaatggcacgcttaggggtcattaatagggctttattctcgccgtttgttgagttgtcccgtttcgcgtgtagtttcggagcccgaagacccgcagtgcgaggatttcgaggatcaagctccagatctcgagcaaggcaagccacctttgaacaacttgagcctatatttgaaatttaattatattgcttgcaaaatattatgcattgataggatcacacttaatctgttgtcccgtctgcaaggcagattggcggacctacctaacttgttgcatttgatccatccgttgttaattgttacaccatgtccccttgtaaccacccagatgcgacgcgatattcgtgcactctgtgcgaatatcgacggtcgccttcaaatttaaaatctgaagtaacaacttgggtaaaactggagttttacaaaagacttggaaaacccgacacctgggtcggtgcttgcgaactaaatgaatttccaaatccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgatgtgaaatcgggttcgatgtttgaaaagaatccgcagctgacgggatcagctaggcccgggtggccgtttgaaaagttgttggcccgggtggccgtttgaaaggtgttggcccgggtggccgtttaaaaagctattggccgggtgccaatcttgttcaaatctaaagactgatacattgcacatactccgaccggacgagacgcactgcctcatccgtgtcgtttgagaagcactcacttagttgcttctagaaaagagttcaaataaaatcaattgcaaaaacaacagcctttccttgaagcctgcattaaacacttattttcccctggcttgctgagtactcccgtactcacccttgctctatataaataatccccccccagttgcggaagaagatgaagtggatcctgctgacgaggagttcttccaggagcaagtcggctacgatgagttttagggtttcagcctagttcccaagtcgcgcctgtgatgattggtccaagtccgggcttccgctttccttttgtaatgcagttgtgagctcgggatctgtccgcagcccaacatgactatattcctactctataataaagagacctctgttgctatgatattctgtctccctgtgataccagcactgtttcctgggactggtatcgattaacaggttaatttggagcgtcacgggctagttccagccggaactggttcggggcgtgacacttgttgagtactcccgtactcacccttgctctatataaaaaatccccccccccagttgctgaaaaagatgaagcgaaacctgctgatgaggacttcttccaggagcaagccggctacgatgagttttagggtttcagcctagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggttaatttggagcgtcacgggctagttccggtcgggactggttcggggcgtgacaccctgtgtgacgtctcgtccttcacggttcgactacatcggcttttcggcgtcatcttcctcaacgactgccgtgattgtgtcaccgtcttcgtctccagtgcatcctcgcgcaccttggtccacgacgcccctcccgtgcgtccacgaccactctacggcgccctatgcgcgtcctgcggctcggctacctcgacatcagcttcctgacttcggctacaacgaccacggctactctacacacggcttcatcaactacggctcccttgcacccttcgctttggctacattgactacggtacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatctcctctccatgtactcctatgtatatcagccctctgaggctcaatacagtcaatccacgattcgcaatatcctctctccctgtactatccaacattatatactgctatataatctaaattacactgttttatataatttaggggatgaagatttctagtatcgtggattaggaatgtcatacaaactcgacgtaaagataagggatgacaggttaactcgacgtaaagttggagtttcaactatataaacagccaatatctatctaccaaaaaaaaaatcccctcgacgcacccatcctgattcacgcatccaaactcattccacgttcacgttgttgctaattgctaacaaattcatcttctgagcatttcagacacgtttcactaattttgtggggaaaaacataccacctaagtagaactgaaacatatttaagcctggattccatgcttagacacacaaaaacaaaaaaggttgtattaagaaatcaaagctttacaaaattttaagtgaagtttcacaattttataattgaagttgcacatggttaaaaagtattgtttttgggatggagggtgcaaatgcactcgatcgaaaagaaaaatatgttctctgaatcgctcagcattcaacgcttagtgagggttagattacatacacattgaatctccttattaatatgcctagtacaagcatttttcaagcacacgagaaaacctactagcacttgctacatatcaccagtccaaaagcataatatttcagtacaagccatttcatgccattgcaaattagatggaagcaacagctacagaagcaaactcaacagctacagaagcaaactgagataaaatagtaaacgttgggactttacttattattagtatgtcaagtactaacttcttttaggcaagcataacaaaacctactagcatttgcaagttgcaacatatcgccagctctccccggaaaaaaaaaacatatcgccagttcatgccattgcatattggacggaagctgcatgtacagaagaaaatcaagctaaatagtgtccagctcttctagaatcacaaaatagtatccaactcttatgtacaaaaggtgttcattcccaacaaaaaatgctagtagatgtacagtctagcaaaaaacaactctatatatccctgtcaaaacaaatttgcaatcatctcatagcaaaacaaaaaaaaaagattcataccatcaattacagcgaaacatgcagataacaaaaaaaaatcaccatccatacaaccaaaattgcatacaaataaaagattaaccaaggaactgaaaagacaaacagattcttcagtacaagccagtttagtctatgcattgtgcaattggaaattggatggaagcaacaagaacagaactaggtatttgttcttaagtaaatgatgttaaactctgcaagtttagtctatgcattttgcaagtgtatgtgactgacaattaaggaaaaaacccgacaacaaaacttatgctgggaaataaaccaaaatattctaagaattctcattaatttgcaacttaagttgcacgtatttataactaaagttgtgcatatttataacttaagttgcacatgattgcatttttttattcttagaaaaatcacaaaaataggtaaaatacctagaggaaaatttcctagatacacaacagtagcaagtattcaagggtgcggaaataaaaaaaaatattactctaggtacctagatacacaatgcagcaagcattcaagggtggcaaaataaaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatgggtataaaaatcgactgacagattgaagattttcaatcacctgcaaaataacaaagcagtttttttctgtatgttaagttttccttataaattataatgttttccagttctattttgatctaaggtatagctagcatgtttatatatacccaatataatgcctcctaaatttcttatcatcaaatttgctaacagaagttttataccaattcccgcagcaacgcgcaggaaatcatctgtttaagtatggtgacctcatggtcaccgtcaccgaggcaacgtatggtgacctcatggtcaccgtcaccgaggcaacgggtagacgggttcaggagcaggtccagtttgagggaggactccaagtggtgaaaaattcattaactcattacttgcaacaaacaggtccaaagagttggatcattgttttgtgtttaactcaaaggcataaagacaattagtgccacataaataagccaacatatattaatattaccgtctactactacttttatagaggggttcatcaacccaaagtaagcaacctggacaaggttcttgtcacaaaactattaactatatatgcccagcaacagtacaactccttaacccccaatcaagccaacaaaccactgatccgataatatttgcatccaggcaggctgcagtatgatgcatatatgtcactgggttcgcacattctacttggcggcttctgcgtcctcctcagatcgtccaactcctgtgtctacatcaaataaaatagctattatctcataaaatgtccttgaagcaagaattagtactcaagggaagagcattcatgttgtccacattgagtacaacaggaaaagcaaaacctaaagcaatatactactttttcaagtatgctttggtcaataccttattacttgctctattctcttgttcttttgacatggtatgaatgcactttgattaattacttcttcatatttaaatgcatgctagcaaaatatattacacgcataatgacactgttggtacttaaaggcttaaaagctagcagctgttgagctagctgtctcatgaagctagcttaattaagtctgatttatttatatatgtagacatccagagagagagagagagagagagagccagagacaagcttagcaacaacaaccaaaagcaaggagcactaactgcagctgttggcgatcgaattaaggatcctgcagctacaagcaagaaggtgcaggtgcagggtgcggccatggcgaactaccaccaccaggagtactaccagatggcggcggcggcggcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtacccccggcggcgacgaggtggacatggaggtgcggcagcagagcggcggcagcggcgacgaccggaggaccatccggatgatgaggaaccgggagtccgcgcttcgctccagggcgcgcaagagggtacgtacgtatatacaataccaaatacgtataattatacgtatcatactacagtatttatgtacgtatgtgtttataacgtacggtatgaattactactgatcatcaacaaatgttctcatatgtactctctccgatcaatattacttgtgctttccgacaaagcaattccgttctattaaacgcaggccaatttaattgtctgaaacggccggcatgtacttaattatgtccggagggagtaattaacatggaaatttctcttttcaaaaactgaatataattagaatttaattaaaactggatctttcacaaaaataaaatgctgctaataagtcgatcacttataaggtcattgttggaatgcgataatttaattaattaggttttcaatagaagtttgtagcaggcgaaattatataatttgcacattgaattatcagtaaattgcagtcacgtcgttattcatcgttaagtttttgagctgagctgaactggttagtttacacaactgaatatatatgagcaaatttcattacatttcataaaggagttagtctatatattttacattatatccttgatgatggtgcatggaggagatatctgtgtgtaccttgggcagatactgtatggagtgaaactctcgagtatagtgaccaagtttggtcaatttgttaaagaactaaaaagttgatggagtgtgttatctcttgcatcatgcataggttcctgttgataatgtttagtcaatatggcctaaatatgcatatctcttctttgattagtgccctttcttttattaccagtctatcatcatccaagcaggcacttgtgtgataattaatatcaaaattaagtcagcttcacctaatccaagattccaagtccagcagaaagggcccataccagagagtgtatatatatgtatgatatcctcgtggacatggtgtctacttgtctctccatgcatattggtaatttgtggttagctggtttcactctgatatatatatatatatatatatatatatcactaattaatagtacataataataaaaaaagaatgtgcggaaaaaaagaatgtgcaatttgttaacaatagtagtgtagtcatgggtattatatatattttccatcccttgtacgcatatatgccctttaggccaactcaatagatcatcaatagtaaatatcccaaatcactcctaaagttaagtagttaacacaattaccatcgaaaaaacgaatgtgcaattatgttcttttcttgaatgatttgctaattgctacatgtatcctctttcttgattaaacattagagaaaattggtgcccctgaatttgtaagagttccagattaaatagagactgttaacaacgacaaatcgaaccttctaagcaaaaaagaaatgaacataatgtcccagttgatattaactatatttgggtcgatgcatgacacaaggtatcccaaaatataatcaccacgttagactcagcttacatcacaattaactactcctgcccccaagaaaaagtcttcctcgtatgcttgagatattttaacagatagtctcacgctaatatatacttctcttgttaggtacggactaattaaataagcataaagaacttaagttgatcgggacaagaggaaaatatgaaaactagcttggcattatctcgactatctatcatctgaataggactgcactatgaattaattggatcacacctgctgctagtgaggagctccttttaccgtctccatctaacctctctagactctagaggtactccatttcagaactaaccatgcatttgtacctaccaaaagggcaataagcatccccaaaaaaaaaacagactgcctacttgtcaatgaatccagttctgtcatattaatacgattcagattgtattaattgtgaagtaatttgttatgcaggcgtacgttgaagagctagagaaagaggttcgccggctggtggatgacaacttgaatctcaagaagcagtgcaaagaggtactcatcactaattcaattcacaagtgatcttcacatcactaattaattactaccaccgtctcagaatataagaatctagaatcggatgatgcgttttctatttttgtccagattcgtagtgctaggaaacatcccatctgaccataggttcttatattctgggatggaggtagtagttgataataactcattacttttgaaatgttgtgatttgatcattcatgtgacgagcacttgtacttctgcttggacagctgaaacaggaggttgctgcactggtgatgcctacaaagagctcactgcgacgaacttcatcaactcaattctgaaggtcgaccaaaacaagcaagattatttgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcagtcagtagtagtatttgttat

SEQ ID NO: 81088 - DNA, 16986 bp, Oryza sativa
cttggccactcctcggagacatgtcgcggagcttcttcggagacatttcgtcgagcacgtcgcagacgaggatgcccgcgccagagatcgacccagccgacggtgccctttgcgcctccgagcatgatggtcttggctggtggtcaggtggtacatatggctctctcagctgagtgatggatcgggcacaacctgtccctcaccggatcctccacggacacctcctggcatgtccaactccgggcgatcgggacagtggacgacggagaagtgggagagggcaggcgggcggcggcggctcgttccagaatgcacctcgatgggatggccggtgctcgttctcgaactggcggtggtggcgttcttaccggcggaggtgtagcctcggacgctgccgctggccgcgttctccgcggcggcggcggccatggcgctggatcggaagtgaacttttttttttttttttggttctccctctgcttgaaggcttaacgttgggcttgggcctaatcggtggcgccttatgctgggttgtactcaagcccaaaatcaattgggcctttccaattgagccaagcccgaaaacctagaagataagacagaacatcggagacttttgattggagcttctctgtcccgctgtccggaatggtgcactgtcagctatgtacaaaatatatcttgaactccctgctgcagaagagttcagagttgagagggtatgatctgcacactaacatattattcctgttgcatagatattgttggattgtcactgtgtgtaagacaagtattctatatatactatataatcagttttctttggtaaaaagttatactgtcttgctatgctagtcgatgaatctgatggcgggcattgttctgagaatgaacttagaaaacacattcgttcaaaaaaaaaaaacagtttgaggcagcggggagcagatccagtttgagggaggactccaagtggtgaaaaattcatcaactcattacttgaaacaaacaggttcaaagagttggatcattgttttgtgtttaactcaaaggcataaagacaattagtgccacataaataagccaacatcccctcaaaaaataagccaacatatattaatgttattaacgtctactcctacttttatcatcaacccaaagtaagcaacctggataagattcttgtcacaaaactatatatgcccagcaacagcacaactccttaacccccattcaagccaacaaaccactgatacgataatatttgcatccaggcaggctgcagtatgatgcatatatgtcactgggttcgcacattctactcggcggcttctgcatcctcctcaggtcgtccaactcttgtgtctacatcaaataaaatagctattatctcataaaatgtccttgaagcaagaattagtactcaagaggaagagcattcatgttgtccacattgagtacaacaggaaaagcaaaacctaaagcaatatactactttttcaagtatgctttggtcaagtactaccttattattacttgctctattctcttgttcttttgacatggtacgaatgcactttgattaattacttcatatttaaatgcatgctagcaaaatatattacacgcataatgacaaggaaacaagagtgacgacacatttactgctatgaattttcacgaagaatgcaagtaattttatgcattagtcgtcgacattttagtggaggtgtctttattctgttaacaaagttcaggttttgtttttgcaagtacagtcagaaacacaacgtttgtctgaaactcacacaaaacagtatattgcataatgagtattggtactactctgccaaaaggactcttggtactgttctgcccttgtatcaacatatcaagcctatcaccctaaataaagttactacattctagtcctagtttggtcattcggaccatcataaacaaagaactataatgatcagccctagatccttaaatggcattttattacccatatgcacatggtgctgcatttgttctggaatacgagcggtaattaagtacctgtggtagtgttgaggcgtttggagatcccagttgcaaggtagcatcgcatggagtagagggtgttcttttcggggtcaagcttggccactcctcgcagctccttgttcctgacgtcaacagcgaccatcattcctcccgtcttagcacccctgccagcagcgttgcccaagaggtaaacaacatcatcatcgatgcaactcaaggccgggtaacacaaacgcaggcgacctagggacaaggaagaggttgccccttgaccttgagcctcctccctgtgttcatcaccgctgttgctgagcatgaggctatgaagcaactcgtaatggtgacttgggttggtgtcaagatggacttcacgcgattcagcagtgcagtcacggcgccagtcgtcccatgaagtgaccgggataggcatgctccatgtagtgattctccacgaaccagggtggaacacggagcgtcgccgtgtcggctgaggttctctgctgcggcgaacccattcaaggtatgaagtaggatctgcagaggtggaggtgggtatggtggtggtcaccgttcttggcgaaacgatctccatctccagatacttgatggaatccttgtgttggctgatggcgatgtcccgacagaaggacacatcttcattgaggtacctcctccaattgcccttggccggccacggcagcggcatgtcgcggagcttccttggagacatttcgtcgagcacgtcgcagaggaggatgccgcgccagagatcaacccagcccacggtgcccttcgcacctccgagcgtgatggtcttggtggtgacgtggtacagctgcctcttggctgagtccgggatcgggcacagcctgtccctcaccggctcctccacggacacctcctccgatgtccaactcccagacgaacaagaagatctgtacaggcgcagcgtggaagtgaactcactccagacgtggagggcggccacgacgtagcggtcgtcgccgcagctgagtatggcgagctggtggtcaccgagggtagggggaggcgggttggggagcagatccagtttcggagacgggggatccggatggtagaccaagtagtcgttgtcatgcggggcaccaagctgatcgatggggactcggaggaggaggaggagctggccgtcggcgtcgtcgacggcggcggcgatggctttaggcgcgccaagcagattgccattgaaggatgggagatcggggcagtggacggagaagtgggagagggcaggcggggacgcctcccacaaagtcacctcgatgggatggccggcgctcaacctgcagctggcggtggaggcgttcttgagggtggacgtgtagccccggacgccgagcaggaggctgctggccgtcttctccccggcggcgccgccagtcgcggccatggcgtcgaattagggatttcgattttgggggtaaggaaggggaatacaacaaacagacgtagacgggtggagcgaaggcttttatttgggatgcccgcacccggggtgattagtccgcaaatgacctaattagcgctaatggtaatatgtactggagtaatattttttttaaaaaaaatacatcaataattattttttttaggatagttcacagttttaaaaaatagttgaaagatcatgaattttcagttgaaattttccataattcgagttgaaagttttagaagtttgagttagaaatttttttaatcgcgttaaaagtttttaaattcccagttgaaagttttcataattcaagttgaaagtttttaaaatcaggttaaaagtttcaaaattcgagttgaaagttcaaatttcatgttgagagttcaaagttttcaaattttgagttagttttaaattttaggtaggacttttttttattgaaatatgtagatctttacctatcataaatgtttaagatgcttttgccaagtatttttgtacgttgtcccagtataatgcgctgcgcagtccaatttcttttcctccctgtgcgtatttttttacgattttccggtccgattcctccatatcgccccctcccaaattgctccacgttttccgttttcatgtccagatcatatcatgtcctagcaagtagaacaaattttctcctcacatcagttcaggcccatgtaaccgccacattccagatcaattttacatacatataaaccctaaaccctaaaccagatagggctccatggtgcccgggcaccactgacatctgccgttggatcacattctcatctagttgatcggtacatgtatatttgattaacgggttcacccgttaagtacatttgatttggaaattgacagcatgtgcatgcatgcaaaatatttagtaacgtctttaatacctaggtttggtaattgacagcctgtgcatgcatgcaaaatatttaggagtatcaatttagcgtctttaatacctttccatcaacagttcacggccgttatttggtttctaaatatttgtcaccataatcatggatttgcggtttatttggcaacaaatataatgcggtttattagggtatatgaaaaatctaagtatacttctacgatgtagtatatatggaaatgttatcctgctgttattttgaaaataattatataaggaaaccgaggtaccctaagtacaccatgaacgatgtaattggaatataagtatatatggaggctaagtatatggtatgcttatgtacacctagctaaattagtgcgttttgcactttccagattcagaaaatgtttactcatttatgtaatgtaatggctatgtatacacgggttattttttctatatacttagctaacttgttaagtatacaaagttttaaattacgttaatttaattatattatgaatccaagcgtatataaatttacaatttgtgtacacggtatattttattattgtcatttaatattgttgtaaatagtaagtttggaaactaattaaatttggaaccaagtatattttagtcattacgtccggatgtaaaattttatataaattaatccaagcatattttttgtataccatggtttctaagtatatctatatttcaaatgtgtactgtagattattagaatttaaaactcgcctacctaggctgacagtacattatttcctaattaaatttggaaccaagtatattttaagtcgttacgtccggatgtaaaatttaatataaataaatccaagtatatttttgtaccatggattttaagtatatctaaaatttaaatgtgtgtactgtgtattattatttccaccatgtttttccatatgtgccgatttagattaaattcaatttctttccacagtgttttagatgcgcttttagaagtttaatatgctgaattgaaagagtagatctcttaagtgaagtctgaaaggaaacaaaatatcggtgaattggctcatccacatatcataggagtttagcataatataaatgaaacatatgctaattaaagtaaaaacgatctataaatatagatgtaactagtttattattacagtacgattgtgattcataaatgtaaaaacacagaatggctgcttatttgaccgatggctggcaaccatatcacaccatcagagagttgattttcggctggtacttgcatgttgcctcatgtttgctattcagacggtgggcgagtctcatttctcatcactaggatgagaatttatcatcactatgacgagaaatgatcaacttaggagcctccacctccctcttgacatctttacggtctgtatctatctcctacgaaaaaaaaacaagtggaaaatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttctcgctccgggcactagtgttcatcttgtccatagctactggcaatataagtataaatttcagaatactaagaagaggtcaacatatatgagaagtacatatacgtacagataagttggagccatacctggaacagaaatgtgttgttggcgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcagcatggatcgatccagtcagaattgggtatcaattgattaatttagtaaccaacgagtgatttcggtactaattggccatagtcaacgggatagagagagagtgaaaaaatgcacgtctgaataccacaagattaatgacataatctgtacttttacaggtgtacatgtacacataggtttatgagtgacagagcgaacacgtatacatgtatatcccacaagatgaatgacataattatctcagctaccagctctttcttttcagcactaaatctctgtatgataggtgtgatggaagatggtacacaacgcgaaaccggtgccacgaatttaacacgaacagccttcttccttgtaggtggagtgacaaagtcatcatcatcgtgaatggaacgacgcttcacatttcttctcatgctcgcacactttggaagccgcggcatgctattaaaaactaccattattaaaacaagcaatatgattctcttcgggtcatatacttcaatttaaaattaattaaatctatatttacaaagattataattgagatgtccacgtaaaagagacattgctgctgtttcactacctacctaaattttattcactggatgcaaatcaagatattcgaacgggcatgttatatacctaaaacaatctaaattcaactgcatttcaacaaaaaatctataaatttaggttccaggtgattcatcatgtgctcagtttagtagataaaaagaagaggaatggcgaatcatctatacataacagggactgcatgtgaatgtaagatgtgtgagtgataaacactgagatccatacctttcaggtaatgcagcttgctagtgaataatgtctgttccgaagctcacgaacaaccagcgacggcagcgaaaaggcacttggacatcaggcgctgtgatggcttgacaaaaatggttgaggagttctggtttccagcaagaggcttgtggacgaacgtcgtcggtgacgaaaaccacggacgtcggccctcttcacggcatggcgagcaatcccggcgaggtaactcggtgaagacgatgtggatagctagctcttggaccgtgaaacagtgtggaaaagaaaaatcaaaaaaaggaatacagtagccggttatatgtgcatcttgaaaatggaatgtaatcttgaaaatagatggcaataatcgcaattagtggaatggcgtcatttttcaaaaacgaatcatgattcaaaaggtaagtatctgcatgcaaacgttgtatatatggaaatgtgatatagaaaatggaaagtgctaatcataatgtgtatgcatgattagagggcgcaaatttggaaatacatgcacagtaaaaatggaaatacctgcatgcatgttctaaggaaagtatatgcatgcaactcttatcgggttagacccgttaatgtgtgatagcatcctctagtgtgttgcacggatcttaaagcatttggacggtggatggctatggagcccgggcaccatggtgcccctaacaaatttactatatatatatatatatatatatatatatatacatactataccgcatctggcgtacgtagtagctaaaatgctccccctcacatcctacccccacccctcccaacccacccccgtgcaccccaaccaccggcgccccctacccctcccaaatttactagtaaattgtttactatcgaatctacatgctatatatatatagactagcaaaagtgaccgtgcgttgcaccgggtgtttacggagtgtgtatagcgatcaaaaagtattgtttggtttagagaactaatctgctcaaaaaaaattgtttgtttttagataaataatatgctctatatttgcgcacagagtgatgtcacgatggataaaatttaactgaacaattttttaaacagtctagtatttcaataataatcacaaagttttttttaaaatattccactttacatgtgtatgatatgagcgatgttcctgacgcgttagcgtaacgattgtactacggtggataaatttaactgatcgatttttaagcagtttagtattaaaaaataataatcacaaatgtttttttacagttattccacgtatacgtggatgatataaatgttgtacctgatgcattggcgtaatctctaatttcgaaatctctgccgattcgcgtgcaaacaacccctccacgtggcacaatacgattccagcgttagtcctctccctcagccgtcggatcgatgatcaacggtgtggaatagctgcggtggacctctttgtaatatgtgaggttttaggggtctttttgaaaaagttataccctgctatgcccttctctccgccggcagccccgcccccgcttcctccgcctcattcgtcggaggtcgacctacgccgatgtcgccgcctcttcctcctcctcacgctccagctccagctccacctccgcccctccggcgcccgaggccgaccctcccacgcgccggcgcgctgttctgtgcgtctctcccctcaagctcggcggcagtggcacagattcacctcgtcgctggatgtggcgatgaattcggttgccgtgcttggggatggggagggtgaaatcacgtgcatcgctacgtccgtctttgcctgccttttgattcgccagccgcctctctccccaagccgcggcaccgaggggatcttggacggaggccactggccgtgccgcaaagggcgtggctgaggaccgcgctaccgctgccggatgacgtcatgcaggagcaggagctccctcccctgcttccctatgtgttcacaccacaggtgattaattccacctgtaaacggaatcggaatcggaatatataaagcggcgcacatggggcgagcgaggaggggtgccacgtaaggattttgctacagtatatacagcgcgcggggtggcatttttgtgaaaaggccctccgcttcgcgcgtaattcggccgccgtcctccatgaacagtcccaccgagttgtctatttacgtttaggcctctggtgaatacagttattgcataggaggaagggagatgtggcgagttagggtcgcgctgtaaaacttgaaagacgagggtctttttcgcaaaaacgccgtgcgcccagccccaagcccccaacctgcccgccgctgcctgctcgtctcctcgtccctcccgtcccccgtctcgccctctccctctccttctcccgcctcgcgtcgccgccgccgccgccgccccgcgcgccgcccctcctccctctccctcagccatcctcctcctccgccgccggtccattctccgcccttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggaggtaaggtttgcagcgtgcataatgatgtgcggttgaagttgaactcagttttgtgttccttttttgatatttcgattttcttcttttcatagaaagaatggattggagtaaatcagcagcggtgtggattgtgctctgacctcggcaggggcggatacaagaacacagcgatgagatccggtgcggtttgtggcggaccaagcatgccggccgatggagatggttctctgcatctacgcattccccaccaacatgccgcccttcaggtacaaatcaagtctgataaaacactgccatccttcttgtgttacatgttctgtgttacatggtggcctcctcctccaccacagcggcggtgtcggcaaacagatttgagaggtaaaaacatcccttcttgtgttgctttacggccatatttgagaggagaatggcatgatgctgcagtttgatttcaccggctttcctgcttgccgtatttgtaatctcaactttcatttcaagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaagtatggctgctgaccaatttcttccctgaagtaggtgaggttagcccgataggaacacataccacctatattgtgatatttggagctagggcacattcagtcctgttatttgatctgtagcatcaaggttgtaaaattatcagttttgcagaggatttttggtcatcaaattggagttgatgatattttttgagacactgaattaactaatatcaaatatataatctggatttcccttcaactcaaagcttgttgttgtcttgttgtctgcgtgcatgctggggtggctcttctgcgggcgatcaaaagggcagtgacagcatgtattgacgaacgcaatgtgcttgctggccgaatagacatgaacacatatcactgagagggagtgaaacagtgttgacgagtagcctgcttttgggttagttcttgatcaagctaaaatgcacttctttttcttgatcggtataaagggcaccctttttttttcttgcagcattttcatatgcacccaatattgcccacacggccacaccaccatcatctataggcaagtagtatgttcatgtgcaaattttgcagggatcaaataaatgtcatttccctgatccattatttggctatctcgtgtacttgatgccgatttttaatttcttattgctgcatgaactatttcttttggacagtcagagtctcaatccttgccatcattaaccgagaatcttttttccatgattcttactgtttcaggtgatagaaatagcattgtagtagggtggtaatagcaagaagccgaaaggtaaggatcaggctataacgttggggcattggcaactcaattaaaaggtaagtatctattggtcacagagcttgacaactttgaatctttgatgatcgtattgtaccattgtttcagttgtagtggccattgttcctgttaaatgcaagttgatactaataaacccattgaatagaggccttcatataattcaatgtttaagagaaaccaaccgtggactggagctctcagattagtttattcaagccacttttttctagcatgcaattatttcgtggcttattgcattccctataattttcattgacttagaggaggtttggggctttttatttttaatgaggtgcaacaatctgtccatctcactcgttggtgcaattacattttttgcttgattttcttcactgctttatgacgactgagataaaaacttatctgtgcagcttcatgtttctgatgcaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggttagttgtctgatcatggagcgcaaaacaaattatccatgtgctgatgtgcaattaataccaaagtatttgtgtgtcactatgatgtcttgtctgcttgcctgaatgttcttgttctgaattctgaaggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggaggtaataactaataaccattacaatttcttatccaaatagttcattcatctagcagaaagaaatttcagccaatttttttgtgttcacagccttggagcgtgcctgaagttgtgcgacctctgtatgaatcttctgccttggttgcgcagaagatatcgatggcggtacagtaattatagtaccctgttcttgatgttcttgttgatttgtaaaaattattgcctaattcagtcatgcaaaattcagtctttacgctgcctgaggcaggttgcctacaaagatacccgttctgtgatcacaggatggggaaggaagcttgcggctttgcatgctctgagccaaaaagctcaccacgtaggactcctgaacagcagatgcttcttggttcttgccatgaatcttcagttcaaaagtgtgaaaaataattttgcatgctctcttttcagaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggttagcttcactatgaaactagaattagtactttctttttgtttgttttgtaattgccaatatttttcatacaatatttcttctgctgtttgctaggatgtctctcctccatcactactgcaatttttgcgcgaacaccagtcacaatgggctgacgatgaaaccaaacttctgcaatttacccatgtctcgtcttggaggattcagtggtcaggtcatacttcctttagcacacacttttgaacctgcagaggtaagtccatcttctactgtctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcaggtgacttcttgattcatgaaacttatcaccagttgaagaatcattttcttttttcctctgtaaaacttgtgttcttggcctgattgcaatggcagatgtacaatggagtagaggagagcagtgcaggaacatgttcagagctaatctttgcacccatcgatgcatcgttcagtgatgattctccgctgctgccttccggtttctacatcatccctatcgattctcctctgtaagtaaatctcacacaattagataatacactagcatttcgaatcaaattttctaaaatttttatgctataaaaaacataattcttctggattttctttccttgcaaatgttaggacacatctagctcgaactgcatgctggatcttgcttccatgctcgaagcagcgacgccatggagcaggatcagcggcatcaattgcagcggctgtgctgctgcggcgagctccaaggcggtgatgacgatcgcattccagttcgtgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctataggtttgtggcttcgcagctgcttgtaatacagttcatatctgtaagatttttttaaaaaaaacagttcgcttttcagaactcatgatgctttgcttatgcagatttcattttggtgctgaactcatcaaatctgcagatgccaacagcagcagtgaatcggttctgaaagcagtttggcatcatcccagtgccatactctactgctctctcaaggtttcttcagcctctatttttctttttctgattaagatacagattttacctagatttttataaatacgtttttttaaactgttgaactgtatatttcgaacgaaaaaaattcatatagaagctttaattacaagataaatctatttttcaattttaaaataattaaaccttaattagtgagatgttaatgattttctcgttttacctgtccgaacttaatcttttatcttaaactcgaatggggccagtactcaatactgttatgcatggaggattgtttgttatctcaatttatttcagggacttttgaatttttcgtgcagcttgactgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggtcctcccatgtccttgacaataacagtaatatccttcaacttttcaacttatcttcattctcacaggtaagtcttgtaattcatcttctatttgtgctagccttgatgttaagtctgcatttataacggtactctcttgagtttctaaactaacttcatcaatggattatttgacaggtgatgcctggtaagtcttgtaattcatcacaggtaagtcttgtaattcatcttctatttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcagtcagtagtagtatttgttatctttgagggacagatgggcttgtctcttgtcagcattcaccttagctttacctcttactagtatattttatcactgagtgcgtttatgctcatagggcatatatatcttatgttggatataagtttttttttttttggtcttgtttagttaaactgaagatgcatggccgactgaacatgagaaaaatatcatttcgtttggaatgtcatggaaagcactttctgaatggctaacaggatataataaatatcagctctcacctttgtccactattgatagaaaaggaaaggcaagaagattgccttaattaacctaattgtcatcaaatcaaagtggccggcttatcgagaacctagctttgtctagaaactttgccttgaaatgaattgaaaaatcatgcatgcacttggcgtgtgattctcctccttcctattgacaaaatacttttcgccatgtcaacgccggaatgatcagtatacactatccattgatgcagattactggcgaacaagagcagcagctcttttccttttagttcttcttagctagatatgagaaattttcttggccaaacattgtagagtttaaacaaaattcttcggaacttacatgccggcaagcaaaggaacacaacaaagtttagcctaacttatatattgaccgattaaaatctgttatgcatgttaagaattgagacagaaatttaagccaaagagattaatctctcgtagaacagcacgcaaataacagacatgacaacaaggagcggtaattaattgagtatacctgtagtggtagtagtggtaattaattgagtatacctgtacttgggcctaatcggtggcgccttatgctgcg

SEQ ID NO: 81089 - DNA, 624 bp, Oryza sativa
  unsure (1)..(624): unsure at all n locations
acgggagcgactcacgatgcaaggaggagcagcgccgaggaggaaaaggtccggtggcggggtggctcgtctcggtgaggaggagcggtaaagagaaggagggccgacggcggcggcgacagctcatcgaggaggaacgccaacgagttggaggctagcggcagatnggctcctcccctcccctccaatcccgccggcggcagtggctctacgacgaggaggaagggcggcggcttggtggagatagtgacgaccactgcgccagcaagggcaacgtacagcgacggcgaccgcgtgggaagagtgatgtcgacagtctctagacctcctcagttgttcttcttcctctagatccagatccataattttttttctctttatttctgtggaatatgtgaatcttgttcttctcatttgcatggtgagatttgatttgatttgcatcgtgcttaatctgtgcaaatggcagctgaatggggatatttttcaaatgtatttttttgcccaaaaatatcttcgtaggtggtctgctttaggtgtccacctcgaaaatgattttcgtgggcggacagggggtccgcgcataaaatatttttcctctagtagtgttagggctgcaggaat

SEQ ID NO: 81090 - DNA, 2245 bp, Oryza sativa
catgacaaggcatttccaaagccgatacaggtttaccatatgccgacgagaggggtcccagaccaacaacaggttaggtcccagaccatactgtggcaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcgagagcggaaaaccgtacacccggtacgttccccggtccgcggttttggaaattcatttagttcgtaagcaccgacccaggtgtcgggttttccaagtcttttataaacccaagttttacccaagttgtttttcagattttaagtttgaaggcgtccgtcgatactcgcacagggtgcacgaatatcgtgacgcaactagatggttacaaggggacacgatataacaattagcaaagggaggatcaatgcaacaaattaggtgggtccgccaatctgccttgcagacgggacaacagattaagtgcgatcctatcaatgcataataatttttcaagcaacataattaaattcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatccttttggaaaagaaaagaagagggagggaaaatagacttttctcggacggctagggcgcggcccgagagaaagggcggctcggccgagcttaacgggccggccggcccaagaaggcggcccagagcggcccaagacgcgcgcgcgcgggagggaggagagagagagccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggacgcggatgcagcgggcccacgcgcagccttacggctcacagtggaacgcgcgcacgggaggggctgaccggggtcggcccgtcccgacctcggctgagctggcgccgacgtggcgcctacgtggctgccacgcgggccggcgggaggtagacgatgacgccggccggaacggacggcggacaacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagagggaaacggcgacgaggtcacgaggggccgattcccggcggtgagagcatctacgcggccacgggaatccgatgctagcgtcggattgggcggagctacgacgagcgaggctggcgacgagcgggtgctacggagatcgggcggcgacggcggcgagcacacggcgagcgacggcaatggtcggggcggcgccggctagctacggggaggctactcgtgctaccaccgagaactaagggggggatggagcgcggaggaagaacggagggaggcactaccgtgcgggcgggatgcagtgacgagaggccgacggcgggggagtaatctctccggccttgggccggggaagaggaaggagagggcgcgcccggagtccccttccacgtccttgctcgtgccggctcctccgacatgcgcaacgacgaacggcgacggcgaacagagcacgggggcggcggcaatggcgcggaggcgaatgggagaggaaggaaaagggggaggctggggtttaaatgggcggcaatgtcggtttgggaaccgacttagggcggtcaaaggaaaagggctggcgctcggcggtcgcggcccaagcggcgacagggaggagggaggaggatgacgccggcgggagggaaaaaggggaaaagagggagagaaaagggggcttgtccccttgcctcttcgggaaa

SEQ ID NO: 81091 - DNA, 15405 bp, Oryza sativa
cctccgggggagatgggccgagcgagattcggcccatcgaccccggaggaggcaaaatagacttttacggaggaaattgatttggaaggatttgggttcggaattgaactcgacgatggatcggggatttgagatcttgagatggcacggacactagacgacaagcgaagaaacaaatttcgcaaatagggtttttaggagaaaattttcccgctaggcgccacgacggaacgggcgctacacatactttcagtactcataaactacaacgtgcaacatgtgagtaggattaaattagaggaacgattattgatcactgacaagttgtctctaaggttggagctttgaaggtgtccttttggtccgtggatctagaaatttaatagatagaaaaaaaaagacatggtcacaaaaactatagtgcctatagtattccatatctatagtaagtcataccaagcgctattctcttattaagaagaaataggcactatatatattcggatcagtatgtcatacaagtctaatatatacgacggtccctattactccttaaatcaaattgataccgagtttcttaagtattccatatcttctatttatgagaactaatttatgatacctactacaagattatatccattccgttatgtttgtgttttccactattaagaatatattacacattcaattcgaatgcatttttttacagttttaatgtgttactttcaggtttctggatccaatattctttggtgaataccctagagaaatgagagagatcctctcatcaaacttaccaaagtttacaccagaagaaaagaagttgttgcaaaacaaggtggatttcattgggataaatcaatacacagcaatttacgcaaaggattgcatctattctccgtgcgcacttaacacatatgaggggaatgctctcgtctacaccaccggtgtaagaaacggtgcaaaaatcgggaaacctgtaagaactagtacttctctacttttttatgtccctacttgatcttcaatcaactttgtccaatatttgtttggtttctatgtatctcatatttgaatatgtgatatgatcgaccttgcagactgcattttcaacgtattttgttgtcccagaaagcatagagtcggctgtcatgtacgtcaatggtagatataaggacacaacaatctacattacagaaaacggtgagtagtgatatgcattggactcaaccccctgaagatccagttgcaagttcatatggctttatgcgtctattccgtccccatcacttatcatggattcatgggtcatggtatttgctttcaggctactcacaacatagcgataccaacatggaagatttgatcaatgacgttgaaagggtcaactacctgcaaggttacctcaagtatctttcctcggcggtcaggtgatgtattattgctgaactttgtattgcatatgcatgtaaaatacattcgtgtttgctgcaaggtgtatttgtgctttcctgctcacatgaaagatccgcctgttggcacatgctaaactgcaggaagggagcaaatgtaggggggtacttcatgtggtcactcatcgataattttgagtgggtattcggttacaccatcaagtttgggctgtaccatgtggattttgacacgcaggagaggattcccaagatgtctgccaagtggtatagagatttcctcacgggctccaatgtaacagacgatacccaagtgtggtcacgtagagcagattcttgaatattccgatacaagtagctatactacaccggggaactgttttaacagctcgagtggatgtccacccatttattgcatgtcatctaaatggttataaaaaattttgaaaaagtataaacaaaatatatcaatatgtaatatatcactccacaaacatgcaagttaaaattcaacttctacaaattgtaacaaaaataacaaacaagacttaaattaatatatgtatatttacagttaaatttattatttttcttacaacttatagaagtttaatttgaacttacatgtttgtggagtgatatattatatattgatctatcttgtcaatttttttaaaatatttcacatccatttagttgacatacaataaacaggtggacgtctactcgagctattagattccagttctcgacttccagtcaatacatctagcactggatagtagttttatacttgtttagagttgtagacccgcttgtgttgaaatgtaaaattggggatattgtagtgcacactaatacactattgcactactgtacagttacttcagttatgaacttgtgctttaatcaaaactagcatatatattttctctcatataatagcatatagtatgttttctcattatattattcaaatatattaaaatgacaacataattttaaattttgcaataactttacaaaactactaatatgtaatattcatattgtattttatatacgtgttagttattaattattttttatatcaaattttagttatttgtaaattatatatattgactagtttttcaatatttattttttttaattccgaattttctgtaaattgtatttctatatagactctatactcttattccaatattatttatttttatttctgaatttttattatttctaattatatttctatgtggactttaaactaatttttaatttcgaatttcagttacttttaaattgtattcctatattgactttaaactcttcttcccatgtttttcttaatttcgaattttagttatttgtaaattgtatttttatacggactctacactctacttttaattttattatgtttattccaaattttagttagttttaaattcccatatggactctatactctacttctaatactccttattttttaattctgaatttctatttttttcttaattgtatttctatatagactctatactctacttctaatattccttatttttaattccgaatttcagttatttcctaattgtatttctatatggactctatactctacttctaatattccttatttttaattccgaatttcagttatttcctaattgtattttatatggactctatactctacttttaatattccttatttttaattccgaatttcagttattttctaattgtatttctatatggacttatttttaattccaaatttcagttatttctaattgtatttctatatggactctatactctacttctaatattccttattttttaattccgaatttcaactatttctaaattgtatttctatatgtactctagtcccctcttctaatatttcttattttttaattccgaatttcaggtatttctaaattgtatttctatatgaactctgctttttctttttctcctattaatatgagaatttctaggccatgagagcgaacgtggaggttcctttttctattcatttaataatataatagatgctttagttccaccatgtgaatgcatgaagacaagtcggtggcctagactatcttggagcagcaaccgtggtaaaaaaaactgacacttgttactgcgtgtgtgattcataaacccccgattactctgttagcattagcacatggtgtgatttaatttgggcctgtttgatcaatgctaaaatatgcctagtttaaatagtaaatgtggtggtttggttgaagccaaatggttggtaatgccacagtcaactcgacataattcaagaactatttttatcataatataaagtcagctctcaattattatcaattcaaacacattcattttcttcaatgctacctcacaaaacattggtaataccaaaaattaacaagataatattatggtatgatactaaaccaaacaagttcttttttttccaaatgatgtccaaaggatcaaagattaatcgacttgtatccagaaaaacataatcaaggataatagtcaacagaatttaaatctctaatgctaaagaatctatgtttattcctttgataaatttcgtttgttccttaaggaggttgggggtaggaggccccctaacgaccaattgcgcgggctgggccgcaatgggctgccacagtggcatgcagaaaataaaaaggaaaaaagtacaccaaagatccctcaacttgtcattaagtttcaaaatcgtcattgaaccgcaaaaccggatacgacccatccctcaacttacagaaccagtgcaaattaggttacttagcggttttgactccggttttgtccgaggtggtatctgactcagcgtgagacccacgtgggccccacacgtcagcctattcttcctctcttcctctcacctatcttctccacaggcggcggccagcgggcgcatgtgagcggtggagcggcgcgcgggcgggttcgattggtcgtcggtgttggaggcggtgcgggcgagcaacgacacccgcgtcaccgaggccctccgcgactgtcggatgctgctcgacgactgccgcgagatctccagcaacaccatcgccatcatccagcagggcgccgccttcgccgccatgctcgacctccacgccatcgagagccacgccggcggcagcgaggtcgacgtcgaggatgacatctagcagtagcaccacgtggaccgccacctcgaggggtcagtacccgtcccgccgtgggtgtccgacgaggactggaggatgctcaccagcggcgaggaattcgttgtcgggctgacaccgaacgtgacagtggccaacgacggcagcggcgacttcaccaacatctcggcggcgctggacgccctgccggagacgtacaccgggaagtacatcatctacgtgaaggaacgcgtctacgacgagacggtgaattgaacgtcaccagccgaatggccaacatcaccatgtacggcgattgctccaagaaatccatcatcaccggcagcaagaacatcgccgacggcgtcaggatatggaagacagccaccttcggtacgccaccgtacaccgccattgactcatccattcatgcattgacatggacattgacatcggtgttgctggtgcagcggtggacagcgaccggttcacggcgatgaggctggggatacggaacacggcgggggaggagaagcagcagacgttggcgctacgggtgaaggcggacaagagcatctttttcaactgccggatcgaggggaaccaggacacgctgttcgcgcaggcctaccgccagttctaccggagctgcgtcatcctcgtcaagccttcgctcccgggaaaacccaccgtggtgactgcgcacgggcgtcgcgaccggcaacagaccacggggttcgtggtgcaccacagccaggtggtggccgctgcaccgcccgccgccttcgcccgcccgcgcgccgctcgcctgcgcccaccgggcgccgcccgtggagaagataggtgagaggaagaataggctgatgtgtaggggccacgtggatcccacactaagtcagctgccacatcggataaaaccggaatcaaaaccgctaagggatttagtttgcactggttttgttagttggggcatgcgtcgtatcggttttgcggtttaaggacgattttgtaactcgatgacaagttgagggagacatgaaaaaacattcaatttacctccttaagttaaggctttaactagtgatgggcccttctaatgggcgatcgatcgccagcgatcacgctgggcgatcagttcccccccctcccctcccccctctatactcctccctcttctccctccttcctcctccccttcttctcttcctattacagtacaccacacaaatttttttaaaaaaacaaaaagttagaaaaatttatgtatagaaatactatataaaaaaaatttgaattcaaattcaaatttgaatcgggtatataaacttttgttttataaattttgggtctataaactttaggtgtataaacttttagatgtataaaaatactatatatagaaaatatttgaattcaaatttgaatttgaattcaaattgtgtaaacttttgacttataaactttgggtctataaactttaggtgtataaactttagatgtatagaaatattatatatagaaaatatttgaattcaaattcaaatttgaatcagatataattcaaattcaaatttgaaacgggtatgtaaacttttgacttataaactttaggtttataaactttagatgtatagaaatactatatataaaaaaatatttgaattcaaattcaaatttgaatcggatatataaacttttgacttataaacttttggtctctaaactttagatgtgtaaacttgaggtgtataaactttatgtgtataaactttatgtgtataaatttactaaaataaaaaaataatgcggtgccaaaaaaaaaaagaaaccatgtggaggggtggagggagggaggggggagagaatcgatcgctaccctatccccatagcgatcgcccatcagcgttcctgactagtgatcggatcttatttgtacatcttaaacgtataaaacgggatatattgatctcttgactgtgtaaaacaacttcacgtgacagcctaggcatacggcccatatgctggccttgttgacatattgcgactgttagacccccccaacgacgtatggtgctctgcacgggctgggctgcggtgggctgtgatagttccatgcaatgccacgtactcctcgctacctgctgggctacacagcaaaacatcatcggcttccgcccttgcacactcttcggtggggtggtgacgcgcgccagtcggcagatcaccgggccgcgcgcggtaacgtggcaccacatcctgctcctcgccgatcgtccttgtaggctacagcgttcggtgggaggtgacgctgacgcagcgcaatcgccatatcaccgggccgcgcgcggtaacgtcgtaggcgacatcgttctctgtctgtcccgcactcccgccttttgccaaagcggcccgcgacgcgacacagcggagaggtgcaactctgccatcgtcgtcgcttctcaaggtttatcaatatctctctctcggcgcgtatagccgtcgcgcggagggacgagccaaggccacgccgcatccacagatcgagaatcgcgacggggagaggcgaggcaccgtgtgggccgccgggaagacgcacgcacgagatggcggcggcgtggctcgtggtgctcctcaccgtgcaccggctcctccacctctccggcgtctcggccgtcgaccgcagccagttcccgccggacttcctctttgggacctcttcttctgcttaccaggcacgacggcggaatccccactcgaccatgctgcataacaagtctctttctgaactctgcttcttcaggttgaaggcggatatttggagggtaacaaaggtctcagcaactgggatgtcttcactcataagcaaggtaaataaagcatgaaacttcaatgtgtttcctttcgtttgtgcttatttctgttccctttcttccccactatacaattacttttttttttcgagaacatgtggctatgaacttgcgattatatctttgttcactcatcctatatggttttaggtacaattgaggatggaagcaatggcgatacagctaatgaccactatcaccgttacatggtaacatctcaaaagaaccgcaaattgcaagattctttcaggaaaacaaaaggaactgcgaggaattattcacggataattattctgtagaatgaacttaatactacttatagagatattctaatgaatctttctatctgtttaactgcctgatactgaaaaatctctgctccaggaagatattgagttgatgcactccttgggtgtcaactcgtacaggttctccatatcatgggcaaggattctaccaagtgagcttaacgattcagcttatatacaattggaacaaacgatgtattaaaaaaaattcttgtcgctcagagggtcggtttggagatgttaatccggatggtgtagcattctacaacgcccttattgatggtcttgtacagaaaggtatttaaataatattacaaaaatcatatgttacaagctagaacaaaattttgagggagactaaacataagagttgttaactggatatgtaaccaggaatacagccatttgttacaatatgccactatgatatcccacatgaactggacgagcgatatggtggatggttgagtccagaaatccagtatgtattttgatgttccataaacattgattcattttaactggtttcttactgatttcttattattttccaggaaggacttcagttactttgcagaagtatgcttcaagctgtttggtgaccgaataaaattctggacaacatttaatcaaccgaatttgtccataaagttcagttacatggatggattttactctcctggtcgttgttctgaaccatttgggaagtgtgccttagggaattcttcaatagagccatacgtagcaggtcacaatatcatactgtcgcatgcaaatgcagtcagcgtttacagaaacaaatatcaggtacaaggcctacccttcagacaaaaggactacaaagtgattagaaggacaagaacatcaattgttatttccacacagtttattaaatattgaaagcaatatcaatctaatccttttaattaattttttattacatacaaatttcaatattctggtcatgttgctagggaaaacaaggtggtcagattggaattgctttgagcataacctggtatgaaccattccggaataccactatagatctcttggcggttaagagggctctatctttcggtgcttcatggtattatgcattcctttaatatgcaattgtcaacatggtgctaccttgttttctactaatatgttctgatgtccaaaagtgtttgccatgagaagtagtatctgatgtgttttggtgcaagtcattcacataaatagctcattcagatttcatcacaataagaaactcaaaggactaccattatgttgatagttgtacttgaagatttcctctgctatatttttgacaatttaacaagagaataatacaaacattcaattgacatgtactccgtatgtttttgcaccgttgcctgactttttttttctaggtttttagaccctatacttcttggtgattatcccacagagatgcgtgaagtcttgggtcaaagcctacccaagttcacatcaaaacaaaagaacagactgcagagcacaaaattggattttatcggactaaaccattacacgacatgttatgtgaaggattgcatcttctcaccgtgtgaaattgatcctgttaatgcagatgcacgagtatttagtttatacgaaagggatggagtgcccatcggtaaagcggtaaatatatagttatcaaaattctaaattgttttgcagacttggaacttaaagtaaacagcaattactagtagttgcactctgactcaaacagacaggagcgccattctttcatgacgttccacgagggatggaagaagcagtcacatactataaacaaagatacaacaacacaccaacatatatcactgaaaatggtatggctctctttctccctatgttgtttctatgagctagaataatcattagcctgaacttggtaggatatttgcgggtatcatttgagtagaatatcatatacttcctattgaccccatgtgtgcagtagtgcaccaaaaaagtaattaatttttacatatcataaatagctcatataccaaaaaaatgaaaatgtacttttttagtgtttttacagtaatatacatgtctttgaaaaaaatacaaaaatatatgtttgccgtgggatggtaacgtgggactgcgtcatggacacgcgataccgcgtcgatcccacagcttagagcaagtttaatagtatagccaactactagcttcaaatcatctatagccaatataatagccaattcatacaatatttgcttattatactattaatatctggtcctacctgtcatacacacattacgtcttgaagttcgtgctgtagctggctacagatctgtagctcgtgacgcttctctcttccttttatcttttaaaaatatgtttatagctggcttatagcctgctattgtacctgctcttagccatgcggcaccacgcgggcccgcaggccgaccgtgctgcactgcgagatgaccatgtgcgaccgagcctcacgcatgcatgcatatacctcacgcgtgcacatcgtatttcttacctcacgcatgcatcttggccgttgtcgcacggctagcccgcggtaccgcgtggtgccgcccggccagcccacaggaccaacacggtaccgcgcgtaccccgtgcgggattttgtgggctgttgtcccgcgttttgcaccgggccaaacactctgccccgcattgtatattttcaatatttttccatataccctcaaacttaccttcctaagttacttctagttattacttcttgctattcttttttattatgttgtgcacactgcacagtagtgcattatcaatttgtgaatcatttttttaggttactcccaagcaagcaatagcaacatgactgccaaggattttaccaacgacacaggaagaattacctacattcaaggctacctcatttccttagcctcggcaataaggtaagctgaataactctaagcagcctcttgctaagatttggcttcagacattgcagtagtgatgtgttgccatgcctgaaaatcaagttgtgtaccctttcttgtggaacaatttgaaggaaaggagctgatgtacgtggctactttgtatggtctctccttgatgacttcgagtggaattttggatacacgttaaggttcgggctctaccatgtccactacaagacactgaagaggacgccaaaattgtcggtagattggtacaggaagttcctcacgggttcactgctgaggagaaagttcagagatgaatctcagcttcataagtttaactcttattaatccatacatgctgttcttccctttccatattactttatgtaaagtcaatatgtgatgctttagcgtacatatgcttgtacttgcatatgttcgcaattatccatcctagaccatatgcatagagtataatatgtactgaataaaagggacggatttttgtgtgtaattcatctccggaagaacgctttgtgtcatcaaagacctttgccaatagataagctgagtttaaggggttcttcacgggctgtctatgcatttagggtgtgttcggcacccattttcctaacccctctccctcgttttccgcgcgcacgcctttcaaactgctaaatggtgtgttttttgcaaaaagtttctatacaaaagttgcttaaaaatcaaattaatccatttttgaaaaaaaattagctaatactttattaatcacgcgctaataaatcgctccgtttttcatgtaggagggattagttcctatcccctgaaactgaacacagcctagcctagttcatgctgtagttagggatggcaacttgggccatccccgacggacagtgaccacccgtccccgtccctgcccccaccgggattccggggctatgacgggggcacacaccagaggagaggaaacacggtgcagcactgtgcatcaatttgcgaatagagagaagggagacacgaatacaaattgagaaaattttggggatttgggagtagagaattagagataatggatacacaaagtcacatacggattgagaaaataatgctgaaacacgcacacaggtgtggccatttccattttgatgtggtaaataagagtgtaaaattactttggtagattttcttatgtcactctatactaatgttatagctctagtattgtaatttatccattataggtagaatttgaacattctacagttcagtaagcatgcaatctatgaatattgtacagcaatttaatggtagtaataacaattaacaaaagaacaaaaaaaacgattacataaatacctgacctctatcttcagatggtgattttgcttgtatttcatcagtggttgagagcattttggccattttgtctgcaagaacttggaatcatcagtgttaggctacactaacattgaattgacgacctgcattctgggcattagtattcaactgaagcattgccacagaacgaaaattcaggaaatcaaacaaagcttgtatctgagatacaataaaactgctgcattcgaaatccagttagtcatacctgcattctctggaagctgaatggcaacaaataaagttcaaggaatgtctcaacacatctgaaagaacaagtcaaaccaccatatgcaaggtaaggtgacagtccaggcagtgtactattcaaattattttgagttttttttttttggcccaaatcactctgtcttcgacatgtctcctttgatgttttctggatgctgtcaagaaaggtgttatttggagtttacagcaatggtttctgctcttcaagtttgtatgaatctgataactaggatgaaatgttgcatacaattactccctccgtcccattaaaaatcaacctagtatcggatgtgacatatcctagaactatgaatctggacatacaagatgtgtcacacctgatcctagattcgatttttatgacacagagagagtaggacagaaccagatagagaatagacatatcggctttcttataattgtatttgcaaaaaaaaaaaaaaaatctcaaagatccaaagtaaacttataaatctcattatgtgaaaattaaaccatccattcttttaattgaaatgccggatattcactaacgaagaaaagggcatttcagggttacatgccaccggagaatctcttacttggattacaaaaagcatcttcatgcagcactaactcttcatcaccacctatagctattcttcctgtgtgggagtagggggaggaggtgtcgatgtcgcaggtgcaggcgccacaaatgtttttgaaggttcccttaaagtcttcgggctcttctcgtcaacgacctccatagcagctctctcctttgccttttgggctctctgaattacttcctcctgtaatgccattatcccccaaaagaagaactcataagcatgtgccatgcattcagatttacagaagaatggtagggtgattataaagttctttgtatatgctatgcagtgatcaataattattagttgcaaaacctaagcaaacctggtgcattgtggctaaggctgtaaggcgtgaagatacattgtactctactccctccgtttcatattataagttgtttgatatttttcttagtcaaacttctttaagtttaaccaaatttatagaaaaatatactgacattttcgatacaaaacaaacatattatcaaaatatatttaatattaaatttaatgaaactaatttggtacaaaagatgttgatgattttttctataaatttggttaaacctaaagaattgtgactaagaaaaaagtcaaataacttataatcaacctgaagaattgtgactaagaaaaaaagtccaataacttgtaatatgaaacgtacggagtatacagctagctctctagttcccaattccctgattcataggcacaattgcaagcaaccacctgagttagggaaattatatagtttttcaccagctagatcgcatccctttccacagttccagatttacaggctcacgctttgctgcattctcatatgaggagttcccatcaagaggaaggagcgtggtgatgcagtacctggaactcctggacctgcttctgctgctcggcttgccactgccccaccacactgaacacctcgcccaccaccgactccaccttctcggtcagcgcctcggcgaaggccttcccaaggaagaaggcgtcaagcacagccttgctctcatcgtcacctacacggacagcaacagcaacacccaatcccacagttcagaagcgcctctctctttctctcggttgcacctttctgaccacacacaccaaacaggtttacctacctggtttgggccctggattggtcccgccgccgccgccgctactcctggctacgaatctggagaaccttctggcggagcacggggcggcggggaaggaagcgctgcggccgcgggggccgggggcgtggagcgagacccagcaggtcggggaggcagccgctgccgccggtggtgggagcggcgccatgtgtgtgctcggggtctgagccgtagttccgtggaattcctcggcttcgccagcggccgctagcgggtgggaattgctgaaacccctccggcaacccccaccggcggtcggcggacgcgcggcttggattggggacagccgggggaaatggagggattgtttctcggtagttcaggatttttttttttcttttgggtttcccgtccatcgagaaaactcactagtggtgggctccgactggactggcccatcacgcttgaacatttggcccaccgaggccttcacgcctgcccgtttcgtcctcacgctgcgtcgcccggagtaaaattcttggtcaactctctatcgtcaacgtcctcgcatcgcggatggccggccggtcaaagagcgctcgctcgctcgctcacctcactgatctcatccgtgctactcctgtctcgattagaattgccagagtaatcggagctccggttccgatccctgtccatggcgcgctgcggcggcgaaaggatggtggacgagctgcgcgacgtgctggacgacttcgcgttccgggccaagcggctggccgcgccgctgctgcagccgttcggccgcgcctccgaggcggtggcgcttgacggcgcggagatcgacgggctcaggcgcatccgcgcggcgctccgggccgccgaggagcgcgtggtcaccgatgacttcgtcaggctgtggctgcgggagctggaggacctggagcgcatggccgaggacgtgctcgaggagctcgagttcgaggcgctccgcgcgtcccgcctcgagcggttcaagctccagctcctccggtccagcgccggcaagcggaagcgcgagctcagctcgctcttctcctcctccccggatcgcctcaaccgcaagattgggaagatcatggagcgctacaacgatctcgccagggaccgggacgcgctgcggctgcgaagcagtgatgaggagaggcgacgtgagccgagcccactgacgccgaccagctgtttgacgaaatgctcccttcatggaagagagcgggacaagaagcaggtcattaag

SEQ ID NO: 81092 - DNA, 4569 bp, Oryza sativa
actgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggacctcccatgtccttgacaataacagtaatatccttctacttttcaacttatcttcattctcacaggtaagtcttgtaattcatcttctatttgtgctagccttgatgttaagtctgcatttataacggtactctcttgagtttctaaactaatcttaaattttttgcgtcatgttctataaactgtaattctatcgctagcatcttcacatcttccccaagctacatcagtgggttccttatatatatttcacttgcactgagttatttggaagaaggttctttctatcatttttgtacaattttactaaggtttgtgtttccatgttcctctcatgaattttcccactcgttaactatgtcttctttgatcttactgaagaaacattccaggatattcaaagatgcggaatgtatccacagactatgggagcctgagcatttttgtctttccaagaatcgacctatactctattgaatatggccttttagtatggcagctgctcatcatggtgctgggtccatagcaattcatttttcattttattctggctcatagtatgaacttgaagcgatttgtaccagtaaattatgacgtgcatagaaacaatgtacttattctcagacggtgaaactgaagagcttgagtagaattacttcacatgtgaaagcgagtactcattgtcctatagctgtaatcatattgtttgccttttctttttaagaagagtgttgtttggtttgttagatgaacttccaggcggtgcgcaaaggcgcgcccctagctctagttaagaaaaaagaaggaatttcttttgctgttttcggtggtttttgcgtgttacacgatgctactgaatattgctcagattggcaccaaggaatgaattagttgccaaaaattaactgtcgcattgtaaaatgttttgtctttgtctgaaatctgaagagttggcatttcttgactcacagtacgaaggtggcagaagaccaagcatccgtaacaccttcacacatcagcacctaggcatgttaactacatctctgttcacctttgcctgctagctgtgctctgtacagaattatgttaatcaagttcaatcaggtgtatttgtatatctacaagtataaaatttgtcctatttagcaacgaaaaacacttcaacgatgtaaggtagaaactaacaagctgaatacacaatgacacatatgatatcatagcagtatctgaaaaagagccctagaggcaatcatagagatgattgtatcttatactatgtttacatatttatccgatattgttccttgaaatagataattcattattagttaatgaatatgtgattctttcatgagactcttcatgttgtttgttactatttctaaagtatccctgatcaaatatcatatgtggaacaaatatatttatatgatcagcacatgtattaattgaagatcatgtctcatgtatcatggtatggagataccaaattaataatgtggacacatgttggtgaacatgttgttggatagatccaacatgagacactgcaagagccatatgtgttgtgtcattagtgatctcatttagtgttggtgttgaattcttagacctgagattatcatggttctcaacatgtgtagtagcttacttagggactgctaaacgctactctgtaattgggtagttataaaagtagttttcgggcatgctatgaaacatgtagtgggatatgaataatcaagatgggatttgcccctcctatggagagatatctctgggcccctcgatgttgtagattatgaaagtgcatggccatgccaaaggtgattgaggagtcaatcataagttatataatctatcaacaggttcgagtgaatgattgagctattagaggatggcacatatctagccttgagcttaatcaatatcgtgaggcaaatgggttcatacaagtatacactagaggttcagccgatatgatctttatgtatgcccggtgggtcaatacgttctgctaggggccgctgttgacgcgtggaccgaaaaggagttttcgggttacagccgagtatacatgaacctacagggtcgcacgcttaatgggccggaataaggggattggatggagatccaatattagcttaattcggatagagatccgaataggagtcctacgggccttggaggcccgagtgatggatcctatatattcgtgaggggtgtgaccggcggaggtattgcatcacgtgagaaaccctagtcgtcgcttccctccccgagcaaaaccctagccgcgcgcgggtgctagcacatctgcgcgtggcgttccgtccctgtacgtgtggataccggtagaggtgccgctggtttgcggtgctgatcagcatgggaatacggcgaggagaacgcacgaggaggagaaggtcgagccggtgcgatcgactacttcctctacatcgacgcgcgctacttcgcgagaattctttcgacttcttagcgcatttttccgctgcgcagcgcgtcgagtggtaacgatctatgatctaatatttgcatggttcctggtttacgcgatagaaaattttaatttatgctatcgtagcttacgcgtatcccaacaaaagaaacatgtatatatgtctattattgtctgaaatatgacaaatagtctatcatgtggttgtccttgttgataattcttctatgcaactagaccatcctgtcttttgccaatggtcatagctttgttatgagaaagattttactcttcctatgatagcttagcgagtatctagacctatcaagtttatgtcgtcaaacaaatttagttcatttattccagaatgtataggtcctatcagttgaacctactcgcagggattattcctgttgtcagttcactcatatagttatataataagtccaactcacaccttttgacatagttagataggttcaagaaatagaatattggctatacaatgtaccatgcaattttctgagcaaatctgatacagcttcataaaaatatggtccattttattcctcagagaaaaaaaaagtcttctcattttactatgaatattccttgaggccttgaagttagttattactgtgccaatgttgaaatgttcagtatatttggtgaatcatgatgctcaatttctctgcaaaccatggtttctgaattcttctctgagcactactatggttgagacaggttaaatgtgatgtaggagtacttcagcttttactatttcatgagttcaaaatataaattgatcattccagtgaagcatcctactatgctattctcagatgtacactacaaaagttcaatcgcgactccacttcaaactgaaattatcattgaagaatgaaaagcaaatgctctctttagctatcttttctgaaatagaaatgtgtcctttgattgaattataatcttatgtaacattttgaaacctccagtctggcagcatcatctctctaaagctaacgaatttattcactattccattccattaatctggtttcacttttttacactgaatcactgatgttgttaataatcttcagcaaaaagagatattctacagctctgtaatttatctctgcctgttggtagcactctgaagaatagcctgagtttatcacccatcattaactctctccgttccccctgtcttcgttgatgctgctatattgaaattgcattttgatattggttctttgacaactgtggagcagatagcaaattaccaagagaagggcagctcattccagatacggtggatcggtgacactatagagcccattccagatatcgtaactaatgccatggcagaggtagatatcatacctcttaatataataaacaccagttgtgcagcttcagaaatttatattgcagtttgtcaagaaaatagttaaatttctaattgagaaaagaagttttgcattgcatggcacacagttcttatgcttcaatgtaaatgattcagtcaagctagctgtgcatcttcctatagttcattttcaaataaacattgttctttgatgggtctattataaatgcagagaacacatgctttattcaaataaacaagat

SEQ ID NO: 81093 - DNA, 4912 bp, Oryza sativa
atcatgttggcagtctacttactattttggagcattttaatgaacacaatatattggagtatttttaaaatgaaattcccgagtctaggccactctgctaagaacactaggccattcaccgtaatggcgtggcaaagccatgccaagttttctagtgattgtactatgggaggaacacatggtgaatttcttggtcactttcatgtaagaggtgatggacaaaatttgtgtgattaaccaaaacaatttttgcatttaaaataggtaattgtatcataatactaatgataatcaagacggttttaaaatactattgcatatttacttaaagtgttgtagtggtcacaaagtatgtgatctcgcttcaaaatatgtggagtcatgtggagactggtcgtgtgacacatggatgatatatagcgcgttgactcttgagtgaaaaattttattacaattgactttttttatctcaaacaaatattaaagtgaaagttttggtgattatgatgtcaacaatataaaatatatcacttgtctgggaagtatacgtgtatcttaattttttttggggcatttaactatttgtcacttttaagatgtggcaaaaaaaattgccacttgctgtctatgacatgtgggccaccctgcgtttatgacatataggcttagtgacaaattctttttatcacttgtaagattggtaaatagttaattattcttttttttcagcaaaaatcaacttggtggatcagcaaaaatcaacttggtggattagcacaattacaattacaaagaaacttaccgcacctaaacttggtatattgctctctcgttccgaaactaccgaggagagccaaaatctctcgtttactctctctcttgctctctcgtttcttctcccccatctcatttactcctctcttggttggagggagtttttagttgggattaggagtttagagggatgaggctattaaatgtcttgtttggttaggagacataagaattttggtgagatggagatgaggaattgaggaaggaactccctccttttcaatacctgggtaggggtaggtaattgggagaaaattcctcctttactttgtctaagtaaatctcgaccatccgtttttattaatgatctaatctccaactaaactccctatcaatttccatcacctctaccaaacaagatattgagattaaaaatcaaattctcatcttaatttcatcatcaattccttcctgtaaactcccaatcctcttacctcgagttaccgaacaagccgctcgtttactctctccattcctctcccttctcacgctcgccctcaccagctctccgtcattccgcctcccgttgaccggcgctcctccacatctcctctccatggtcgcgtggatccgccgtcggcggcgacggcaggggtggatccaccgagctccatcatttgtccgcccccgctcgcgccgatccaccgcctctcgcgtcggcagcgacgggaggggtggatccggcgacctccgtcgtctctccgcccccgctgacgccgatccaccgcctctcccgtggatccgccgtcgacggcgacgggaggggttgatccggcgacctccgtcgtctctccacccccgctcgcgccgatccgctcgggctcgtcgtcgcgtcgtttgtgggctgcttcttcacgtccgtcgcctcgctcatcatctccaagctgcatccgccgtcggcagcgacgtgatgggcggatccagctcatcccttcagtcccaactctgtctggtgagcagccgatccgcgacgtttagatctttgctggttcttttgcggtgatcggtgacggtgagggatatcttttggttcttggttcttgcagggtgtccaggaagagaccggcggcggggagggccagaatggcggcggtggtgagggcggaggcggtggacacatccatcagcccaacgatgagggcgctccggtcgtccaagaacatggccatcacagaccaggccacgacgttgcggcaggccggcgagctggtcatcggcctcgctgcaggggagcccgacttcaacacaccggcctcgctaccgaggtaggtgccttctcttgctcccgagagaaaatttaatcctatcgaaatcatgatatctgtatccaagttgtgtgttgtaaggattgaattgattcacatttctaccattcttaattgtactctaattcatgcactaagtccacaaaagctcaaatgtttgtttgtgtataacttgaattggccgattttggcacttgcagtgcagcagacatctaagtaagcaatacctaggtgtcagagtacttgtgttatttcttatactgacaacctataaaaacacacacacacacacacacacaggcaactgttgctatttgtatgctaacttctagggaagaatattttgttttacttacttgctccctcttgttatacatgtgatgaatccttttttttatacatgtcgcgaagcagacggagttgggtttagatctttgctggttcttttgcggtgatcggtgacggtgagggacggcgccctccctggtcgtgggaccatgcagagggagacaggaggtattgaacccgaacctatcttgggccgtatggttgcggtcgaagattatatttcttgcggttttcttcctccaccttccgaatttcttcttctcgttttgaacttctatggcctttctttgcttcacttgaatcccaattccatcgtgttccttagcattttctcttatctttgcgaggcctacattggggtagagcctttccttgatctcttccgcttttactatgagttgcgctggatggaacccaacagggtatctggatgtgttgggttccgacttcgagatcgcctgaagtcgcgttacatccccttccggtgcccctcttttcgcagcaaatggtgggcgagatggttctatatttagatagaaaactcggatcccgtccttgttgtccctgaagagcagccagacaaaatcccagagtggaccgccaaacccgccctgactccctccctccagtctttcatcgacatcatcgatgacctccgaacacaggggttgtcggggtacgaagtcgctgccgacttcgtaggtaggcggatccaaccgctccaggcccgcgcccatgcggcctttgactactctgggctagaggacgtgacccgggtttctcctcggggtattttttcttgcatttcgaattttacttcgagtacgtctgtttctcctggcttatcgagttctcgtcctcgatttacaggtctggacagcgacaccgtgggacagcttgtcggccaggtgatgatcagcgctccctcagcggcgagcgacatcccggtccccctttgtgagaagggtccggtcgaacgcgtcgctgcaattaatgtaagtgtactcgatgactcctttacatccttctcctcgagatcgcgttgtgacttcacgttatgtaggttctccctctgcggacgtcatcggaccactcgcggaccaccaggcagcggcgtcattgaaggagggcgtcaccaatgaggcgtccgacgttgcagctgctgctaccacgagtggcaacaacgttccgaggaaggggaggaattctcctccgtactcgggacccgtcggaaggcgccaaacccggcggtgagcctccctcttgttttttaacgtgtagtcggagtgactggacctcacaccgtcgtatcttacttagactcggacgcgtctccccacctcagcgaaggcaaaggctagtgactagtgacgatcggcgagaagtaagtagacgttcttgaagtttttccattcacgaaatcttgatcacctagctttatgagaaagaggaaactcttcatagggcggcgcaggcgaaggcggcgcaaggtgggaccggtgcggcttccagtgcgtcccctgcagtgacctcgacagatgtagtggtcgctactaaggaccgggaggcgacgtcgagtagccccgccgtcaaccttgtgtctgctcggggcccgtccaccgatgccctcacctggggggagctccaggcggagatggagcgcctcctccaggccggtgctcggggcgtaggccgcgaggtcgaggaggccagggcggcagcgtcgtcagcaaaccagcgtgctgaccagctggtacgtgacttggcggaggcccgtgaggacctcctgaagatgagggagctggtggccggcaacgagaggcagcggcaagggctcgagcaccggatgttggagctcgagaacaatccgtcagaaatccgatgctcgctgcgggtatcgtacaccagcctacaccagctcgccggggaacgtggtgtcacgactaccagctggcctgcaaaatttgcacatgaacgtactacttgcctatagatgatggtggtgtggccgtgtgggcaatattgggtgcatatgaaaatgctgcaagaaaaaaaaagggtgccctttataccgatcaagaaaaagaagtgcattttagcttgatcaagaactaacccaaaagcaggctactcgtcaacactgtttcactccctctcagtgatatgtgttcatgtctattcggccagcaagcacattgcgttcgtcaatacatgctgtcactgcccttttgatcgcccgcagaagagccaccccagcatgcacgcagacaacaagacaacaacaagctttgagttgaagggaaatccagattatatatttgatattagttaattcagtgtctcaaaaaatatcatcaactccaatttgatgaccaaaaatcctctgcaaaactgataattttacaaccttgatgctacagatcaaataacaggactgaatgtgccctagctccaaatatcacaat

SEQ ID NO: 81094 - DNA, 531 bp, Oryza sativa
ccgcttcgcgcgtaattcggccgccgtcctccatgaacagtcccaccgagttatctatttacgtttaggcctctggtgaatccagttattgcataggaggaagggagatgtggcgagttagggtcgcgctgtaaaacttgaaagacgagggtctttttcgcaaaaacgccgtgcacctgcccgccgctgcctgctcgtctcctcgtccctcccgtcccccgtctcgccctctccctctccttctcccgcctcgcgtcgccgccgccgccgccgccccgcgcgccgcccctcctccctctccctcagccatcctcctcctccgccgccggtccattctccgcccttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcaccgccgcggcgttcgcggcgtaggcggcgggggacgggtgc

SEQ ID NO: 81095 - DNA, 11815 bp, Oryza sativa
caacacatctacaatgatgaggccttgagatccaagtttgacatgaaaatgtgggtctgggtgtgccaagagtttgatgtattgaagctcacaaggaagctcgctgaagaagcaacggagtccccttgcggcttcgctgagatgaatcaactacatcgaatcattgctaaacggctggagggaaagcgattcttgcttgttcttgatgatgtatgggatgagagtctactccgctggacaagcttgctggttcctctaaaatctgctgcacctggtagtagaattgtagtgacgactagaagtgctaaagttgctcgaatgatggcattcaagatacaccaactggggtacctcactgatactacctgctggtctgtgtgccgaaatgctgccttgcaagaccgtgatcctagtattattgatgacggcttgatttctataggtaaatctgttgcagccaagtgcaaaggcttgccattggctgcaaatgcagcaggaagtgttctatccattgcaattgataggaagcactgggagactgttgagcaaagtgacttgtgggctaacaatgaagtgattgatcatacccttcctgctcttctagtgagctacaatagcttacagaagcctttgaaacattgtttctcgtattgctcgctgtttccgaaggagtatgtgtttagaaaagacaagctggtcaggctatggttggcacaaggctttgctgcagcagatggagaaagcgatgctgaagatattgcttgcaggtactttcataacctcgtggagaggttctttcttcagcaatctccatcttatgaccataacgagcaaaggtaatgtcacttattttccaactccaaaaaaccatgaactattaattatgtcacagggatgtgcaattatgcatgagtgaccatcctttggttgattgttgaaggaaagttccacaagaaaatattactgcattgttattttacctttatgctcccaaggataaatatgcaattattcatggcatgcacaaaaattgaactggcatgcaaattaaactcaatgttagcgcactccattttatgtaccattcaaatactcaaacatcactagctacaccacataaatgtctgtactgcttacatgttattttgcaatctaaaatagaaatttggcactgaattcgacatggtgacttggtgaatgtcaaaataatgctgctaaatatattttaattttaatatgggaagttaaaagtaaagcatggaagacttggtttacaaatctaacttgaaatgtttcagtatgcatgctttatgcagaacaataatactagagacaacaagaacttctgaagtaaaaaattgtaattctgcatatgcacaaccaaacttgatgaatggatatagaattggtgcagatgtgccgtgttaccaaagatattcaggaaatacagcatgttaagattgctataaatttattatttttaataaaaacttatgtttcatttttctgtggtgcttttattagtattctccttgtaataggtgagtctatacatttttttcttgaaatttccgaattgaatgctttttatggacaatgtcacataagtgccactattatgtagtggagtttaaaccttaatattgctgctattatttccttagtggctgaagagtagcactgcaagagctcacactttgatagccttccatattttccatgtcttaatcccagtggtttgatgaatatttgtattgatggctattgattattagatgaaaagctcctatggttataactagatggatggccttaaacaactactaatgttggtcatataaacattcatttctggttaaaccttttcaggcttcatgttagttaggtataactcattttaatcatattcttgcttcatgggtttatgctgttttaagatccttcagaaacttccataacactgattatactaacaggtatgtcatgcatgatctctaccatgagcttgctgagtacgtagcagccgatgagtactctagaatagagagatttacattgagcaacgtaaatggagaagctcgccatctatccttgactccaagcgagactcattctcatgaaataggagaatttcatgcatccaataacaaatatatgaatgaatcccaataccctggcctgcgaactttgctggttgtccagagaaccaaacatgacgatggaagaaaaacttcgagcatacaaaaaccaagtgttctgttcaaagcttttgtatgtttaagggctctggatttgagtaatactgacatggagggcctgccaaactctattggggaactgatacaccttaggtacctcagtcttgagaacaccaaaatcaagtgcctgccagagtcaataagttctctattcaagttgcacacgatgaacctcaagtgttgcaactatcttagtgagctgccacaagggataaaattccttgctaacttaaggcatcttgaactaccacgcatagataactggaatgtgtacatgccatgtggaatttctgaattaactaatctccaaacaatgcacacgatcaagttcacaagtgattcaggaagttgtgggattgctgacttggttaacttggacaatcttagaggtgagctgtgcatatcaggcatagagaacgtaagcaaagaacaaattgctacagaagctatcatgaagaacaaaggtgaattgcgtaagttggtactccagtggtcacacaatgactccatgtttgctaatgacgcatcatctgtgttggacagccttcaaccccaccctgctctggaggaactcattatcatgggcttttttggtgtcaaatttcctgtatggatggggagccagtgctcgtttaaattgtccttcctagagctgaaagattgtcggaattgtaaagaattgccatctcttggtctattaccctgtctgaaacatcttttcatcaactcactcaccagcatcaagcacgtgagacggatgttatctagcggtgatcatactagctctggtgattttcagtccaggattgcttttcctacattggagacactgaaattcacagacatggaatcttgggagcattgggatgaaactgaggctacagacttcccttgtctccgacaccttaccattttgaattgtagcaaactaacggggttgcccaagcttctggcattggtagatctgcgaataaaaaattgtgagtgtctactcgacttgccaagtttcccatccctccagtgcattaaaatggagggtttctgccgtgtcaaccatttgttgcaactccctctattctctcagcttgagatgctagaacttcggtgtcacaaaaaactcgtatcgctgagaaaactccagcatatttccccatttcacagtttgagattgagaaaagaactagtacaaaaggtatcaggttgtgaagtgttgccattccagaatccctctgttcaagatagtcaggtatttgttctttctcaagtagaaatcaaacatgattgctatcaaatgttgcatactctaaagcattgcatgctttgtggttttctgtgcatttcagaaaacttggacatttttaaggtgtgccgggcaaatccttgaatgtaatgttgttgcttgtactgatcttaccttcggccagacgaatgtccactcttctgaaggtagcttacatttttctttcttgttctttattgccttccaccattttcgaaacttgtgtgctgatggcacccaatcatgttcaaattcgatccatctaaagaatattgctctgatcgacttgtatgtttaatatgtttcagaggaaatcggcaatggtgtaatattccacataggacaggatgaagctgttgagcttgtatcctgcaaaccggtttgggtccaaataggccagccagaggaggttgagattatttgcatagactagctattatgaagtcagcttgatggtcaaatcttcttgtgctaaacctggatactgcttgtaaagtcaatacataatagtttacagtgtgatcctacgttgcaacttgtggtacaagattcttgaatgatgttgttaaacatatagtagatgctgattggatgactcataagcctttgaagctggagtcatgagtaaatgttatcaatgaaactcggtcagatggtgacatggtggtgtggaggctgttttctagtacatttcctatgaaatatatttacgttgttctgaggaataatgcatatatgtactggaaaaaatatacacggcaacactctatactcaaaattctcacttcgatcgatggaggataatatttgactattcgaaatctgtagtgatcaatcccagcaaacatcgcccaaaggaatgtaatatatagcccgtttcaaaccaagattgacggataaacttacacaaacccataataatagatataaaaaaaaactcgggtacttttatcatgattagatgcatgacaataggacatatataaaactgacgcagaaaccacatgtttacccttacagctgctccctgcagctatttataacaacaacttagatatgtcttcctaaatgtaggaagagcactggagacggttcgcctgcatctccaagagcttaatttgtttaaacatcagaatgctcaggccaacttatctgctgaccctgcgccgcgcggtttatcatgcccaggccagtctcgagctggaggagcacgcgctcgtcggcgagcagctccggcgtgaagagatccttccacgactgataccacacggcggccttccccgggatgggcctcacttccgtcacaaacgggtacaccgcgtacctccatttggcaaagaactccgactccagaaccggcaccatgtacctcgccggaactaggagcgcccacctcatcaccagagggaatgtgttgctcccaccccatgtcctcgtcggcgagatcgtcggatcccgaaggctcctgctcaccaccggcacgacgtgccgctgcacagtcacaaactcgtcccacgtctccgggtcgaacacgcccttccactgcgacactttgccgtaggcgcatcgcgtgacgtcccgccccttcatccacctcccgagctcccccgctatgtcgaggtataccccgtgtaggcggtcgacgccgaggtgagggatccacgggctcacccagacgctggctggatccacgggctcacccagacgctggctggctctgtccaccacgtcggcgaccagctccggcatgaccaccttctccaggatgatgaaggccagcgccgatggcgggagggtgtctttccacgtctccaagaaccggagcatcggctcggggttgctgagacgttccacggcgactcactcacgctcggcgggacgacgtacgttgtcgatgagcatcgcgtacgccgacatgcccgccgacggcgcatcctcctcctcttgcagtatgttcctcagcgactgcaccaacgccagcgcccaagctggcctctgcaggatgtcccagcgtccgtcctgtgggcgcagcagcgggcggagccacggcgccgtgaggtgagccgccgtttgcgcgagctggaacgtcccgtacgcctcggggaacttctccttcaacccctcgaactcgcagatgaggccgcccagcgtgagcgtcctcgacgaggtctccccccggatcaccgccatggcgctgacgatctcctcctccgccgggaccggcccgcggtcctccccgtcgtggctcgacagcaccaggcgccgggccgtgctggcgctgccgctcgcacgaagcgtcttctgcgcccgcttggcagcgtaggcggcgctctcttcgcgcagcgtggcgagtgtcctctcgatgtcgagggcctcccaccctgcaccgccgccgacctaccgtgcgatccctcgacggcgccgagggcggcgttcctaggccgggaggtcatctcgatgggatcgatgcgcctaggcgcctagctgagagactacgggaggaaaagggcattctctaccgttggataatgccccttatatagggaggcggcggcgcgaggagagccaagcctaagtggggaggcgcgccggcgccaccgtggcagcgcggaaaccctagcggctagcggctcaggttaatggggcggcgcaagcgccacagctgtggctgtgtggcaaactggcaaccctaacaagcagctgatttggaaagaaacaccgaaacaggaagccattcaaaagcgtacaggataacccaggctggcgaggcgcgggaagaaggataaggcgcgcgaggaagagggaatatagacgttggcgacgggaaactgtttaaacacgggtgaacgtccacccgagagattagaatccacctcccgttggcgacgtactgtttaaaatctttccaaatttcttcggttctccaccctggacggtttcacattttgaggttccaaaaaggaaccattagaaaagatatcaaatgccgtcgcgattgattttcattagaaaccaaaattaaacaactatgttattaaatattatatgctctatctacaagtacaacttgcgtgctttcctgattgctgctacgtactatttcagaattttacaattagtttctggcaaaacgtctcccaaaaattatttcatatgtattttcaaatcaaaagcaagtcaaaatgacattcatagacatagtatagacataacaagcaaagaggcaaaaaaaaaactgaacttaagcttcatatcacgattacatgatagtagatgcctagatggcatacatgaattgacctcggtaaacacaatatctaacacatacaagcttcttactagcaggggctcagcatctcgaactcgtataggcctcagcagtttatgttactaatgctccggcacgcttatctccaatccctgcgtcgcgcggttgatcatgtcgaggccggcctcgacatgcacgaccacgcgcttctccgcgagcagttccggcgtgaaaagccctttccacacttcataccaagccatcgcctcatccaaccggggcctctcgcccattaggtaccgatagttggcgtacatccatttcttgaagaacccttgtatcaaaagtggcaccatgtacttcaccggcacgatggatgcccacctcattacaagagggaagaagttgttgttttgtagccaagtcattcttatcgagatctcgaggtcatggagagccttcctcagatgaggcagcacgtgccgctcaatgtgttcatcccagctcgctggatcgaacacctttttccatggcaacgcaagcttgtagtcgtactcagagatcccaccgcacagccaatctctgagccgcctgcttataatgtacactattcgtaggcgggcgtggctgagatgaggaatccacatgcccacacagacgctcagcttactcggcctcgtcagcctaaacacgtccgtcgcggctaccagcgtcggcaagatgacctcatctaggatggaatccatggtggcttgcggaaggaggcccttccatctattgacgaaccgtagcatcggctccggctcctcagcgctccaccaccacgcatccaagggcggtgccatcacgaggtcgtggatcaggcgagggtacgccgccgatgcgtccgcccccagcttgtccttgagcgcttctaccatgacaagtgtacggttcagcaacggctgcgtgcctccatactcacctgcgttgtactaccagctcagctgcgagtggagcagcggcgccgcgaagctgatcgccttgtacggcatacagtttgtcctgtaatcctccaggaacttcgccttcactcccgcgaactcgtggatcaggccgcccaacgtgagcttccctgactcgttcagctcccggaccatcttcaaggcacgcttgatcgccgtgtacctggaggccatcccctcccagtcgtcggcggcggtggcgtgtttcggtgggcgttgcctgcgcatgttataggctcgaaccttctcgtggcgccgctcccacgcccgcgcggcggcataggcttcacgctctctctgcagcgtgtccatggcgcgaacctcctcgacgtcgacaacggcttccggctctgcttcgccggtgccccgctcgagcttgggctctacaggcggccccgtgtcataatccgagtcgctatcgtacgacgactcgaatttgccaacgcctcctttcccatactttttggtcgggttgatgggatcgataatcccgtggccgtacttgccaaggccggtgccctcctcgtagttcatctgagccatcaaccttgccactatctggttggttgccatgctcccgggctgcggcggcaatgggggatagtaggaattgcagtaagcgggaggggaaaacaacgattgacaatggtgatccgtgtcgccggagctcacgcgcacaaagtggatggtgggcacgtctttgcttgcagccgccgcaatttcctgcacgccactagtcttggtgttggaggagttaggaggagtgcgatcagatgtttccaactcttggcctgcattagtctcgccgtgggaaagactaccaccttggtttctcccctcgtcaccgacggaggccattgaaataaccgaggccaagatcagcattgggtgaagtgtgcgcctccctgttaaggccggcctgtgttatataaggggaagtagcggttctgttctgattcggtatacagggaagtaggggctgcgcgatcctgttctttctcttccgaatcggaaagagacgcgtatcgggattcgggactctgttctcttccgaatcggaaagagacgcatatcgcggctgcccgtgccacgtccgcacctgtccactaatctgttagtctttgttcgctatctatggaaattaatccaaaggaaaatcaacccacgtggggtttgggttgttcccccacctgacacccaatccctccttgtgaatccccctatcgtccacttgcgcgggtggttagtgggattagcagggattatccctgggtttggatagaaggggattagaagggatcactaccattcaaaaataattcagaaatgataagaaaaaaattgatcgtgaaaacagaaaaaaaaatcaatgtgcaaaataactctaaaaagcccaaaaatagaaaaaagtagatttaccatagacgaattctgaaaaatagtccagaatattaaaaaaattcataattttggatagattaaattctacaagcagtaaaacatccaaaataatcatatgttttccatagatatgctagtcacagacaagagattgatttgtcatttacattgtctactagtatagcaatagattagaaattaagcgcatatatcgtcttccatgttcggccctgcatatactgatctgttgaaacagtacaattagagactcctaaatctgcagttctgctaattgaattaccattatactacgaataacagttctgcaggcaaaccccaaaagaactgacgaaactaaaactagtttatcatcaagcccttgaaaacaaacttttccttgtctctgaatttttcccaaaaataaagagagtttggcaactaccaccatcagcttccaaatccatcaaaagtcctgtctcttaatcttaaaaacctgaaaaacaaacaggaaacattatggacacctgaatagtcatatgaaaatttgtttggaaaatgacaattattctgtgttaatttggaaaaactaaaataagaagtgagttatcatctacaattctgggaaaaaaatatttttaagacaaggaagaaggtcaggcatgattaagcctagtacatatactcacaattttcagtttttaagcactcaaccatacttgctatagaaaacaaggactatttggacatataaagtacttaccctgataaacatcatctctacttgtctttgtctgaacgtaccagaaaaccagcgtctcatttttcatattgttcttccctgaaaggttaatctttgaatataagcacagaacttgcaatgccaacagttgcaatatcaacacaaatgagttatatgtcgatttgtccacagttctgcactacatatagtaataattgagctagtcaatgatattcatgtttttgtcatatctgtgagaccatgggcagtggcagcactgctgaatgtggtaaattcatcagatatatcatataattattaattatattcgtgatagagcaggtagctccttggaaaaagaaaagtatgcataatacctgttatatttgtgtttcttggagtatcaaccaataatgtaggacctgtccagcaaagaggaaatcggtcaacttcaaatatctataactacctgacaaattttcactcaagtttcatttgcaatttcctttggaatgtattacattacagagagtgcatttctaaagaattgttgaataggcatttcacacttttcacagctattatctcacaaaatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaattcacttgatcctgccaactgtcagtatacaaagggagatcgtgcaaaatcagaaagactggtttagcttctactcgctcatctaaggctttggaaacaaccgtgttgctctcctcgtcaccggaggagaagggcatagaaatttaccaggctaactagcactagaggatagatgagatcaatacgggttgtgtgcgtcctccccgtcgaggccgacactcttatataagtccgctgtagcgattgtcttctattcatattcgacgaggggacggtgttccgattcggtaagggattcggcgagggaagtagtggtgttccgattcggtaaagggtctgcagccgtcggattgccaatctacgatgtggtggaccttgttgtaatatgctggagtttagggtcttttttgcaaaaaaaacgctcaattcctatctccgccttctctcccaccctgccatggctgccgccgcctcctcttcatactctgctggtgcctctcctctccatatgcaccgctttggcacgcctccctccatgtccctagtgagagcactgcaaaccatcttcatctgaaatgttagtaacattgttcacagaatttacatacatatgttatagtttataaaatcagataagagatatgtgaattttgtgaataatgttactatcactttatcggatgaagaaaagaccaaaataaaagttatagatcttgatgatttatacaactttgttgttgatggctttttcagttgaaattatttagtatttgaaaatattgtttgaagttgtcatatttttaaattaaaattcaaattgttcaaaaaaatgttatatagaaaaataaccaaaataaaagttatagatattgatgagttatacaattttattgttgatggctttttaagttgaaatcatttagtatttgaaaatgttgtttgaagttgttatattttcaaattcaaattcaaattgttcaaaaaaatgttatatagaaaaataaccaaaataaaagttatagatattgatgagttatacaattttgttgttgatggctttttagggctgcaggaat

SEQ ID NO: 81096 - DNA, 7662 bp, Oryza sativa
gagagtcatccgtgacgggtttttgtgttggcccgattgagatgtgtgtcatccgtgacgcccggatgtccggttgagatattttctcacatcactgacctttgcttagtgaaggggccctgcccgaaagagatgagctttaagcccgttagagataactgatcccgttctagtgtgtacaccaagtttgtatatgtacgtattaaaaaccaaaaaaaaaaaagaaaagtgtaccgtctgctgcctccctctccgtgcgcgccacgtgttcaatggtgcacgtggaggagggggaatgcgcgtgactagccacgcattagcatttgcgtgctgcctcagctgtgtcgatctatcgtttaataacgcttctgcattttttgctggtggcctatgaaaattaaaattttcatatacgggatctagtgaaaataaggtaatttttacggctgtcctgttatacacatttgtaaaaatcaatttttatagacaatgctgaatttatagggtctcttatcctatatatctataaagttcatcccccgctgagtgtagttaataatatttatctcttctctcataaagccacattaccttaattgtgttgttagcctttggatgattcatcaataatgtaaattacatctcttcacgtcatctcaattatttttagcctttggatgattcatcaagggtgtaaaatacatttcttcacatcatcttatttgtttttagcctctggatgattcatcaaggttataaattgcatctcttcccccaaaaagtacaccatacaacccaatcatttctaacatttagataatttataaagtataaaaataaataaatacatgaaaaaaaaatcgaatagtagataagaaagaaaaatttagaactcatatctactatattatcacacaatttttccgcagcaacgtgtggggtatccatctagttatttttaaaggaggattcttttgaatccacctaaaaaataaacccatgtgttgggaaaatcgcttcttatagtgcagctaatcatctccattaaatattcatttgttatatatgctacaatttatttagatgacctggaaaatatggtatttcgcttactcatgttctacgtacgcacatgcctgatgcatattttacccttgatgtattgcgcattatatactggtcttttattcaaagccgtcatcattagttctaaactgaatgattaacatgactattattctactaattaatttcacgacatattttattggtctttttaaagatttgaacaaaaataataacctattgtttaaaaattatattttcgctggaaccctgaacctctgaagtcaacacaacaatatggttaatttctagcaaaacgtctctcgaaatgaatctaatacccatttccaaaccaaaccgagttagtcaattaaaatgacctgataccattcacagttgatataaaagacttcaagtttccttttaaaaagcaacaatttaagagttatatcactgttagtacgtaacatttttttaaaatagaattagcacgggattgtgctttttattaaatataatggaagaaaaaaaaacccaaaagcaagaaaagagaaaaaacatcatatacaacccccgcgggggactcgatgggtgagcgggacccgcacaaccagatagagttaggctgtgttcggaagtgcctgttaccaacacacacagtgcgtatagaaaacggagtggtacattagcacatgattaattactagtaattattagctaatttttttaaaaaaaatggatcaatataacttttttaagcgactttcgtttataaacttttttaaaaaaaacacaccgtttagcagtttgaaaagcatgcgcgcggaatactagagaggggttgggaacctagggctccaaacacagccttaatactcattagaaaggacacatcacactgaatgataatgtacaaatcacagaattaaatcctaggctattgcattggcaaatagcacaggacccatccatgagagatgtattggagtctagaatatcctcgttcctcactggttgcatgccggatttaacatcctgtcaaaaagaagtggttaaaaacggtgagaattaggactaagcacatcccttctttctataaagttaaggccaaaagtttaaacctcgtgcttccacgtcatcatcaaattgtgaaccgttggataaatatattagattgcttctcagacattagatataatgcagcatagagcccaacccatcagtcaccaccccggtgagtctcttagcttcttcagtgccaaatgtaacccacatgggcatatctccacacacatctatatgcatccagcctgtcaatccatataaaagagctttatggctgaacattccttcacttgacatgtgctatctaaattatgtacaaatttttgatagggctgctaaaaagaatttcttcaagaaacctatttgtttattttgtttctttttgagattatacctcttatctaacaaattgatgttaacaaagtcctgcagcaacgcgctgggcatcctctagtttgtagaacactggataccgctgcactaacaaggtagaaagccccacatcgtacccatgcatctgaagtcagcgtaggaggaggaggcagcgtggtactcagagaagcaggagggactcaggaattcaggaggacggggagaggtggctgtgggcttctggtgtcgaggtctcaaggaggacacaacgtaccgagcccaagccccgctcgagagcctgtgtcgaggtctcaacggagaaaacaaagaatgaggttggaggagagggggaggggggggagatgggaagtggagaaattatggtttacttcatatacctctatttaaaaaggccaaataggcttcaaggttctacctcatatcttcggagcccaccgggtcatccgcgagctggaatttccactcaaccccaacaagaaaattgtcacccctaataagtatcatagatattatcactgttggagccgtcgggaggagtgtcttagagaagacggtgcttccgacaccagtcttggtgttaaacaacttaagtaaccaatcttattttagaaaacagataaaacttatattatcatcgatgtctcaattagaaggactttaattctcgatccatcctacaaataagcaaagattttaaaactcaattatctggccatctacagaaatacggaggattttgggcttcccaaacaaactgcaactaataaagccaggtccggtcccacgtcccagacacctgaggcgggaaacaaaaacctacccaaaagatttcccccgctccactgacgggtgggcccatcggacgggacccagcgtcataacaaccgggtacacggcagtggcagtttcccctggccccactccacgccacagaacccacatcccaccatgacgcgcaattacctcattatcctctagattttgtggcaactagactctagcgaggatggcatcccttgtaattcttccgaaccttgagtcctctctctaaatctctccgatataaatatgagccggcatcccacagaccccttcccttctaccacaaattttttttccaccttccctctctctcttctctgctgtctctccccccctccatctgctttgctggcccctggcctgtgaagttacgattttgcccctggtgggccccacctttgtacatctccttcccttttttttctaccctttttgcagaacacatcgcccttctctttttccttttctcccatcgaaaccttttttttttttctgaattcctctctttctttgacggctctgactcgtgctgacgtggcacgtggcgaacgaccctcagccgtcgatatgtcgctcagcgagaagctggaggcggcacgtgtcgcggtcggcaagcgcaaggagcgggagctcctggctcaggctccggctaataaagctctagccgagccgggtactaataagccggctccggggccggtccccaacaacaagctcctagccggtcacctggcgcacgagttcctgacccgcggcacgctccagggccgccgggtcgagccgacgaagccgagccaagccgccgccttgcatcccggcgagcccgtgcccgagccggagcccgacgccgccaagcggaggaggtacgccgaggtgtcgtggctcctcatggcgagcggggcccgcgtccccggcgtcgtcaacccgacgcagctcggccgctggctccagataaaggagtgacgtgccggcgaccagacatcacaaccccaggtggttttcccccttttcaccggggagaaccgacacatcatcaaaccggtttcttcgttttctcctcctctttgcctgctcctcctgtttagattttagatctaggagagaaaaagaaaaaaaaaacgttggtgtactagcagctttattcgatgaaattattgttgttattcaaaaccaatgaccagaatggtccagctttctatagaaagcgcgatttcttgttagtactactactagttcgctacctgtatatcatgtgcgtgcaatgtttggtggttgtcatttgtcaagtactagtagaacggcgagcgtgtgcacgcacccgggacggtgaatcgcaatttttttatataactgttgattcgcgttgatgggtggatttcgcgtgctaccgagcgccgccgccctcgcctatcggtttcctcggcctgtgttccatggatgagacggcggctattcgcatgaagagacgcgtagaggcggtggcgcgcgagacgtgggggatgtgcccaacgagcatggcgccgtgcaagcggttagtggtggcctggtgggagttgctcctcccccatccatcatcgttccatgtgccctggtggcctgatgctgtttttagatctaaagtttgacgcaaacttcagtcctttttcatcacatcaacttgtcatacatacacaactttttagtcacatcattttcaattttaactaaaatctaaactttacgctgaactgaacacatcctaaaaacgcatgtgtttccagaccacaaccagacgaattattggagaattgttcggtgtcctccatggctgacggtgtacacggttgaagcatgctttggacgacgcgattgcagaggaggtgattcacgaaaaggacgcacgcacgcactacgtattattctgatctgaagctctctgcgagtaatttatttctgatcttcctctgattatttattcgggcaatcaggcaatggaaagggcgtaggggcagctcctcccgtattgttttccagagcaagattagttggtgtttgctgtttccatttgattgattggctagcattgttccaagtggttcgattcctgcacctgcctggtccattcctgccagttttaattgcatttaaataaatcggggatcattgttggttgggtaattgtctgaactgttcgttcatctcgtctctcggttttggtcaatggcctgcggagggcaatgtcaaatgtccaagcaaccgggggaattggatgggggtaagcaacgcgcaagatagcgtagccgtgttaagggaagacgagaaaggagatgcgtgtgatttacttggaaagcaaagcattcctcggctttgtttacaacatcgaagcatttctgagatcattttcaccaaatttacattgcgaaagtttagacgaaaatgcctacacgaaaaaaatctgggtttaatttttactttgtatagcttgtaaaataaaatatgtttgattcgacgctcccacagggtctgcatccgacgctccaaccttagggccctttgattcggagaaaagtcagccttaggttctgagtatttcatttggaggaaaaacttgatttaggggaaaaacaatcatattaaaacaaatgattgaatgatatactatcatagattttgaagaaaatttaaccaaagcttcaacatcttaaaaaattttcctttaaggccctgtttagatcccataaaaaacctttacaccctgtcacatcgaacgtttgaacaccacgtgaagtattaaatataggctaaaaataactaattgcacatattgtgatttatgtgcgagacgaatcttttaagcctaattgctccatgatttgacaatatggtgctacagtaaacacttactaatgatggattaattaggcttaataaattcgtctcgcggtttactgacggattatgcaattagtttttttattagtgcccgaacacccccatgcgacatcatatataatatccgatgtgacacgtcaaaactttacacccttgaatctaaacaccccctaaatctatatttttcattcgattcatatgatccaatcaaacaatcatttatgtgtcttatacttctctattttgcacttgctttactaccagaatcatatgtttcttttttttattactccgttttccctttgtatgtttcaagcgacccttaactcgtgaaaactgaaaacactacttatcaagtctagggcctcgttcagatccaaaaattttagccaaaaacatcacatcagatatttggacacatgcatagggcattaaatatgggaaaaaaaatcaattacacagtttgcatgtaaattgcgagacgaatattttgagcataattacgccatgatttaacaatgtgatgctacagtaaacatttgctaatgacagattaattagacttaataaattcgtctcgcagtttacatgcggaatatgtaatttattttattattagcctacatttaatactttaaatatgtatttaatatgtgtttgtatagctaaaaaattttacgcccaaacaacttaacaccctagacagatcagctttggtgtcttggtggttgttgtcacttgagagcggttcaattctgccaatacgacaggcgatgaaaaccaggcaagtgattgatacggccggtccgcttccatcggtcggtcgtccgcccatgacctgatcccgtctctcgggctctcggcacgcagccacgcacgcacgcacgcacgcatgccgggcacatctcggacttcgcgaacacgtggccgcacgagcacgtcgccgactgacactaaagaaggccaccccaagaggccgacgcgcacctcgcgggccaagctttagcctccggcccgtgcttctccaactcgctctcctccgcggcccggcccggcctgcctcaccacccccgctttagccggctgctaggtctaaggtcttcagtcttcaccctaaagccgcgagcccgcgacgtgcgcggcgccggttgggggcgcgcgcctgcgcgcctctctcccgcagtcccgcccgcccgcgcgcgcgcgcggcgctcgaaacaggcaatcgctttccccatccaaaaccagtccaccctcgcgccgcgggggaaaaccccgaaaaattttcttcttcccgccgatggcacgccggttcagacccgcgcccgcacgcggcggcatccaaacattttttttccagccgccgccaccccttccctccaattttcgagcgtggccacgcgtatttcagtggctccggagctagcttaattagcagtgcccaca

SEQ ID NO: 81097 - DNA, 17536 bp, Oryza sativa
gcaaagcaactatagatggtcgaccacctaaaagaatgaagcaaacaaacgtatgaatctcggtaactaaagattcacaaagaccaaatctaaagaatgcagtacatcagtaacagaggttgaaacaaaacagaaagccaacctcttatgctttttatcctgaaatgatatgctcaaggaaatctgagttatttgctaagaacctgcacaaattcagaaatacatgatagtgagaacctgcaaggctgcaacacacatacaaagggagaaagagaaagcatgacaaaaaaggaaaggagtggtggtaagaggcaagcaggcagccatctgaaacattgtctgtgccgctgcccactggtcaccgtcacatatgagaacgacttcataacggcggcaacgacagcaagggactcagatacacatgaatcctgtatggctttggcagtggagaggcacatggagacgaccttttttggccgcatacaatgctactcttgcttgatgccgtcgccgccggtcggagcggcttcaagcttccgtgcagcaccgtattactcatctcgccaaatctagcatggtgttggaatactcagagtagcgtgcaaccagacagagagaaccgtcgctggatcgacgaactcatcattgaccgcccaacacgccaaatcgagctgtgcggcaccggatagagcacctggtcatggagctccagcgcaaccgccgaatcaaggtactcgtcgttcgctgactgagcgtctcaccattgagctcaagccagcaacaccgatgacacgaaatgtctgagattggtgccacatcgccgccgccaagatcaacagatccagtggctctggatctatcgccgtctctagatcaaagagagagagagagggagggggagggggggaggaaggagagcaacaagaaagatgagggtggggagcagagatttccccatggagcttaccgcgacactgccgatgagcctcatgtgctagccctgcccttgcctccgggtgaccggatccgccggcaaggaggtcgtggctacccgaatccggcgagcacggtctaccctccgccggaactggcctcgcggtggcaagggggaggtgcggcgatttggctgggtgcaagaagagtggtcggaggcggaggcggatgcggcggtgtggtctagggagagcgagcgagaagagagaggtgacggaacggcggcggctagggtttcgtggggtgagggaccgggatagggatgcaagttgttgcagaaaacccccttagtttctatgttttcgagcgcagtcctattttctgttttttgcttctttgattagaatatttcttttttagaggtcctatacgtaataacgtagaacgtagaaactgtataccagagatctaaaaccaaattatcaattagtttaagggcttttttgcaaaatgatcagcgtcgggcaggcatggacgcacgatgggcatccaacgacggaggaagcaagcaacgcgcagcctccaaattcagctccggagaagggccggacgacgtgtcacgccccggcaagggccacgccagcggcaaacgctgatttgaggctcaattcttggcagctttgtatataagcgatttgtaaacggacccttagtctgctatatagagacagatatatacggagtactagtacatacaagatcgatacggttgatgcaggcatatagcaactgcaccttaaggcattggatcgagcaaataaaaggagatatctgtgcccacagtggaaacaaacagtaattgccacggtacatgtttgcagtgttggctactttcatgagcagtacaagcaagatctgcaccatacaaccaagatccaacggtggctaaagcaaccgctaaaagtcgcagttgctagttgctacagccactgtactttgatcctgatgattcacatatcatgcattcatgctggcctgggatgctacagtgggtaaacttgtggcatctttcaccgctgccatggtcttcgtgtctatgcaagatgacttcataacgaaacggcaacagaagcgtgtgatggcctacagcaattaaggcctcacatgacgctgcgttttgtacttgagctcccagcgctggccatcttgatctggccgtttaatccactcgctactggtaaacggtagtaggagaatgattccatattagtgtatcaaatgatgatcaatccaacccggtgatgaacgatcgatcgtttggtgattttgttgcggttgaagtgctctcggaggttcagagttcaatgcgtaaagccaaaattgttttcgatcctctcaagaaatcatgacgatgatgcgacgcgtttaactagggatcgcactgccggaaaccatccgaaactgactgattggcaccttgtaccatgggatggcactttatcagaagttggttggcacaacgaacgatctagaaacactttatcgaaagcgaaaatttatggacgataggcaatgacctgattcctattctgggctgtgtttagttgcttctaaagttagaagtttgagttgaaattggtacgatgtgattgaaaaattatgtgtgtatgacatgttgatgtgatgaaaaaaagttaaaagtttggatctaaacacagccctgatatctgaacatctgttccttttttttcttgaataacagctacctcgcccaaattcgacagaaacataagctgtgaattatccgcatccccgtaggcaagcaaatctagcttgctgccgtacaaattcactggaaattgccttttgtcctgatcgcgagcagcgcggccaccgcccgtgtcccacttgcaatttaatccgcatccgcgggcggcgagatggaccgaggaagaagtgaagacgaaccaaaaaaaaaaaacacgcatttcctgccttgtaatccaaccatcccatcgacgacgcaacgcctttgatcgtcgattgcttcctttctttccttgtttttctattgaattgcttgctttggctgagtttatttcctaactttttctttaaacatttaacctttttatcgcatcaaaatttttctacacacataaaaacttctaactttttttttaaattttcaattttagtcaaactttcaattttaacgtgaaactaaacacagcctttgtcgcagacgagatatcggagcggtcgacggcggtagttgcatatatactcaagctctattatctcctgcatttcagttaaggccgagtttagtttcaaatttttttcttcaaactttcaacttttgcatcacattaaaacttttctacacacataaacttctaatttttttcgtcacatcattttaatttcaaccaaacttttaattttagcgtgaactaaacacaccctaagggacgaggctactggctacgtacaaatgcacaggcagcacagtacaggtcactagcggcaataaccggtgacggtgacgcgtaatgcttttcttggcctgtcattcactcaggttgccggtgtgttcctcgacatgtagtcatgttgccgatctgtctaagagaaaagcagggagaatagaagaaggcaactcagagaccagagtacagcacggtgaaattcagagttaagaaggcgatctgtctaagaaaggggaacggaagatggagattcagaatttcagaagttattgaagtgttaagcagcatggtgaaatccagagttaagaagagatggcagttgtggaattcgaccaatgtagggtcacaaaagtcataactagtcgtaggtcaagtgaacatcagaataacatttatgctcacagttcatgttcatgctaacttcggagtagtagtactctactttggccctgtttagttcacaccaaacttctaattttccatcacatcacgtcacatctaaaatttttctacacatataaattctcaaactttttttttccaaactatcaacttttcctaaacttctctccaattttagaaactaaacacagcctttgttgtagatatactcatatctactcctactagtaatgtggctatgttttggtgtaaccgaaagatgatcaaaatttattgccctttttaccagctttgtgccaatggatgaggtggtgggcctggggattttcatgctcttcctttaagcttactcctctctggtctgcggtgtatgcatcggccgggcagccggctggatggcacgatggaattttagttgccactgccctgactgccagcacgggcggcaccgctgaattttgtttgtctcccgtgaaagcttgtacgtaatctttgctctacggccaccgtgtggcgtcacccagtcgtcagcccgtcacacacagcgtctgcagttctgcagtttgcgctagtaacgattggcccatttctcgggttacctgattcacgttttcagcaaggttaaaaatcaaataaattaaacttaaaatattaattacttttaaattattcagtttaaaaacactagaacctgatatatggattagtcttaatttttttaataaagttaaatattcattttttaatatcataatagaaaaatactgttaaagatatgttttgagcaccgtgttattgatcaaaccatcaagattatgaaatcagaaaagtaagttttagttgtagagttcaaaataatttactagttttagttgaagtgctccctctgtcctaaaatttagcaatcttgtactggatgggacacatactagatttgttgtactagaatgtgcccctatctagtacaaggttattatatttttgggacggagggagtagaaccgttaagtacgggttgacatgcacccatcgtcaacaccctatgacaactcaaagactcgtatcttttttgaagtaattgtacatcaatactcttttaaaattatacaaagaaaaatcacttccttaaaatagacccctttttgaaatatatgcagtcaaatagcaaaatataactccctaccactccctccgttccatgttacaagtcgtttgactttttctcagtcaaaatgtgttaagtttgatcaactctatagaaaaaattaacatctaaaatatgaaactagttttttttattaaatctaccattgaatatgttttaataatatatttattttgtgttgaaagcaccactatactctattaagtatttatctacaaactcagttaaacttaaacatatttaactataaaaagtcaaacgaattttaatatgaacgttgcaatgtgggctacaacatggagtgatcaattttgttcctgcatactgcaagtagtgtttaggggatttcatgatttaccgcactttagtcattgactcagaggggtctcatcaccgcgaaaatgtcacgtggagtagccatcaacaatctactacctccatttttttaatagataacggccgttgactttttcttacatgtttgaccattcgtcttattcaaaaatttatgtaattataatttattttgttatgagttattttatcactcatactttaagtgtgatttatatcttatacatttgtataaaaatctattatattattaaaggaatagaaaaaagagcctccacgttcgctctcatgtcctacaaattcttacattaatcggagaaaaagaaaaaacatagttcatatagaaatacaatttagaaatagctgaaattcggaattaaaaaataagtaatattagaataggagactagagtccatatagaaatacaatttagaaatagttgaaattcggaattaaaaaataaggaatattagaagaggagactagagtccatatagaaatacaattatgaaataactgaaattcggaattaaaaataaggaatattagaagaggagactagagttcatatatatagaaatacaattatgaaataactgaaattcggaattaaaaataaggaatattagaagtagagtatagagtctgacggagcgtggggctcctcaccgggagaccgcgcaggcccccctttgccggttcggccgggggcgctaagtgaggttcttcgctctcgatctgaggaacgtcagcgggagaggaagtgcacaagacacgggcgacgtagacaagttcgggccgctgagaagcgtaacaccctactcctgtgttctggtggatctgtatgtgaaggaatacaaagaaccggagagcgagagtgagttcaggctctagaaccccttccccagagtcccaaaacccccctttctcctaggcctgggcctcctttttatctggtcaggggtcaccacatgggcctctctctgcctaagaagggaaacatgctttttacaatgagggctagtctacagccggaagtgacctctgacaagcagagcacacgcctcctgccctgctcgcctgcttttccggtggacgcccctttcaaccttcatttaatggccagcgacttcattgccatacttgcgctgaagtctggaatggatctgaccgggactaacataccaactccaggagttagcacgccggctccggctagggacgagagccaggaaactctcatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcacgctcgtccaacctgctataaatgcggttagtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccttcgggcccgacccccccgagggggtcaggccacgtgggtgaccgcggctacccaagcctctagtcacgatacccccggccccatgtcaccgacagagtccatatagaaatacaattaggaaataatagaaattcagaattaaaaataaggaatattagaagtagagtatagagttcatatagaaatacaattaagaaaaaaaatagaaattcggaattaaaaaaaaaggaatattagaagtagagtctagagtccatataggaatttaaaactaactaaaattcagaataaacataataaaatgaaaagtagtgtttagagtccatataaaaatacattttacaaataactaaaattcaaaattaagaaaaacatgggaagaagagtttaaaaacaatataggaatacaatttagaagtaactgaaatttgaaattaaaaattaaagaatattgaaaaatgagtttacagtccacataggaatacaattagaaataataaaaattcagaattaaaaaatatattaaaagacgagtctagagtccatatagaaatatatataatttacaaataactaaaatttgatattaaaaataattaataactaacacgtatataaaatacaatatgaatattaaacattaatagtttcgtaaagttattgtaaaatttaaaattatgttatcattgtaatatattttaataatataatgagaaaacatatatgctattatatgagagaaaatataatgatgctagccgtgcaatctgcgtgggccatcatgctagttttgaataagacgaatgattaaatatataagaaaaaatcaacggcgtcatctattaaaaaacggagggagtatttggcttgataacacaacacagatagcagcacgaaatggaaacatactgtacaaagcaagaaaaggaaaattttgtgtgaaaagggtgcatcactcacacgacacatgttactgtcagttacttcccgaagtatactacagtacacttggagaaaaatacatgttatgcacggatgaaggaaaaaaaaatacagaaacaaaaaataacccgaagacacacttgggagaaaaaggtttcaaagacccagatgtatctcccacccgccaattaatgctccctcctcgggaccagcgtcatcacttcaatacaaggaaccaaaaaagagaagaagaagtaaaaaaaaaaaccttggaagaaaggcacagcagtacagcagccagcagcctcagctccctcgccaagcagagagcgcgaggaagaagaaggaagaaggcgcggaccgggatccccccgtcgggccccacatggccgcgccttgagccccgccccgtcccgcccactccggacccagggcaccgagatgccgccgcggcgagcggcgctgctcctcctcgctctcgccgtgtatggtatgttccttcaagattgtgtgtttcttttcttttttttttctttctacccgctgttcttcttgcccggccgggcgggcgatttcttcggggtttgaggttgcaatgcggagtggaattgttgtctggtttgtttcgttgcaatgggatcgccggcctggaagaagagcggtcatggctggctggcttgcgtggcacgttccccaggggttgtggaaagatggtttcgcctttgcttcatggagctgttcctcctgtgattcgtccgagcgcatcggcatctgaatccagtaggcgtggacatggcgtagattcccgtcaattttctccttttgattctcctctctttccctttcttgaatcaacccatgccgagtctgagaaagtttggaatttttatgcaaatctgttgttaaaaatttgctgcattggcgctgcccgcagcgattttcggtgggcttttactacgcttgatttgccggcttaaacccaccgcgtttcagtactgcaccagctgtagtggttggtgtgcatttgcctttctgttgtattgaaccgaaaaagttaacaagcttttggtgcaatgctcgattagtggtcaaggtttttggcgaggttcctgctgttctgttctcgtcttgcaatcttgcagacacatagttttcgttgcactctgcattgctcatctatagtaattttcttgtttttaatcaaactgtaattttgtagtaattcgcactcattcgtcctgcattatctgtaatatttggctgtagtttcttcaaaacaaaggccggaatgaattccattatctaaaaaaaatatatacagtggcgtgcaaaaccgtgtgagttactgcattagtattccagtttccactccatgaaacatatgttcattgtagttatgctgaagtaatagttaagagtatacagatgttatgtatcatatgaacagcattttttttgggtcaatatccttgcagtgccactgggaacggcaagctcaacaactatcgcgtcgtacttacttgggttatggagtagagcacatcggcattctcttcctgcccctgctccagctccagctccagctccagcccctgaaactcaccgtaagtagaaatactgttgaaatttgtacacttaaatagtaattcaggtgtaacatgttctgcaaacttaaatatttatttcatcagtattcttacattcaatgattttcttgttgtcttgaaccgtcttgtaattttgtcgatcattttggttctcaggacctggtattagacacccagtgcctaggcatcacaggaaaaggcctcatgttgccccaccactaccaccaccatcatcatcagaaagacaaggttctacttttctctactgaccaattgagattgcaaatcttagtattgttagcactgaaggacacaacaataatagacgcgtttgtgcctgcaatgtaacagattgcagtgggatttcctgtactgctccactcacatctactccaatcggctccccctgtggctgcgtatatcccatgcaaattcaacttgatcttgtagtagcaccatatcagttgtttccaagaattgatgagttagaaattgagattgcagcaggaacatttctgaaacagagtcaagttcggataatgggtgctgggagtagtcttcaagatcctgaaaaaactactgtcaccgttgatttggtgccactaggtcagaagtttgataggacttcagccttactgactagcaacagatttttgcaaaagaaggtgccaataaactcgtccatatttggtgattataacgtaatatatgttcattatcctggtgagtgacatatttttttgttgacatcaacttcaatagtataattcccagtattgctgtatgtaatcatagaaattttgcaggcctgccttctttggtccctagtgttccaggatccttgggcccaataagcagtagccaatacccctttagtgcaaatgtacacaatagaagacatcagaagattaactctaaaagtgttgccataattgcattatcagctgttgtgcttgtattaatgagctttggcatttgcatcatatggaaatataaaggatttgaaaagtctcgtggcactggtcgtgtttcgaattcgtcagccacaagaaaaacaggtaacttttggcagtcctggtacatatgctaccgttataatatgtcctgttatatccattttgcatttagacaccctctgttctcgaataactaatactgttgaactgttgactattggcatctcactttgatcacaaattacttttaaactatgagattacgatgaatgaaatttgtatgtttatacttgtgatgccacacactttgacaatataacatattttcaagtatttattttattttattttattttttgctaaaggaagaagtggtcaaagtttgaaaataaatagttccagtatcagttattcgagaatgcagataatgttaatttgcaagttcaattttggccctttttttgtgtgattcaacatgaatagtaaaaccttactttttgactgtgtaattcccttgctgtttgtataacatcttgtttctgtttcaggtatgaggtcatcattctccagtatgaccagctcgacggcatcttttgtttcaacaattgcaacatgcccacctacagttaagacattctctatttctgagcttgaaaaggccacagaaaacttcagcttcaacaaaataataggtgaaggagggtatggccgtgtttatcgaggtacaattgatgatgaagttgatgttgcagtcaaattgcttacaagaaaacatcaaaacagagatcgtgagtttattgccgaggttgagatgctaagtcgtttgcatcatcgtaatcttgtcaagctgatcggtatatgcattgaacggagcacaaggtgcttggtgtttgagcttgttccaaacggaagtgtggagtctcatctgcacggtatgtacacttatttagtctacaccattggcatataagaatctttggtacattttcagcactttcctatgcttcattatacattgttgtgatctgcatatttacttctgttttgatgtttcaggttctgataaaatatacggcccacttgattttgatactagaatgaaaatagcccttggtgcagcaaggggtctggcctacctacatgaggatgccaatccccatgttatacaccgtgatttcaaggccagcaacgttcttttggaaaatgatttcactcccaaggttgcggatttcgggttggcaaaggaagcctcagaaggaatggaccatatttctactcaggtcatggggacttttgggtaagtcgcattcttaccatattcacctgtggctattatatcaccccaaaacacactaaatttgtaaggagaaaaagaagaagataatttagtcatacactagtacaccacagtagattatcaatcttgtaggatcgaatcacaagaactaagccaaccagagggggggcgggggtgaatggttggtataccccaaaacccaaacttttagcggaaataaaagttaccctcaaattcgatgtagatcggactgaacgaggttgatccgccggtctgaccgcgcttgtgccgctggtctgaccagtgttgatcgcccggttcaaaagcctgaagatcgcctgccgcgcctgaagtcgtagcaggtctgactgcctctcctccgtcggtctgaccgtcgctatgtcgtcggttagaccgccgaacctgatgaaacacaaatcgaagaactcttaaaatagatgacaactttattgcttccctctgtgtttacaaagtgcaccaacaacactccttacaaaaatttcgactaaactcgaaaccctaactaaactatcaactcaattgctctcaacagcgataccgggaaacctcacactccctctctatttatacccaaggtaggcagcctaaagccacgaaccaaattcatactagaagtcctaatcaccttaggaaaccctctagtacaagaaacaaactttacataaccaatcataccaaatttggactcctttcaaattcgactccgcatcccatacgcacacaatacctccatcgtatgccatatggaatctttaccaaccacgtgcattgaactctagccttagtatctcgcatgatatctgaccaccacggacatcgccttaccaccaagtcgactcccggtccaacttgactctctcgaggcatcgagtcacctacacatgaaacaaacaaagaaaccatattccgagaccaagctatccccaacttgactcattagtagcaaacaacagtattacatacgcatagtatccttctagaagccataaccatgaaacaatcacggatatccaaacaaacaaactaaaaccgacacagtgtcggccggccagactgcgggctagccggtctgactgctcaatcatcaccggtccgaccggcacacactgcccggtctgaccggacccaaaacacagcagatcacctgtgaaatccaatcatcttcaaaaccacttcgtaaataaatttcaaatatcaaaaccaataaacgtcaatgccaattgttcatcacagaataacaatcaaaaacacatttgattttacaaatcttgattgtagtgataaattaaatatttcaataaataaattaataattaataaagctgtgatctaaacaatacaatagacgaaagctttctgagaaatcgtattagcaaataattaacggcgatgatattgtgaataataagctgaaaagaaagtttaacttttgatcgatttctttttgtcatggtcttcaggtacgttgccccggagtatgcgatgaccgggcatctcctggtgaaaagcgacgtgtacagctacggtgtcgtgctgctggagctcctctcggggaggaagccggtggacatgacgcagccgccggggtcggagaacctcgtcacctgggcgcgccccctcctcaccgaccgggacggcctccagcagctggtcgacccgtcgatgccggcggcgagctacggcttcgagaagctggccaaggcggcggccatcgcgtccatgtgcgtgcacgtcgaggcgtcgcaccggccgttcatgggcgaggtcgtgcaggccctgaagctcatctacaacggcaacaacgacgacacctgcaccagcggctcgttcggcggcggcggcggcgaggagtacgaggacgaggaggcgtcgtcgccgtggaacaaccgctcgtggagccacgacttcgccgcgacgccgccgccggcgtcgcgcaggctggcgttcccgcgggctccggcccgcccgacgacgatggactacagctcggacccggccgacggggcggcggggacgtcgtcggcgtcggcgcggcggcagcggtcgacgtcgagcctggtgctggacaagatcgagtcgctggcggcgtacgactggtccggcccgctgagggccagcagggggaggaacttctacaggctgaggggaagcatgagcgagcatggcggccatccttccgaagattgctccatggagggctactggatgtagtagctaaagctgagtgatgatgatgatgatcagatgttgtctgcagaattgcagattgccttccatttcttgtcatgttcttcagttaactgtatagttttctgctcatttgatgatgataggattttgatatgattgatgccatgctctgaacaacaatcaccacaccacccctggtctggccctcattttttccatgtagtggatgaacgcactaatcatcatatcattatggcattttgcaacattcattgcactagaatttagcattagtctaggcagtatcaaacaagacattagagcatgttgccatgtacatgaacaaatggatagcacaacaaaaaaaagtgccttaactactcaactagctagtttgttttcgtctcaatccatctgttcggcagcggaagattgagatgaaaacacactgatttttggtcgttcgttttatttaaatcatttttatgattaatatttttgttgttattaaatgataaaatatgaataatatttttatggtgacttatgttttttttattttttaaaagatttttaaacaagacggatgaaaagttggatatagaaactcatgattacgtttaaaatgggacgtagtagtattctcctatattctcttaaacactctttaggtttgtttaggaacacatgcctctgtacacgaaaaacggagtagctattattttaaaaaaggttcaatataatttttttaagtaatagtttgaaaaaacgtgcgcgtgagggagagggttgggaacctgagaaaagacgggccacagggtgctggggcccactggtcagagaccgggcactcgaaccatctagtgcagacgtggtaactggcgcgcctttctcccctctttatcaacaccacacgcaggtcgacctcgactggaagcgcctcctcgaatcgaagaagtgtcatggctttcgctgctcccgcgacatgcgcgtgccgcatggcgccgccgccgccgctcgcggccgcctccgtctccgggcgtgggcgctcgccgtcgtcggcgtcgagctatagggcggcggcgcggtggtggccgggcgcgaggagggggaggcggaggaggtgggcggggttgagggcgaggtgcgccgggcagtccgtcgtgaagcccgggtcggagagcgccgccggggagggtttggtcggggaggacccgccgcggccgccgttcgatctcaacctcgccgtcgtgctcgccgggttcgcgttcgaggcctacaccagcccacccgtgagcccctcctgcttcacccgttcacctcaccctcatccttaaggttagcttcattagtccttgtaaattcgcgagtcatttggagaattgttcttcgtgtttggcaggaggatgtgggctggcgcgagattgatgcggctgaatgtcagacggtgttcctatctgagtgagttgtgcgcttatccttcttttttttattattaatttgttaattttgatagaaatatctccctagccgctgtggtgctaaactggaaagggaatggaattctgaacgcattgatatggtcatcactgtaaattttgtgaattgtaccgtgcctatgtattgcagttcatttctccgtgaagtatatgatggccaattggttgtgaggctgaagaaaggcgtaaatcttcccgtgatggatccttgggtacggtgatgtatttgttggcgaaaaaccatttattatcctacttaagttattaccgacttcttgttgatctataggtgaaacaaaataaatctctgcaggtcatacttatatgagttaaatttaccttttcttagatgagagttaaatgtacttcaattaagggatatctgaacttatctaaaaacccattgcttctcataataatcccggattatgaatgtagcccaaacaggcaaacacccaatgatttaacctgcatgttgcaatatagggtcgagcttgcccaatctaactactgttaagcagacctcttcctccagtttattaacaacttcgttttctctaaccatttcaattgcagggcacaagtgacccttacgtagttctacaactgaatggtcaaactgcaaaaagcaatattaaatgggcgtgagtaaccttttcccttttctatgtatgctggggtcttggcggaggaggatattgctgtttttttttcacacattttggaatattttgccaactaatggtttaatttctctaagcaatatttgatatgcttgaagatgttatttttctccatcattgatgcagattgtgatttcagtaattgatcaacgtaggacgaaggaaccaacatggaatgaagaattcacatttaacattagtttatctcgagaaaatctactacaggtatgagcaagctcattttcgtacaagtataataataaacactagagattagagtcttagggtgtatcattctacataccatgtcttcataacttgttgtcctaggctcctagccctattattatggcctctctcagcaaaccaactgaagggacacactacatatcttatatgctcatatttgattattattcttgttttataattcgtagaactctgcatcttggaagtggctattgctcttcgagaatcttgttcattaggagtggatcactgagattactattttaaataaaaccatttgagaaatttggcatgtcaacctctgaaaaaagcttaagctgaatgaacaatattaatgccagacatcttgacaaatcgaaataaacatatatgactcaatatggttctagaggacacggcaagtagttttatttagttaacaggacatacataagcaaactagacgtatcattctagcaagttatggtaagctgcctcgcaaatcatagtaataatagcatgcaattctgtgcagcattactcttccttttttatcaactttattacatattggtacatacagtatcagtaaatgattatttgtttaatcattttcctcaacaggttgctgcttgggatgcaaaccttgttaccccacacaaacgcatgggaaatgctggattgtgccttgaatcgctttgtgatggtaactatttttattgacgtaaaaaataaaaatgcacgctgtttgacatttccttttgttatagaaagagcttggaacctatttctgtgatggcatggatgctggtttcttttaattctgagcaggaaattctccataaagaatcatggccaaaatacatatggaacattctggaattggtcagaaaccataggagctaatcacttttatatatgatggcatatgagaaatgagcacttctcttttcattagtgatgctttcagagtactgattaatcaaaaactaacagaacgatgttctagaacaaacttgatttagcaaaacgaattttgaatatgtaacatgcccccagcatttctgatatcaagcggttcatatcttatttgttggggacttggtgtcaactcacagttgcgcacttactccctccgtcccataatataaaggattttgg

SEQ ID NO: 81098 - DNA, 6854 bp, Oryza sativa
attcctgcagcccattcataaaattttagatgggttttcagtttttttttcaagtgcaagcaagtaaggcctcaaccgtcaagcatgggaaagctagaaaagttaaggaaaacccactcaaaagcccaggaaccccaaaacctggcccatctccccggtccccgacctcgcctctccttcctcctctgctcccactccgcctcgccgccgcctccaccatgtacggcgtcggcggcgggggggcggggttgaagccgcggtggacggggtggcgccggcggcgcaaccacgaggacgacgacgacgaggaggaggaggagtccggcgaggggcgcgtcctcgaggcctgggagcgcgcgtacgcggacgaccggtcatgggaggcgctgcaggaggacgagtcgggcctcctccgcccgatcgacaccaagaccctcgtccacgcgcagtaccgccgccgccttctcctccgctctgccgcctccgccgccgcccgcatccagaagggcctcatccgctacctctacatcgtcatcgatctctcccgggttcgttcccccgtgccttctcctaagcttgtcctcgggtcagtcactccgtcgagcacttggtgagtgcggagttttccgtgagctcgggttaggatcactggggatggcgggcaatgctgatcgtgctaacctctcagtgtttgttaaatgcaacacctcgtgccgaggctgatctggtggtattgcccatggcctcaatttggttcgtgtgaaatgtggactggaggcagtattgttgaatcggtgatcactatgtagtgcttttagcttgatttcatatgctagctatttcagtgactagctgcgcaatcctctccacttccacatcaaggtttgatgtttgagttgatgatctcatcactcatgtatgatttgctagcttgtcttcttgcttaggtgttctgcttttagtccctgagagtgggtgttataatcggtgcatatcagggcaatactggaatctagccatttttgtttgccattgaccagggccataaccagagattgaatggggggttttcgccaaccattgaacgcaatgaagttcacaaactaaaatgaaattgtatatggtttgtattaaaaatggttcttctacaattataatagtttgttttgtaaaggaaaaaaattcttgtgccaaagggtctcctgagatctgtggtaaataaaattctttctataaattactgcactatgactcttatgagcaagctaaaaaggaaaagacatatttcataccccatccctgttaggctcatgctaatagcaattttctcttggttctgtcctatctgaaaacttcataggaatcggaggagcgtgaggtttttcattatcaagattctgaagcggtaaagcgttttggttgatcgtcatttgttttatgtcaaaggaaaggggcaccgtactgcattactgctccataccatttgacattgttggaaagtgttttctgttgatttgagaacactacgtatattttgtgtatgcattcatgtggaaaaagccctttcttcctttgggtgataggtagtaaataagatcctctttggcacagctccagatcttagatccatggtagatttgaagtttataaattaaattataatggtttaaaattctaaatttcatttgaaatgtgcacgaaataatttatttaaatgttattaacgtaatcgtagatctagatccatggatttatggagctagaaatacctagctccaagaaatcttggagagggcctataccatttattttagcatatgtacattttcttctcacaaagtaggctgctcatgattgttctggtgatgaagatatttttactgcaaattgatatgctgcccacgacttcttttacttctttgcattcggttgtaatctccatttatcctggttgtatctttgatcatgtaggcagcttcagagatggattatcgacctagtcgaatggctgttgttgcaaaatatgctgaggtattcataagggaattttttgaccagaatcccttgagtcatgtggggatagtgacaatgaaagatgggatttcccatcgacttacagagattggaggtagtcctgaatcacagattaaagcattgatggggaagcttgagtgttctggtgaaccatctctgcagaatgctctagagcttgtccatggttatttagaccaggttccttcatatggtcacaaggaagtattatttttgtactcggccctgaatacctgtgatcctggagatatcatggagacaatagcaaaatgcaagaaatccaaaatacgatgttcggttattgggcttgctgcagagatttttatctgcaaatatctgtgtgaagagactggcggatcctacacagttgcactggatgaggtcttaaaatatgctttgtgtgtttacctttccttattcagttattgtgaagataaataatgcctgttttattttggcagtcccatttcaaggaattgcttctggaacatgctcctccaccacctgcaattgctgagtatgctgcagctaatttgattaagatgggttttccgcagagaggagcagaggatcttatctccatctgctcttgtcacaagaaaataaagtcgggggctgaaggttacatatgtcctagatgcaaagtcaatgtatgtgagcttccaacagaatgtcgaacttgcgggctgacactagttagctctccacatctggcaaggtcctatcatcatctcttccctgtacaaccatttgatgaggtgtcctccgtgcacccaaatagactaggtcaaaagggaggacaaaagtgttacggctgccagcaaagctttattaaccctggtatgcagttctttaacacgtctaacagtacatgctaccttttcaatgcattttcatacaaggaaagatatccttattgtgctacatatgttgcagttggtagaaaaaagaagagaaaatacataatacaaagcttacatttgtttgttattacatggcatcatgttcttcaattaccaatcctcatacttctcttacatttaatgtttttcactggtttttgtgctagattatactccctctgtcccataaaaaaccaacatagtactagatgtggcatatcctagtactatgaatctggacatacctctgtttatattcgttgtactagaatgtgttatatacagtcctaggttcgttattttttgagacggagggagtactttgcaattatcaggtttattaattatttatccaatatccttgcagatagtcaatctagcctccatgttcgctgtccaaaatgcaaccaacacttctgccttgattgcgatatttacatccatgagagcttgcacaattgcccaggttgcgagagtcagcgtagttcttcatagggatgccattgtggtgttaatctttgtctttttaactcaagaagctacccgttgctgtaagctttctcgtacactgacattggtaggcgatgttgtgaggtaatcaaacagtgtacagatgatatagtgcccggcctccattttgttgacgcttcctgttcatttagatggagtagctagttaagctattttgatacagagtactggtcaaagagttgttgaagccatagcattgttgctgaggggaggtgttagaaatgtacaatgcgactgaaaagtgaaaacttgtaactcttgccgtttttctgaggcaaagatgtattctttcagtgtcatagtcatgccctgacatgccatttacgagcagaggctgttcctttctttttttttcccccttcctctcctgatatgccaatatgctggatatcgacggctcgacgcacgcacgcacccggcgttttccgttgctggttgctgactgtagaatcgtcaaggtaagcagttgcctcgtgcaattaactgcacaatttcaaagcaggcggagacgcagaacgaaacggcaaaacgctggagagagcacgatgttgctgacccaagaggctgatggcttacgtttttttgctgcctcgcaattcgcttctgatgggcggagtcaacacagatgctaactctgggctttttcgttgttccctttcagctttccggtgacgagcagtggcgatcatcatgcataattacatatacgcagcatatccctggttccctacactctgatgaaagtgtgcttcctgtggctatcatgtcgactttgctaaagcgaatggatgacaggcagcggtgccagtgctccttttcaccagttgcacggccaagttgtgggcacgacgaactgcaggctgctgcaccgtcctgtgcgttttcaactgtagatcactcgagtccacttgaaagaaacacaggtgagacagcacgacggcaaccgatcgaccacggccttttccgagcactgcacagtgtgcacactctatggcgctaagcccttttcgtgccctatgctgcctatacacagtcacttgcaacttcctttccttcaacagtacggacgcctcgctcatataaacacatatacgcacatcatatttttataagagtaaattttacaaaactacatgttttatggttcaagttgcagaaaaccacacatattttgacacttggcatttaagtacatatattttggtagtttagtttcacaaaaccacactatcgatgaatggattcacacatgagatgacgtggttgttttatctagatgatgacgtggcatcctattaatttcatgggatggctagtaataagatgccatgttctcgtcctagttgaaacagtcacatcatctcgcgggtgaattcattcattgatagtgcggttttgtgatatcacactaccaaaatatatatacttaagtgccaagtgtcaaaatgtttatggttttctacaacttaaactacaagacgtgtagttttataaaatttactctttttataaacatctctaaagattacatcggtatatatttaatttaagattaacaaaagttatcatagacatatctctctatcatatttcaaagttaccatagacatatatggatgtcatgtgtcgatatatatagtattatctaccactaaaagaattaactagctataaatattaataaccgtgttaagtttataatttaaatccggatcgacaaactcaaaccacaaggtcgaactgagttcgccgcttgcaactttctgacgatgtggtccggcaccggctgggcatcgcatcgagctcgtgcaatgatactgaccccatgatgggatttgcttgctttggcttggagagacaacgacatgattgccatcatgctagttgctcctgagctgcagcctctgtactatggacaccaaacatttttattactcgtatctctgaaccaagcaaacattcagaacccagaaaaaggcagtggtgaatttccttgcatcaaatggctgaaaagttcgcatcaaagtttggtggaaaaatatcagctccaaaaggtgtggtttaccgggacaaagccctttacgccgtgagtttaccaagcccggatttgccggattccctctctagcaggaaagttcattgctgctttacggcagaaatcttcagcatggaaagggtggctatgctaattgctaaagcacatgtttggatagtcaaccatgaaccttgcagagaggtaaggttagctgcacgacctggtttgggaatttttcttcttacaacgaaaaataactatgaaattcttgtgaaattatgtgtttcagacggcattagactgaacatctattttctaaaaaataagactgaacatgtcttcgcgctcaacagaaggtcagtgcaagcaggtgcaatatcgccttttctgatcacaccgaaatcattttgaaagcaacacaagtataactcatactacgcgtgtgtaacatataatggaagggaaaataaacttatgtccgttctaataggatggaccgatggatgaagccttttcccttggtttcaccagcatcttgttcatttatttccactatcccatactataagatgcttgattcaattcaaaagaaatttgaccaataattagtctaacatgaattaaattttatttgacaaaaataatatcattgggttaaaatttgaatgcacttttctatggttgactttgttactataaatattacagtaataatatacaagaaattaaaagtcaaaaactagttttatagattgtgccaagttcaattgtgttggttttttttttctgcatttctttcgatgtcgctacatgcgcttaccgcacattataatttgaaacgagggagtaatatgcatccttcggtcgtcccgtcctttcagcttacgtcgagaaggcaaggacaggtgattgtccaacgagtcttatgtacttgtgttagtggatcaagtgtgcctcgtgcgccattatgttattttccgtcgaactcactgcaattatcaccggatttgagacagcataacagctgccgagacataattatgtggggattattaggatgtcacgctcggtcggtcacctgcattgtacttgtaaatatgtctatcagccgattaacaaacttgagaacaccccagctaacaaacctgaaaacataaatcaataaagaaatcaaatctcgtttgattacactcgagcatctctgcaccggtaggattctgctatggatcagcgtttacctatttccattttgtttttcctgatgtgaatattggctggatgtgagccagcaggatagctttgttaagcctcaaaatgttctgaacaatctgcag

SEQ ID NO: 81099 - DNA, 12699 bp, Oryza sativa
ccttgtcttctagcttgcaaatcttaccacgattccgatcttcacgatcttgagccgctaacacagtctccgcacgactttcatccatagcccacagcatctcaaccaaatgccttgtggtagcatcattctcaattccttcagtctcaaggtagctgccacggtcacttccctggggttgacgaggatgatagcgatactcagtatcggccaactgatcactgtaacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacattgtacgcaactcctggacaaaaccctcaacaccaaacaagtactcaggcttgtagcgcggcatctaaagacaagtgaaaagagggagttaagacatttatccaattaatagcacaagttttgggattaatttgaataaagtttagaagatcaaagtaaaaggtaattaaataaagtaaaccaagcttgcaagataagttgaaacagttggaaatgaattttgtacttttgaacatcaggttccaaaagaaataaaagaaagttataaaatcaacatgttaaatttattttattgcagcaagattaaataaaacaatattgtaaaacttttgctggtaaaatgagccattagtacagtaatagatgtacagtactaataacactggaataaatttttgaacgagaaccattaaaacagattatgaagtgcatgtgctattagtttggtttaattaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaagatggcataatagggttttattttgcaaaagcagcatttagtaaacatttgagaatttaataaaacagtgaagtattaaacaatattaaaccaacgctatacaacataccctgttgtataggcccaaccattctgaacaaccattcccggctgaacagatctaatctccaaaccaggaattaaccattccaaaccaggagctaaacaaattataaccaaataaagcatcatttactatggtgagaaatgtgagactaatcacgaaaaacattgttagacccgcccataaccgcgggcacggctattcgaatagttttactctgatcagaggtgtaccactgtacccacaagacacagccccacatcatgtcaccatgtgccttagtaccaccacggtacctcggaaaggagctgtgacattaccttgctggccttggaactcttcaaactcttctccggcgaaaacgaactctccgaaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaaccggttttaattgaattatgacgcaataaagaattatttttgaaaaggaaaaggggatttattgcgtcagcggctagggtttgcggtggaccgagcgcacaggcggcggttcatgcgaacggacggccgagatcgatccatccaaaacggacggccgagatcgatcgggtccacgacggctcacggcggacggccccgataacgtcagcgatgacgtcatcatcggcggcggcggctcggcggctcggacggctcgggcggtgcacactcgccggcgaacggcggcacgaggacgcaaacggagggcaccaacgggtagcggacggcacggcgaactcaccggcgaccaaaacgacggcggaaacccaacggacggcggcggcgacgaagaagaagcggcggagctcttcggttcgacgacggcgatggtgctccggcggtctccgacggcggcgaagcaacggacgaggacggcggcgacttggcgatcccaacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagaaaaggtcgaggagatcccggagatcatttcccctctattgattcggccggaaacggaaaggggcggccggatttggaaaggaacggcggcggcggcggcggctagggtttcgggcggaggccgacgccaggaagacgacgacctgacaggtgggacccacctgtcagcgaccgaacgcgcgcgcgcggctgcggactgggtcggctgggccgaggagagagaaaagagaggtttttgagccgactttcggcccaaagccaaaagaagatttttaaaacctttttcaatttaaattattttttaaatgcaattccatttattaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctgggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgcccgttgttgtctcggcgccgatctccatcatcgtcgtcattatggcgacgtcctcgaccagtatcgcccagcacccgccgttcgtgatcgtcatgatcgcagcggttgtggcggttatcatggcctcggtcttcgcttgaacggcctcctcgatcttcgttatcgtgacgtcgtgaagagatgcgatgttgagaacggttctcgttgtcacttgtgcgtcgcgcctctcggcggccattcaggtgatcgcggagatcgccggtgccgcgaggtgaaggggtggctcgatgaggcaattcccggtgttcaggatcttcaccattagcatcgccagttggtggctgttctgggtgcactgcagcagcggcttctttgaacgcgttgctgaggttggtcactgattcccgtagtcgttctgtccatcgtgcgagatcgtcgttcagaatgggatcgtagggggtttccctcagtattgcgttgacggctctgatgtgctgggccagtgtagtcgcttgattttccgcttccgcattggtgcgcgctgatgtgccgacatcgtcgatagccaatacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcctgcctttgattattatgggccagaggacgcgacccgggtttctcctcgaggtatttcctttttagttaaattgactcccttatgcgcatgttcttcccggcttatcggattctgttctcgatctacaggcttgaatagtgcaaccgtggagcgccgcgtcagccaactgatgatcagcggcccgacaacggcgagcaacgtccccgtccccctttgcgagaaaggggcagccgagcgtgacgctgccatcaatgtaagtgtacttagcggtccttttgcatttttcttccgggatcgcattatgacttcatgaaacataggctcttcctctgactgatatcatcgggccgctcgtggaccatcaggtggcagcgtcgctgaaggagaaggtcgccaaggaggcgtctgacactgctgctgccgctgccacgacgagtggcagcgatgttccgaaaaaggggaggaaattctcctctgtagtcggacattgtcggaagacacccaccccctcggtaagttctcctgttatttgatcacgtagtcggaaaacttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaagatgagggaactggtggccggcaacgagcgacaacggcaggggctcgagcatcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatacgagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttgaattttgatggaattgtaagaaatacttgtggaatagaaaagaaatctatcttactaagctttcttactctggacgtagtgtgtatgagtgtcttctcacttcgcgacttcgatcagtcgtttgagttatacactctccctagcctccagccttgtcatcggagaattcttctcggaagataaggctcttggacctttgacctgcctcggttgaacaagcactgatcctagcccccagccgtgaagttggaaagtttatttccgattacacggcttggttaatacgcacggcgagaactcttacacaaccagatcttacatggtctttcgtctctacaggatccgacaaggccttatcggctctgggtgtccccgccgaagttcccttaggttcctcggaggccttgtcaagacggcgtaaagagacatgaggataggtttcaacgttaggtgtcatctgggtaagggatcatcgaaaaggaacactttgattgtagtctgtacctaaaaaataggctttattgaggctgtaagatgtcttacaagtatggatactattgacttatacatagaatttacgtaattgatcaatgttccaggaatttgccaactcgcgaccatcgccatctgcgattttgaatgcacctggccgcaaaacttgcgtgatcgtgtacggtccttcccatttgggtgagagcttgttgcgccctgcttggctttgaacccgtcggaggacgtagtcgccgatcgaaagcatgcgtgctcggatgcgcttctcgtggtaacggcgaagggcttgttggtagctggctgctcgaacggcaactcgttcgcgatgttcctcgagtagattcacatcgtcgtatcgctgctcttcctgatcctcatcggaatacttctgtactcgtgtactttgatgtcgtagctcggtggggagcatcgcctctgagccgtacacgaggaagaagggtgtctccttgttggacgttgtcggtgtggtacgcacggcccatagtactgatggaagttcctcgacccaattcttgtcgtgtgacatgagcctgtcgtagacgcgggtcttgattccttgtagtattatgccgttgccctctcgacttgtcaattgctctgagggtgagaaaccgaggcgaagcagatcttgactcccagcctgatgcagtaatcctggaaatcggcactgatgaactgggagccgttgtctgttatgatacggtggggcaatccgaatttgcagaatatccctttgatgaatttgatggcgttgtcggccttgatttcccccgtgggtgtcgcttcaatccacttggtgaatttgtcgatcgccacgaataggaacctgtagccgccctgtcctcgtgggaatggcctgagtatatctagcccccagcacgataacggccaagtgaaagggatagtctggagtgcttgcgctggcagctttgtgtgtttactgtggaattgacaggcttcacactgttgaaccatgtcgcaggcgtctttgagggcgtttggccagaaaaacccttgttggaaagcttttccgactaatgtccgaccggcggcatgtgacccacagatctcttcatgtatgtcgaggaggaggtgtctgccgtcgtcggacaagatgcattttagga

SEQ ID NO: 81100 - DNA, 1281 bp, Oryza sativa
tttcatgttgcaaaaccttttatcctatgccttctttttgctcaattggcctaacaaccaagggataaatagaaattgccacaggatcttcttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatttgttgcccttattttgcttatatctacacatggccatggtgcttcatgtttattttctgaaaatgccaacaccaaagattttgaagcacacaactgacaaagtggacatgctacaacaatttctacaacaagaagcaccatttatagaacaaaatgcagtacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaagg

SEQ ID NO: 81101 - DNA, 789 bp, Oryza sativa
tccatgagacgtatattggtatatagttttattcttcaatagacgcatatagtattctttcaagttccatttgaaaacttggggattttcggtcgtaggttcacgagtttgggaaaacttgggaatttcattctagtttatcccaatcttcccaaacttgctgaattgaattgctggaaaattttgctttatcccgaaactccttttcctgagttaatccgaagctaattgcttcatttactgataatttacatcaagacataggcatatatggcatctaaacggaatgatgggaacataatggctaagtttctgctctgataccacaatgttgtctctaattatataaattgaatcttagcctaacatgatcacttcttgcttatgtgaaatttgatctataaccgttttgagatgccactgaagccacttcaatcttctcccggtttctttctttatggactagtgtttatgcacttatgtttggcttcgagatcaccggttttagagatcgatggagccctctcttaggttttaaaattggtgatagaagaaatagttgtcctactgctcctcttaattcttttcttataatagacggtgcttgtgaggcttagggactaatcccgactaatttttcatataaaacttacaaataatgatattagccgtttaatttaacactattacgggcatgtttggtacagctccaactcctgaaggcatgtttggtacagctccaactcctaaatattgcttcaagagttgagtctggagtggagttgtgga

SEQ ID NO: 81102 - DNA, 18662 bp, Oryza sativa
  unsure (1)..(18662): unsure at all n locations
cgctcccccggtcacaccggagaaagaaggggagggagggggggtttggaaattttnaaacccaacaaantnnntnnngggtggtggtggtgcgcgtgtcncggggggttgaagaggacggcgtttgcgtttcgtttctctctctctctctccgtggcggttttgcggatcgccccctccgaggacgcgtgcctctctttgttgcagtttcttctcttatttttattcccttttcctttggcagttttttttttaaagaaaaaagagggcggctacaaaacgggatcccgttgcaacaggataggcatattaactattctcttgcacgagtatcacgagtaccaggtcctaggtatcacaggtatcgggtatcatgcagctggtaccacaacaggtatcaagtactgtctcatagaagggtatcccgttccaacggaataccgttgtctaggttttctgtttttttttttgggaaacacggtataacgtattcaatctatccccgaataacccaacctgagtgtaggtgtgacataaggacacctccagcgcgcagctaaaaggaggcgcttataagaaaaaccggggttttttttattaccacataggatcaatgagacgcttagcgcaggaagccgctgcttcgtgcggcgccgacgcttgggaggtgtttgcacgggtgctacagatggaacctattatttcaggcatcagtccaactccctagcattggaccatcaggctcttgagtgaagtgcttagtttaatcatatttttaagcacctccttaagcatgtacttagcgttggaggtgccctaataacctagtataataaatccgaacaaaggatcgttcattgaggttcttttaggatagaggaagtagaaacacagacactcaccccaataatttatattcgcctgagcatcttcgagagactggattgatatattttaagattgattattatttttagttgttattatccatgttacacttactcgctatactgaccagcgtgtgaattttaactcaaatgtatgtatgctattggattatgggttaaagaagatgatgtttggaatttgggtgcagtaggtcctgtgaaactttggcttcagtaaaactggggtgactaatgactatcgaagtgtgttttttactctctcttttcaacttatattccctcgttgtagatgtgcacgctttctaaataggtgctaaatagtgtggctttagaaaatcgtatcaatacatttttaagttttgtattaaatacttaattaatcatgctccgttttgcatgttgaaggaaaatggttcccaatccttagcttcaaacacaattgttgtgtacaaaatttgcatcctctaaatcaccacaagccatatgcatgctgatctatgtatacgtgatctcatgccttgtataagacctaaaatacgtacgcacaaaatatgttttgaaaatatctttattggggctagtcgaataacttcaggagtaaaaattatcaagtttgtcactaggaaatttaaggaacatccttaaggtttatgatctcacaaataatgccaccttaaatagaatgttttaggctcattgaaggaatctcatgaaatgcgtacggaactatagtttgcagggttgctggatgaatagacaccctcttactagacggctaatgagtgggcccaatgtatcatgcgttcattagctcatcatgtacaaggttataatgaccttttaataggcgtgtgaaaccaattttataacggagaatgaatgctattgtgataaggcgattaaacagtatccacaattagtgcttaaactttaggaaaaagaatatttatcatgtaagcgtatctatgtcaaaggagtaacacgcttatggcttttcaagtaggttttgatgaaccccatggcgtgttgatccacttaaaagctcaatttgtatggtgtagtctcaactttcctgtttccttagctcttgtactatatgcttattggtaagctaaagttgttgtgctatggtgaggtgtttgctttaggcagtggtggtcatcactcccctaaagtctcctttaacaagtggctttgcaaagggaatacttgactgagaaagactcaaggcaaacggtttttacttcctttttctttctttcaggcacaaaactacacaatgagacaaacgaggaggaaaccaacaaatattctcagccttttctttttcaaggaatgaaatggcgatgaatgtgcgtgtttaccgaggttctaaacgatgtattttttttaaaaaaaaactttgtatatacaaatttcttatagaattgttttaaatctatatttttttaattatatgatacttaattgattcatttataccctcgaataatgatcacaaaccttgcattcagctattcagcataaaaattaaagaacaaaacatactcaagttctgaacttaagatgctataatacaatgttgagatctttttcgcctagttctatactacaagctagccaattcttgttcttgcttcacgaagaagggggtctactgaagtcaatgaagtatatattacattcatactactcatgaaagttgatgacaggacacacaaggatgaaaacacacaaaatacatgctgagttagcatatcatcatttcctcactctgtactgctggcagatgagtcagtgccaaaacgatggcactgggaattggatgttgtgtaggggcacatcagctttgatccctctcttttgttggaaaaaaaggcaactttaattagggtaaaacgcttggctttcttcttaactaggttagcctctatggtgctcttgctttcagcctttcaggggtgagtaatcaagcacaagaagatccacagcaattggcagcatctctgaaagattgggatcatccgagtgtcatggcatacatgcttttttagacttgccgtagttgcaccaacagtagatgataattctccttaactctttaaaagatggcaatatcaaaaagaaaaaaaaatactacgggttaccataaaaggaatcatacatgtacaatatcatttaacaaaagtaaaatctcatgactgtatttagttgtggtatctagaaagaattgtcaaaagagatacattgtcatctgatccatcctcttattcttgtcatcgaagtttgctctgtttatatatcgtgaataatacacacatcattttttccgctcgtgaatggcatagctttggagctaagaattttttgttaaagctaggatatggatatggatattttaatgacttgctaaaggtccatgtattgcaacggataagcaatataatatagttagttattaggcatataacatcaaagcaaaagcattcatgtgtggagatcttatggccccacacattagcttgtgacgttggagacggattcggacgccaccactaacatcatttaaagtagtatagattgtttctatttttaaaaaaaatacacaaaaatttaaccactgcaattcaatttataaactttgaatccaacgtaaatctaaaatcgatctaaggttgtgctaaacagaccttagacacgatttttttttctcattgcacatcaaattaaaaaaataaataggaacaaaagggataattagagggctaaaacgaaattctccaccctttcacacattcccctccccagtgatcagtcgcaaaaccctagttggcaggttgctttgactgcgaccattgcaccttaggctgactggtaccacgaagctttctgcaaaaaacggagggcccagagacgacggagacatgatcacgttggaatcagcatggggtgcacaagaatttcatacctttatgtcaatccgggacccacccaagacaaggatctaggatctgctgaagttatggtgaaagatatagtcatcatcacatgaaaacgatgcattatattagcgggaataaactcattattcctgggttattcacagtacttcactagatcacgttgttttgaagtattatattgatatagtctttatttgaagtacaactttgaccacaaaggattctttgaaatgcatgaattttacaggatttttataagcaaaggtccttaaagaatccctcattacaaagtaggcctaaatcctaattcatgcaataacatatttatatttataaattccagttaacgctgtaattacataaatatacttttcaatacaaacctaccattagccttttgtgtatctaacataaataatttaaaaaactatagcaacatttaaaattttgaaagtttgagttgtgtttgatagttttagtgtgggagaaacgaggatatcctcaaaaccatttcttgtatagtttaagtttacctttgaaacgcacaaatccaaatacacatgaatagaaaaaacataggtatcaacaagagtcctctaaattgcaggaattgttgaaacgtgtttgttttgatgctttataggaaaagtataggatttaggatatgagagagatatgaagaatgtttcccatgaggtccaacatcacattagaaatcctcccaaattttcataaattaagctattccaaattaagctattccaaaggaattttgtaggaatttcaaatggtaattcccttgttccaagggagtatcggaaaattttccatgggatttcaattctaattctaaaaagaacatgtatttttcctttgttccgaagcagccctaaacaatttaaatatcgttgttaggggcagtggaagttctggtggaaacatagaaaaaatgcgcataaagctgaaaaataaatactttacttgatatatagaagggataatgagtatagctgtataagttgtctcaatccaggtttctctgccatcctagggagcgttcgttcgagtgagttagcgtgagaaagcacatcgtagtccgcgcgcacgcttcccaaactactaaacggtgcgtttttggtaaaaaaatttctataggaaagttgctttaaaaatcatattaatccatttttgaaatttaaaatagtttatactcaattaatcatgtgctaatggctcacctcgttttgcgtatcttcccaatcttctcaatctcctatccctcaaactcacccttagtctacattatcagtctaaaagaaaaacacattatatgttgtgtacaactttataaaagtgcaacgcctagtattggaattgatttcctaaacctcccctgcttaatctcagtagttttcccgcaaaaaagaaacattaagcttaatattttgtatacctatttgtttattacttcctccgtttcataatgtaagtcattctagcattgcacacattcatatagatgttaatgaatctaaacatatatatgtgtctagattcattaatatctatataaatgtggataatgagtcttacattacgaaacggagggagtatgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggtcgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgttgcgcctgcttccggcggaagtggaggtaggtatgggccgtcccatcagaaggtcattcggacggcaaccatacaagtctccgtctgtttatgaaaagataggataagtccccccaaaaaagagagagatggtgcatgtggtatccccttgaggtataaaaggaggaccttgcccacttagaggagggattttttttggatgattttagaggggatcgagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacaccgagagcttagaatctcacccagggcccccggccgaaccggaaaaggggggcctgcacggtctcccggtgaggagccccacgctccgtcatctggcgcgccaggtagggggttctgcgtgtgttcttctaagctctcgcactctttcgtgtgcgccaagcttttcctgttcagcccaatggctgaacaagcaaaggcgcacaacctctctccgagtgttagcggtgacgaaggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcatgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggcggttgctcgccattcggccgccactccttcgtcaacgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacatgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagtggttctgtcaagtccgcaacaccataccatgcatccctgcacacgcggtgatctacgcgttcagggggggtgtgcggcacaaccgcatgctcgaaaagattgcttccaaagagccccagactaccgaggagctttttcagctcgcggaccgagtggctcgtaaggaagaggcatggacctggaacccctccggttcaggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaaaaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgctgaggacatcgatgacggcgatgatgacctaggtttccaagagcctggggccaccattgccactgtcgatgggggagcgtgtgctcacgtttctcgtcggagccccaaggccatgaagcgagagcttctggccgcggcccctactcatgaggcgacgcgccgggcacggtggtcggaggttgccctcaccttcgaccagaccgaccacccaccgtgtgttgcccggggaggacagatcgcaatggtggtttcccccactgtttgcaacgtgaagctggggcgtgtcctcattaatgggggagcagccctcaacatcctttcccccgcagcctttgacgctatcaaggccccggggatggtgctccggccgtcccagtcgattatcggtgtgacgccgggtcacacttggccgctaggtcatatcgacctcccggtcaccttcggtggatccgccaacctccgcacggaacgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccagattcatccgcgaggtcatccatccggagtggctggcgaacccagtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgcattactcgaatttctttgggtagccaaataggacgtaatgttgaggcttatgtcgatgacttggttgtaaagatgcgcaaccaagagaccttactctcggatctagcggaaacttttgagagtctccgctccgcccgcataaaattgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggaattggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggacaaagagcgccccagggatgtggcccctagcgaagaggatcggccccaccgaaaggtgcagcggcccgtctactttgttagtgaggccctccgggacgccaagacccgataccctcaagcccagaagatgctttacgctattctgatggcttcgaggaaactgcgccattatttccatacgcatcgggtcacggtggttacgtcttaccccctcggccaaatcttgcataatcgagagggtactggacgggtggtgaaatgggcaatcgaactttgtgagtttgatttgcactttgaaccacgccacgctatcaagagccaggccctcgccgattttgtggcagagtggaccccagctcccgagcccgtctcagtccccgaggccagctcgggcccctcgcagctgcctcacaccgcccattgggtgatgcagttcgacggctccctgtctcttcagggcgccggtgcgggggtcacgttgacctcgccgagcggagacgtcctcagatatttggttcgccttgactttcgggcgaccaataacatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcacctttgaagaaaggcttgcccagccgtcggcgcgacccgaccccttagaggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcaatgcagagcgtgtcaattccacgccaagcaaatccatcagccggcccaggccctgcagatcataccactttcgtggccatttgctgtctgggggctcgatatcctgggaccatttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacttgcccaccccagaagcaacggccaagtagagcgcgccaatgcggaaatcctcagaggccttaaaaccaagaccttcaacatcctcaagaagcacgacgattcgtggatcgaggagttgccagcggtgctctgggcgaaccgaaccacgccaagccgagcaaccagggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacacgtgctggattgggcaagctctcaccaatgtgggagggtccgtatcgagtgatcggcgtcccccggccgggctccgttcggctggccacgggcgacggcacagagctgcctaacccatggaacatcgaacaccttcgtcgcttctacccctaaagggtgatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccctggggcgtggtgaactccggggggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacaggcatcctcgtctcatacacacaacaaatagaattgacacaaaaaatttcctctttatttgattgcagattaaattagtctatacaagaagggggcccggaggcctcggaagaagaaaagaagaaactatttaaagattggcgggggcctgggggctcactccgatgcacccgggtcgccagcctcgtcgccactgtcgcccactccgccgtcatcatcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgtggtctagacgggagacggcgtcccgaagcatgccgggccctacctcgcctgccaagcggagggcctcgacctccccggcggacgagtctagcgcgccctgcaaatcggcgatggtgtgttcggcagctgcgaggcgggcggttaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcagcacaggcagcttcgtgcaccgccagtgtgacctcccgaatagcaacggcgacctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggacccctcgggcggcgtcgagttttttccctagctccgcctcccagctcccgtattgaaggcggagggtgtcctgcgcctcgttcatcacggtggtggcgatgaggacagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaagcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcacgagttgcctcggaagtcgtcgtcgcctcggcctggcgaagtctggcctcctcccgagcggcttcttcagcttggcgagctcggacggccacctgggcaacttcctcggcttctcgaaggcgatccacggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcagcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccacgggatggttctgtcccccccatcttgcggagccgtttcttcttccgctccccctcgggctgcgacgtcggcatggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccaaacaccatggcccctgtgagcccctgggatcgcaggcccgccaggcggtcgaggacggcgtcgtagccatctcccagatctaccggcgcccgccagttggaggcctgcgctggaggctggctcgaaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcagcagcacgctaccgtcaagcggagtggagccccgtgccatgatgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctctaggaaaaacgaaccggcttgtcccgatttttggaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggtcgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaggagggattttttttggatgattttagaggggatcgagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacaccgagagcttagaatctcacccagggcccccggccgaaccggcaaaggggggcctgcacggtctcccggtgaggagccccacgctccgtcagatggcgcgccaaaccatgtcaatttatcgtatcctcagtttagttactagtncagctttcacatcctangtacaccgaacaatttagtcngtggtacctaccatcaatgatcaggnccacttgtaatcagatgaattgatgctgcnatcataccangattagcaatatactagcacggccgagattcccttttctcangcctcagacacaaggcatgcacgacgggacgtggtttcaccccctcgntttagtcctttttttcgacgcggattnacaacgggaanggctcagtggatcactataaaccatagccgtgt

SEQ ID NO: 81103 - DNA, 8205 bp, Oryza sativa
acatcatggcatcccttgtgttttgtgaataaaaattcattgtttgatatgtctcctttgttatttactttacttttctatttgttgtttcagtcaaaatggaaggatttgctaactgaccttatgctagtgcctgctgggtaggactcgatagtcaacattatgttctctttcattcatttacagtttgccaaatgcctggtttcaaagagtgctagcattgtggtacattttgatttatgttatgtttacctgaatatttccaaattgaatgcagactaaatcctgagaggttgggtggtgacttcaaacaagaaattcaagttagtcatctatatctttattcacttgcttctgtatttcacctcactttatgctatctggtatccaacttcttgacatattacatttcaggttcacagcggattcttgagtgcatatgactctgttaggaatagaatcatcgctcttgttaaatatgccgtaggataccagtaagtatttctataatgaaacagtttctaccacaaacatatatctcctgccaagtattaagtaatctttctttgtttctattcatttttccactgcagggatgaagaagacggagaaaacatacctaagtggcatgtctatgtgactggacatagtttaggtggagcactagcaacccttcttgctcttgaactttcatcaagtctaatggccaagtaagaagctctgaatctgatatctgatcttatttgctggatatgagaggaaagactctcatattgaaatttattaagacaggggtgaggctcgaacccaacccaggtcggctagcccacaccttgtggtgctagccggaagacccttgggcctttatcatatctgaccttatttcatacagaccttatcataccattaagttcaggcttaatgtgggaataggtttcagttaaacatttaacgactcataagaaactctttggttgtgaaagatcagatgaacttggcaggtctctgacccaatttaattgtcacgctctagcaaacctttgcaggaaggaagattatatgtgctttgacccagttcaattgtcgttctctagcacaacttccattttagtatgaatagtggcatttaatagaattgaatgaacttattttgaaagatactccattgttgtaataacaataacaataatccattattgttgttgttgttgttgttgttgaaagctcccagttttatatgattgtgctataaagcaacaaatatatgtttgtatagctcttcttctgcaattgacaatctgtaaaattgcattaaagacagcttctatttccctacatccttttctacgatcattcgttcatatttatccgttcaccttttataggagtggggtcatatttgtgacaatgtacaactttggctctcctagagttggaaatagaaggttcgctgaagtctacaatgcggtaactaagaatttcaaattgaaataggcttgcattcattgattttgcatatcactctgtcgttcaaagttcaaaccggttttccttaaatcagtatctaatcatttcatcatatggacaaggttgatagtgcaaataccatctctcataatttgaaacaaaaattgaaagcagtctgcaataccacaatctgccttttgaaaccattgtgattttggactaatttctgcagaaagtgaaagacagctggagagttgtcaatcaccgtgatatcattcctacagtaccacgtcttatgggctattgccatgtggaagcaccagtttatcttaaatttggagatctaaaagatgcactggtgattagtattcttatcctatttcaatcaactttgttgtaggaatgttttttagttccattcaaagttccgtgtttttatccataagattctaaagttctcaactgaaaccattgtatgtattttgatataggtagatgaggagactatagatgatgaaggtgattccataggggagtacacccctgatgttcttgtcagtgaatttgtgagtgtcttgtgaacttaatacatttgtctgtagactcttgactagctagattctcttgattctgatgataagatgaggattctagttttctaaaaataaaaagagacacttagttgttttaattagtttcttcacaatgttctgttgaactcataataccgatgtaagttgaagaggataaatgattcttgaataaacaaatgattttgctcaaattgcaattgaaatcaggtgtattaaatccctgcagatgaaaggagaaaagcaacttgtggaaaaactacttcagacagaaataaatttgctccgatcaatcagggatggttcagctcttatgcagcacatggaagacttttactacgtcacactgctagaggtttcttaccttgcttatttttattttcaaacacacagtttgtattaaagaggaagaaaggggcagaaccatgagcacacaaacaaacctgcacacttaccttgcctaattacttgtccttgataaatattctgtttttcacatcatctctgcttttcatttcacttgttatatatcgaaagcttcctccaagtaaatttaaccaacaaaatacacttaaacttttgcagagagtgaggtcaaggtaccaaacaggtgacggtgcaaatgaagactaccatcagttaaccgcctgatcttagtacatgcttgaaactcccaaacctgggttgcctgtaagtaccactcttctaagcgcacacagcttgtacttgtcttatggatatatttggagttgttggacggtactgtagtttaggggataattcggacaaagaagaaagtttttttgggggtgtttgaggggggattggagtttgccctactgttatatgcgtaaacaaataggcggtgcttgcccaacattcttttactagcaacctagcaattatccaaaaacttcagtggcactagtgcattacccttacttggtgattggtgatcgccacaaagttggttaaccccaaaatcatttgttctgactctgtgtctgatgtccgttttgagttttcagggctactgccgttcagcttctttggctgatagatatcaagaaacattgcaaacaatggaacctgtgcaggaccagtttaggggttatggtcgaactcggaagtaagaggacgcattgcccttggtagtcagtttgtatgataaagcttcaagtaatcaggacagttatctgaggatcctcatctgcgcaaattgcaaatggacttagaatgcaaagaccttcattccccggccgtaagtggtgtgattgacacgcacatccttcctcgtgtgtggtaaattcgtgtaatcaaacataaggcttggaaaatgcccttttatcctcaagtgctttgaactgtaaattatataagctctatgatccttaggctaagcagttagtaaacgtggcaaaaaaaagtgtggaggtataccaaaagatgtaccaaaaagggtgaaataaggggaataaatgcatattttgggtcactgttttggaatcttgatcaacaaaaggatttgttcagttgtttcatctgggccaatatgcacgcaagtctcaaacgaggacaacacacaattttcaaggtacaagagcaaatatgtttatgaccagaggcatctcgattcatatcaacatctaaataaagttttctacaattgctgctgtttgttaaaaaaaaaaaaaaactaagatgagaatagcaacgttccgtttgctcattagctctggcacactgcaaagcacgaaaaaattcatcggacaaatctacagagataaaagtcttgcccataatgaaggtctgatgtatggaattattgattaccgtagtgaagtagttggtatatagatgacagatcaaacagcagcacggaaatgcttctgaacatgatgtgttgcacgcgtggctgaatcaacagtcactccccctttatttgagagaaactagataacatgtctgacctagaatttgctaattccacaattaattcaagtgctgcatgaaataaatatagagttagaccaacacacaaactgaggggttcaaactgacggtgcatgttcctgttagaaagaaccgaacctgtttcaaaggacatctgggccgatcgtagttttggagataccagtgctccaaaggttgatagtgcttttgatcttgccttctgaacctaaggtgcaaaatatcaagaaaaagttcggtaaaattttgaagtccaagaatatagtactacctccgttttaggttataaaattttctagcatttcccacattcatatagatattaatgaatctagacacacatatatgtttagattcattaacatatatatgaatgtgggcaatgctagaaagttttataacctgaaacggaggaagtagcacatagtaagaaactagttggtcaatggggggaagattggtcaaatgaactagtcaatgcacaaagaaaactctggctttgttggcatttacaaattagaatagtgactgctctacttttgttgttataagagacaccatcaattatgctctaatgttttcttccctagatgaagcaatatagcttggtaggtggacaactccaatttataacggttacaaaacgttttacaaaaaagagctataatgtatatatgcgagttccagtcttctatccttcatcatgtatataatgtaggcttcatattaaacttacatggctactagtgtccacactagtagcagactctgccggagttgcatctgaatcatggctgccatcttcttaacacgagaagatacgatgtgagcaaggagaactaagaaatattactaattatggattgtggaatgctaatacctggcgttgctgctgaccctcggtaccttaattttggcttagtagtatctcgcacaccgacagcgtcattggagttggatttttcttgcaagcaccactttgacaggataaaatgtgggtttggctctgaaacatgatcttagattagttcatgacgtgcaacatggaactaccagaatacttagatatacaagacaaaaaagataacacgagggcttctggagaaaacaatgatgtttgcaaatacgttttgacattgctagcaaggattaatagagagatgtttcacctgatgactgcgagtctgcagaatcaaccacttgcagcttgctagctgcagattgctctttgtgatcgaagagtgtactcgaaacacgtgatgtacccatcgagtgacgggcacttgccagatcaagccacccctagagacaaaacaaaaccattgttcatgctaatctgtgaactctgctactgttcagtaaatcagacaaagactaaacagcaataaaggacctcactctttcctaatcagtacatgaacaaggcagccaaaagagttcagttactgaaaattatcgagctaaagtgttaggagctctaatgggccatgtcatccattctccaaagcaagcccaagccagcccaagcaacagtaaagaaagtgaaggctgctgctcctgcagcacacatcgattgatcaattggattggcggagctgaagctcccggcggcggcggcgacttgggcggccggtgggcacccttgtcgatctctttcccctacctctcctcctacctccaaccttctctctctcagttctagaagcttctagaacttgtaatccctagtttcttcttctcttttcaccccaaaacacttgttgcttgtatggtggatgtttgctattgagttggaagaagtgggttcttaacataaaggtaaaaatcagcatccacacaagtttcagggcacttcactcggtggttgttggtgcaatacgagcaaaataatctgaacaagcattcttctccagaacaggattaggagctgattctaagtgacatgcagttggctagaattcaaagatcacgaactcgtttcttttcccctcccgatagttaactgcatgctactcctgtaataactatcgcttcatctggagttaaaactacatcgcagagcaaaggaaatccaagaaaaaaaacacgaatcacaacaaaccaagaaagaggtcgggggtggatgagcggagagcgggagccgtaccgggcggagaacggaggacagtgaatccatgaggaggaggtagccgtccacagagtccatgaaccgcaggatctcgtcgtcgtcgcctcgcccaagtcgtcccccctctgtggcctcgtcgacctcttccacttccccgactccagggacgacggatcccgtgattcgcagctgctcctccgtcgccgccgccatcgtacccggggatcccgtgcaaaccctcgctgtcgaagctcactggtgagtggcggaggccgagccgccgcggcggccggggaggatgcgcgtgggtctcgagtcctctgctcgtgcgatgcgggtgtgtgcgcttgccccgactcgtgagcgctaatacacggccggatctcgggcctacggcggcacgcttttgttgattgatcgtttcggtgtgataccgaaacaggagataaaatttaggaaaagtttatacttactaaagttttatttcggttttactatactatagtacttgcgatagttttttagtcgtaaaaactttcaaatcatgaacttcacatcaagattcatcagataataaaaattctcgcaaaacctgcggaagcgaggagtcgaacctacactgaacggagctaaatttattttatcttgctgaaactcttattaaattttattttagtgaactcttattaagaataagtgtcatgctttgagtacatacagaaaattgacgcgccaataggcgcacccatgacttcttatatctgcactataaaaattaaatatttgatagaacctattaatagcatttttaggtagtactccctccttccaaaaatctgagtcatatttctttttcatcaagaccaagaagcaattaatttattcaccatgtgacaaaaccaataaatatgcaaccaataagtattaaaatggcttcaacaatttaatttaacacataatgactacaaataggacttagacttttggaaaaaccaaagaatgaaatatgtcttagacttttgaaaggaggtatttattacttcatttgttccaaaatatatataataatttttagcttttataatttgttccaaaatataacaaattctccgcatactattctgaaaataaatttcaagaaagcatacgatcataacctacgaacatcctattcctaaccattcacaaccctttacaattctttttttacctacctccactttccatccaatcacattcttccccatttaattctaccaaatttcttaataaccatgttcaactataaaatttcttctattctaggttgaaggtagtaaaagatttacagtgccatatatttctataaatgtaaaagttttgaatgaaacaaaacttttatatgttttcacggttttatccatatttgtattatatttccatgttcttatttgaagtattgtatttgtctttcccgaatatagtaacataaatatttaagcacattaaatatttgacttattttgtttttctcatcaactaaaatacagacaagtaattatttatttgataaaatcatcctatgagtatataattgcatataattggttggaggtactattatgaaccttaaaagaattacaaggatcattctataaatatgaagtggagatgcagttaggcatgcacatagaccgttttctctcacgcttttctcgtctcacgtccgcgcaccgttttcccccttcttcacagttcacactctcctccaagaatgttcgtgttttttttccctaatcacatatgaacccagcccaaccaaagtgcaaccgtttagactcaaggaatcaaggcctagctgcctggagtgcacacgtgggcgatggccgaggggctgctgccattccattgcacgtgaggggcaatccgtgaatcacgccgcgtcacttggtagagctctctgcccgagaacgtgcacgaaattcgtattatagagatagattttctaaaatttttatctagttaaattaaacggttaatcggttaatatcattatttgtagggtttgtt

SEQ ID NO: 81104 - DNA, 13438 bp, Oryza sativa
ggaaggtaagctcaggcgggcatttctacaatttaaatcggtagccgcccgccgcgtcctccccctccgccgccgccgccgcggcgggcgactgccaccgcctcccgccgtccatcatcgccgatccctcctcgccggtgctcggctcgatctctccccgtcgctcgctgggcttttgggctgtgcgtgcggcgcctcgggtttgggttttgcgggggagcctgtgaatatgattggtatagttggcctaaaaggcccgcagcccgatggccctgcccacggcatagagatttggcccgacctaagcacggcacggcctacaccctccatcccaaataaagataaaccctgatgtccagattcatagccagagtttgtccttttttaggacggagggagtaactgttatcaggtccgtgctggctcagcctgactgttaggctgtgtctaggttcagtgcttagcacgacgtgctggtccggcacggtttggtccaacaattaggttggcaaaatagagttattttaaggagattatggtgggcttgtcgccggcacggcccaacgtgtcggtcgggttgtgccgacccgactaatcttactccccatctcaaaacacagaaacttaggattgaacgtatattttagtattgaatgttttctaggcttttcatattcgtattatattgtatttggctatttctttagcttgggaaaagtggagtacaaaagtattattggttcggctcagagtttactacaatggaaaactttatgcaccaacttgatttgatttgtcgatccgtatcaaactttatacacaaattacataattcgtgaagttactcgtgtgaccacagtgcatctctactaactaaaattagcctattattttgcaccctttattttcagctatgaaaattgacctctcctcattacaattcaaacttcagccaataggattgtaggaagctcttgtttgaggattcaaataaacttctactagagaattaatgtagaatctcaacggtacgtaattcctatgcttctcaagcaagaaataggaaaatgttttgtatcggcaatgtagtgctctgaggcccaaaaaaaggggggggtaaatgttgttgaagtaggaatgtgatgcctttgtgaggaccataagtggagcatggaactaaagggataggttaagaaagtgaggaaaaaatgcaaaaaaaaaacacctcttaagttatttgaactttgacatttcaccttataagttattttgttgcaaatgtttaccttctaattagtttttttttttgcaaaaaccaccataatgtgcacatgcttaaccaaatcaacatattttcatacattgtaagtcgtaatgtggtatttatcaaaattaaatacttctaggagtatagtcttccacttttcttggagatttcacaaatagaattgttgataagagtgtaaacatcatcgcactgagttttgctatatgtgaaaaaaatcaatgaaacataaaaataaatataatgcaagcacttaacaagattgacttggctaacttatcatgtggtggctctacatcagcgataatgggataatttggttaagcggcacttactcctgctagatatacctgactcccctatacaaaattattgatttccacaatctagttccttaatgtctacaataatctaagtagcctagtagagatcgaagccatgtgcactaccactctttgtcacagcctccctcacgctattgtatagtcctttcctcctcctatggctttgccaaaggtgagagaggagggccatgtttcttagtagtctctatttttagggttttcttaatgttgtctttagaggattagatgaatccgatttattttaggtttcttacatgatattcatgtagacttgtttagagttgtttgctttttttctctttctctctttgctagtagctacccttcctaaggtcattggtggaaagcctagaaaggattgtctgtcatgttgatgatcaaatcgattgtgccaactttaggatccgggttgtcaacttgtttggtgacattggttttttgttttgtctaaagaagagaaatggtggtagatacccgttcatctaattttgtgtgtgttagctgtggttgcgctcgtttgcacttatctcctttgacattcgaagatgcaaagtctctctattctacccgtagtaataggatgcatctcatccgatcttaggtttttatattttgggatagatataatatttaagataagatatgtttcttgaaaccgaaactctaaaatcatccccattagcataaagctgcttcatcatcatactcattcattcccacacatgactaaatagttgaagtcttcccttatttagctcctatcacatttgttttagttaatgtgttcttacttgtgcattacgcacgttattaatgcacttggtttgtgcctatctcatcttaacaagatgtcaccatcacggagaattagggcaagtactataagcctctgatcactaattctaatatgccatgtagactcatatgatgatatagaggggagaagagaagagagagagagagagagagaggagcagccgccactcatgcaagaggcaacctccgcacaaatttcaagaaatgagaaagaaagagagaagtggattggtagcaagtgtattgggtgtagtgtaagtagatgcaatctattgtatgtattacctataaattaatgtgtggatgatttggacaaaattagatgtgaccacttcctccattataaaacttgcccttatgctcaggaaattaattttgataggtactacatgaagtattatcaccaagaagtattaaattaaaaacatgagtataaagtccaaatgttgatagaagcacaattaaaatcactttagttgattattgccagtttcgttctagccaagaaagtcgagactttcattaaatttttaccctaaaagtctataaaattatatatatgcctactatcattcacctctttttttcaattatgaaaattgacccctcctagatctaattaaataggagtggacgttcggtcaggaccgaaagttcggtccgatttgtttaatattttaaaagttcggtctttcaaatctacaaaccgaatttatgtgaccggaggttcggttaaccaaaacttcccaatccgttgtttctatataatttaacatatatttattcatgtattccatagcaaaaggcacagtattgcggggctgtctggttcccagccattacttgccaataaaaattgccacacgttgtctaaggtgaggtgatcaaattcttagtcataacttactaagccacacttttttgagtcgttgacatgtgggacccaatttattagaagggaattttgtcacaactgtggctacaaacaaacacctattaaatttgcctaaccttaggtgtgacaagctgtggcaaagtgtggtttgcaaccaaacacaccctatctacaactcatactcattacacatgttttactcaatggaaggatggattaatgtgacatgtttcttgagctcctagacggtatgatttttgaaaaaaaaacttttgatatttgattttatttaaaaaatattttagttcattcgtttgtatcgttaaatagtcatcacgaaattattcaaaaaaaatataactttagtgattgctgacatgtgcattgcgtatgctatttatgcacttggtgagcgcctatcaactttctatccttttcttggtccttataagatgttgctatcactaagaatcatgatcaggaaattaaactacatgaatgctacatgaagaagtactagtaccaggaagttaaagaaaaaacgtgaatataaaatcaaaactcttatagatgtacaattgaaatcactttagctgattaatgccagtttctttctagccaaataaaaagtcaaaaattccattaatttttcaatctaaaagtctgtaaaacattactaaccgatgtaacccgtaggccgtatatcacgtcgtaccgtattgcccattactattaataaaaacgattatctaataatgtgatttagtaagataagtaacactccgtattaacaaaagacaaatctgacgagcagacaaatcatattgctaattgctgaatcaagagaaaaaaatataccaggtatgaaaatagtgaaaataaaccaaaagcagatacttagtttcgattttgatatatagttgtcgataaatttcctccaaaaaaattatcaaatgtaaatacaatagaattataatgtaattttattgcaactacaatgcaacttgtatgtaactttaacataattttaaaattttagatttacttcaagatttgtgcaagtttggaaaaaaatcataacgcgcacacaagtgatgagattcggtctcgcgacctccatttcacgaaaatagcgtgttattgtgattttttttaagttgtatacaaattagttatatgcaaattctagcgtagttacactctgcttgtactatatttacatctatcacattaatttgataaagaaaattatcgataaatgtatagctatttccctgtggttttgatccatggttttcgtagaagaaataaccacaaaagcttacgaattcgaaagcaaaccaccaccaccaccccggaaacttagacacacacacgctccctgtcccccctcctccccactcccttaatggccacctcctccaccgccgcgcgctcccctggcggcgaggtaaaaccagccacctttactaaccgaatcaattagagaaccgtatcaaatttcaacatcgacataattctcaacagagttgttaatagtgaaatttagtaagcccggagtaatcatcggcttagagttaacatcggcttcgaagtcctgagattagccgatgagagttatcaagtcgtcagttgtcggattcttgctatattcggttaaggaaattaatctactaaaggaagcttatccaaaaaagaccgagttcaaagagaatgcggcatggcaagttatctattaattaggaatagtttgttagtttcctttttatctttaggaaagtgtgttcagtgtcctataaggactttatgttttccttttatctttaggaaagtttctttattgtcctacaaggactagtatctacccatgggtataaatatgtacacccggggtcattgtaaactaacacacgttcaataacaatctcggcgcatcgccacccttttactttcgttttgttttgacgagttcttgctttcgggttgagcttcatcggtttcgatcttcaacaagaggtaaaacttgttatggcggcttgtgttctcgggattagtgcttccatctttatgacactctaatcttgtttatgtaattcgtcgagttatcatatatcctacataatctctgacaacatcgaaatctaacctacaatcggctaacatctgtcaatagaaggcagccgattaggttaaataccgatgttgacttagattatataggatatccaccactctatgacacatccaacagcttgattgtctagatattgtccttcttttcatacttatagctgcatcagttaagtttgatcttatgagtcgtgattagaatctcaatctctagcatgtttcttggttgccgattagggtagtatcggggtttcagccgatcttacctgatttaactactttttatcctatatacttgattgacatgttaaatctgccatttatgttaagatcttactgtatttaagtatattaggcttttgtttagtatattctacttgctttaatatcttaatatagagtggtatcggagtattagccgatacatgctagatctatctgatcagctatgctatgaacgtatatagtctcattattaatatatatttcgatctaagtgatttatactgtttcggcatggcgaccgatctaacccaatcacttgatttaagtatatatcgatataaggactacatattgttaatatctacagccgactgagtagatttagttctttcttacttattcatgactgccgatcgatgcatatatgacatcggctcaatgataaatgatatgttatcggcacctagccgatcggctatcgtttatggatttaaccacggtttcttgtatttgtttcttgttgattgcaggatcaaatcaactggcactctcatacacccgaaggcgagttttggacctgcactggagttaagcagatctcccaggcctcgtgttttacatcaacaagagtttattgcatttttaatctctaagagcaggtaaaatagcaggctataagccagctgcaaatatattttaaggagataaatgaggagagagaagagcagcgggctacatatttgtagccagctgtagcacggactccaagacgcagtgtgcgtatgacatgtgggaccatgtattaatagtgtagtatgtaaccattgtatgaatgagctattagattggctatagatgaattggagctagtagttggctatactattaaacatttaaacttgctctaagactctgtttagatgagactaaaattttaagtttctatcccatcgaatgtttggacactaattataaatattaaatatagactattaataaaacccatgcataatcatggactaattcacgaaacgaacctattgagcctaattaatccatgattagcctatatgatgctacagtaaacattttctaattatggattaattaggcttaaaaaatttgtcttgcaaattagctttcatttatatgtaattagttttgtaagtagtctatatttaatactttaaattagtgtctagataaagggaccaaagttaagtctctgggtccaaacaccacctaagtaatgctgatacgtgggccaccagtcggcagtcatagtaaaaaaaataaaaaggtggtgtatagtcgagtatctcccctcttccccctggcgtaaaagaaaaatctcccgtctcgtcgtcgcctccgctccttgcgccatctcgcggcgccgatctccttctggcgagccgagcagagcagaccagggcaggggagcggaggggatcctaggtgagcatccacatcctcttcctgattcatctctctccctcccaccgggagtacttctgtctggagtttgctcgcgttctttaatcctagcttctcttctagatctggaagaagctcttctgttaagttctgagcctttaaccttaatacaagtgacagtttgtgtttgttcagttgaatccgcccctgatacatttagtacaaaagaactgttttgcatcatgaactcattgtcttccttccttccaaccagtatgaacgattcggctagaactcactgttgtcgggatgtcaagtgcgagctgtttcctttttgcaactttatttatgtagattaggatgcgtttatgcatgcggaatcttggacatgtctaagcaatttctttactttcacgataggtgttgcagtttcttttctcgtggacggtctaaaggtggtgaagaggctgtacagatcacgatcccgcaagtgaggtttgaggatgatgaactaaagggcttgtccgagctactgcggcaggagatctgataaaaccagtcaagaggcgagtctcagaggtgctaggacgagatggatgaagttgctgagattgctgatgctatgggtacggttggcattgataatggggcaagccggaagttgttgtcgaacgagagtttagaggagcgaggagaagagcatgatgtgcaggctgatggggcgcactcgggtgagagtgaggtgatcaaccccgctgaggaggtgggtggagaagccacctcacagccagaagacgtaaagccgcgtgtttccaaggtaaagagttgacacattttgcagttgctgaggtcttctatgaaggtttttggtgacagttatggtaattttgtgttttgtagggaagccaaagtcattcccctaaggttactaccaaatctcagcgccagagcccacgaagtggagataagagtcaagctaggaaaaacagtcccggttctacttatcccaaggcacccattgcacgagtgtctgacccagatttggttgatagctcttcatgcaatgatggtgctgatattaagaaagtaaaggtcttttccattatgttgtattatatagtgctgaaatgcttagatcctgctatgtgcagtgttaggagacatctttatgcccaataatttaatataacatgaaattgcttttttgatgttttgatccagaaggctgaaaagagcagtttccgtccagttgccagggcgagtcaatcactggaggactcaaagtatgctgtttgtttgttgacagtatttttgtggcttagctgtttctgttttctcaagaaaaaataacttgtttggtgatggtctacatatccaattaagctattctgctttaacccattgattaagaaaaagcagggctttttttttgagtgaaagcgactaagcaagggggccttatgattgttgcatttctgatgttctgccccctcaaattatgccaaaagaattttcttgcttactattctcttatttttgcaaccataagcttttccatcttgtgagacctcagtcagtttaagcttgtttgaatactctttgcttataggcttattttttttgtgaaccattctaccaactaccaattgaagctcatattgatagtgtttcttgcattgacacattcctcatcaaacccagggaaaagaagaaaactcagaaaacatcaaaccaatgttctgtcaaaaatgatgaagaagagccaaactgtgaaaaagtaaagcctcaaagggttggcagcactcctgcgtacggatttgcattcaaatgtgatgagagagctgaaaaaagaagagaggtaaacttgttactagataacatttgcaccgaatttagtctcatacatatggacatcattcctttccttacacattctgcaatcaaatagttctactcaaagcttgaggagaagattcatgcacaggaattggagaaaagcaacatgcaggcgaaatcaaaggttcatacgttatgtctcttttcatggaaatgaacaatcaatcagttgtaatattcaagtcaaccagacattttcataaaatctttgcattgtttgtttctttataccatgcaggaaacagaagaagctgaactcaaaaagctaaggaagagtttgaattttagggcaaatccaatgcccagcttttataaggaaccacctcctcccaaggttgagttgaaaaaggtaattctctcgcttgagatatacatgtaaggaaaggaaaatttaagattatagaccatttacctactgattcacagtaggacctttggcagtcttcttttattttagttacacaatctatacttgctaaaaccagttcctgtgctgcctgtagttatatgtacaagtacacagcaggggcaggcctccaactccaaaatttaactccagctgggtctggagtggagttgtggagcagcctgaaccatgctccacctccctagttcattttcttatagcactccagcccactccgcttccttttggggtgcagctgaaaccagctccagctccaagagaggtagaggtggagctagagctggagctctgccaaacaggccctactttcacacattcacatatagtcatgaatggctctacattgttcaaaattttggctaacttaattactttaggtagccaatttcatggctgtttcctataagtagctagcaagctgttaacttttcatagaggtgatcagttctgttgatcagctgttcaggatattttatttacttgtattattatgtagctgttggcccatctattgctacgaatttgaactcagtcatgtttctttgatgagttaatttttagatggtttctttgatgagtttgttgcaagtttaccatctgcaatttgctgatctttgaaaaagataagtcctttcctgagaaaaagacatccataccaacttaagttaattcttggcttgctcccaccagatggttggttctttgctgagcattggaacttttgcttagcaacatgtcaaatatttatacttactagaaaaaaatgcccgtgcgttgcaacgggtgaaagctcttttaatcttattactgttatatggtttagttaaggtgaaattcactgtgacaattcgcttggatgcattttttttttaaaaaatcatgagctgcggttaggagtctgatcgtctaaaattagcatgcgagttttcttaaagagatttcttatacaactcttcttgggtttccaaaaacgaacgagctttaaaaccgacttaaatacggacatgtatttccaaaaacaaacaaacttaaaaaccggctcatatatggatgacgtaccaaagtaccggtaaaaacatcttcaattttataatagtagagagtagagatttacataatttttttaataagacaaataatcaaatttaatggttaaagtcatctgcctcaaaatatttatgacaagatggagtaatgtatatgtatattatgcaatagaggagaagtgatttaactggctagcgatcacatgtttcctgcatgattgatttgtggggtagcttttgcaagagcaaaaatatcagctagcaaaagcaggtccaattttaatcgtttaaatccaaatatgtgggaccactgcaacgctcggtttctggttgaaagtcggaaccccatccggtatctttgctgcgaccctgctttgggaccgacatgagtcggactctgcactgctcgtgcagcttcacacgtccagggctccaggctatgcttcgcagggacatgtaagaccaatagaattcgaagacagctgacggacggaagattttgaatgatttaatttttataataggtaaaaatatataggtaaagattaggataagatacatctagaaaacataaatggattcggatgacgtaccaaaatcttgacaaaaacatcttcaatttttataatagtagagatgtgcattttctgttcttctgataaatgatacttatttaccgtcattcattgcagatccctaccaccagagctagatcaccaaagcttggccgctcaaagaacacaagctcagtaagcactgaagaaagtaccgttccttcaagccgcccagctcgtctgagcctggatgaaagggcctcccagaatggtgtgaagaaggtgcctgctgcgaacacggtgaggaagccccaacggaagtctctccccaaactgccatcagagcaaacagtcactgaacaggtagaaaacaacacgtcggctacagatcccgttcgggagctgatccgtgcccaagttaccccggatgatcaatttggtggatagaaaagctaccaatttgagccgcccaaagaaacgcgcaagttatgcctcaacttcctatatttcattctctgctatttctgctgtaaaactgctggatatgccactactatgtactaaaattagtcctcatcaccaggagtttcgaagaacgcaagtagcccctgtaatgtttatcttgtcaatttttgttcttgatacaagagaggaggaacctactgttgttatttgtagttggtaacaattgcatatgaccatatcctatttcctaggctagaagaacttattatttccatatgaattaccctgcctttttctctttagcaaataagcaataaactttgtgcattctatcttgttaagttggtgtggaactttggcttaaatgatttctgttctggaagggagatgagagccttgcagttgctgatctagctagaacatacttggctgtggcttatttatttcacaagcgttgctgatacagtgatacacatgtacaagaagtaaacaagatcatcatgtaggctttgcaggctcattttacaagatcgactacaccttagctgcgtggtgctcttctccagattcatttttacaggtggccggattcagctgcgagccacggcgagggtcgccgggccggcgagccggcgacgtcgacgacggccggtgcctcgccggagagaggccgccgtgattcctcctcgggtgttcgttgcttcgtcttctttacaggcggcgagagatcaagagcatctgttcactcaagacgccgctgtgatggaaggaggctgagctgcccccatgaacggcggcggcggctgctcgccgccgtggtcgtcatcgtcttcctcggcgtcccagaggaagccggcgtaggagccgaggacgtagctgcaggagaagcgagacatcatcaagaaggaattgcctgagaaggtggcggcggcgcgtgggctcaccagtcgtcgggggcggcgtggacggcgcgggtgaagtaggcgtcggcgcggtcggcgtcgcgggtggtctcccagacgaggcccgcgtagagcgcgagggcgtcgccgtcgccggggttggcgacgatggcgcgctcgcagtactcctgcgccctcgccgcgtcgccctccacctccttgaggaacctcgcgtagttgccgagcagcagcgggttcgccgggtcggcctggatcatacgccggtagtgcgcgtcggcgtcgcggcggccgccgtcgcccttccccccgctgccgccgccgccgccgttgcacaccttcctcccgccgcctcctcccccgacgccctcctcgacgaccgccgcgtcgccctccctccccctccccgtgtccgcgtccagcccggtgctcgtcagcagccgccgcagcggcacggccgccccgagcacatcctcctcctcctcctcctcttcttcaacctcctcctcgacggagatggacgccgacgaggccacggacagcgcccgcggccgcgcactcaccgccgccatcaggtccccctcggacgtcgcgcggcacagcggcgggccccgctgcctcgccgccgccggcgacacgggcaccaccaccaccaccgccccgacatgctccgccgccgacgcgcacgcggcgtggccgagcagcggcgacgacgcgctccgcagcagcatcgccttcgccccgatctctcgtctcctctcctcttggctttctttgccgcgcgagagaaatatcgcgagcgagtgcgagtgagccactgacagggtggggggcgggggatatttatagggcccgcgcggccgtgggtgattggacgtttgggcgcgcacgtgacggcggccacggtggagggcggggagtgggcgtgatgggggtggggcccacggggtggttgtcgggtgggcccgggaggggga

SEQ ID NO: 81105 - DNA, 1324 bp, Oryza sativa
ggggcgatggtaggggcacacggctggaatgtggtccagactactattcctatatcctcgtgggctagccgcctggccgggagttaaaaagtctatgtttattcgtgctgatggatctgtactatatgagagcggtccagaatgtaagaattatttatgtgatttttaaatggtaaggagctagatataatagagtttttgactttgagtcagcaatatgcgacgaagcagactgagctatcaatttttaaattcagtttgatactcaaggtcgaagtccattctttcataagagatgggattgaacccctaatatagggagtataattgtggctattgaaacaaagccatatttcccctggacaatgcaaacataagacttgctatgtaattcatctgtcctaaaatataaatatttttaaatctcgacacagtgttcgagatactactttgataaacaatatctataaaaataaaatgttttaaataaaaagagttgcatattataataatttgattaatgataaatctagtaacatcaatttgacattattgatcttttttatttttttttgctattaatagtcaaagttaaaaaatggttgatttggtactatgctgaaaatgcttatattttagaacggagagagtactaacaagatagatagagtagttgtatatatatatcacaatatcaatctttccctccaagcatctactccatagttaactactccctccgtcccataatataagggattttgagtttttgcttgcaacgtttgaccactcgtcttatttaaaattttttgaaattattaattattttatttgtgacttactttatttctacagtactttaagcacaacttttcgtattttatatttgcaaaaaaatttgaataagacgagtggtcaaacgttgcaagcaaaaactgaaaatcccttatattgtgggacggagggagtacttaccaaactacgttataatcgtttatatatacacattacggtgctacctagttcaccttttaataatcaacaatttttttaaaaaaaataatcaaaaatttcaggccctgtttgaccatgttcgaagggaaatatgtaaacatgcaagtacaaatagctttaagaaaatactaatatgggttagcacttggagcttggaagtcgtatgttcttgaggagagctaaccgacttgtgattttctttttgttgacagtattatttaagtagcactctacttccatgcaaagatatccaacagaatattcctataattaattgtcatgcgtcttgcaatttgacagggctgcagga

SEQ ID NO: 81106 - DNA, 14358 bp, Oryza sativa
ctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagtataactgttgtgatataacatgacagttaggaattgtaccagtacgccagcaaagatgtctcaatgatctgatggttatcgcttcatttctgggaaatgaaaattaagagagatgccaccatagcttcaaattctgtcctgaaggcaccgtcttgcacttcaaaaaagtagctacttaaccagtaaaatcatgtatcgtcattatctctacagtcagccatgtcaataaatgatggccgatttgccaaacagctccgtaattcaatcaagggagagatttttcttcattgcttcatacactaggtaggtaatacttgctgcaggcaccactttaagaagatttggtaggattcctttgtagaatccagaaacaccctcatgctgtagcgttctccagaatacatcagacatacctctatatgcagattctgaattggctcgttgagcttgcagtctacaaagatttaaaagtactgttgagaaagagtgtgtgtttgcttcttttctttacaagtcgacaatgcattcttaccttgtcctgataacctgtaaagggtaaacacatgttgcccccaaggctcctgatacagtcccacagcccagttgtactagaggaccaggatctacacaaccatgataaaattcaagaatcaagaaacggagttgaaaagcaaaagggtaggaaacagaaacagtttctgaatggaggctcaccactatccttcaggatatatgtcttggatacgtctttcaatgtctcatatacagcaagatcaattccggcataagggacaataccaagcaaagatggaaccagacctctatagaatgctcgaggaccctcgtgcatcaatatatcccttgacaatgcaccaagactaggtactttaccatccacacatgaataagtctgcagtcgtgttttcactaaatctacgggataaattgctgtttgtgctactgcaccagccaaaccaccagctacaagacgttcagaaggaccaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgcaagctcctcatcatcaatctctatacctgcaaacaacaagctgacattgcttgtaagatatattatggatgtgcaaacaataaaatctctaaataacccaactatgaatatatttaagacttcaggcaaagcagaaccaaggaagcaaacaatgtgtatgcttttttaaatttgacagaaggtatatttttggtagaagataccataaattaataaggtatagctaaataatgcaaagtcagattgtgctctcctgcaagctcaacatccataggaaagaaaattatttttggtcatacttgagacaaaaatatgatcacatgaagttaagaacttaagatgatagtgttttcaactctgaatgaagaattgtaatctaatatgaattgctccgtgatatggttgaaattaaaaccatcttaactaaatgttcaatgcaaaaaaaacttcctgaacaaagaccgccctaccacatttaatctttcttctcagccttttgagaaatattctattacaaaaatcatccacgtcaagctttggcatgagaaggtatagctgatataccagttttatcattattagttctcaagtcaagctagtatgttactccgtaccagttcaaaacaaatcataaatataccgcctacctaaattcaccttaaggaattccacttagataatgcattggccagctacaattacctctaaatcgaattcatataccccgtgctaaaatttgaaaaaggaacatggtactcaccatggccatctttcactaattatgcaaggccaaaagtttgggcccaattgattggaagctgcttcagccaccttcttgaagtgattttatcatgtgagaatgcttcgacttcacctgaggcactcaaattcggttgcctatactacgaaagtcttagtatgggaacatagtcttggatctatatgctgtatcaataagggattcagtcttctgaaactaatagagttcgccttgaacagggaataaggaaaataactaaaacgtttgcactcttaaactgcctccagtttttggactctgtgacaatctaatatctaacaagaaactgataagtctttgaggctatatatttgctctcataactatatatcacaagattaacgaagcataaaatccaacattaatcagtcaaaaaatgaggaaccaattcaacttattcagtggaagcaggttattgtaatgaatctaataaaatatggaactcaatatgtggaactgcttaacaagagaggatttaggacaaatgcaacgcatcaataggattggattctatgagcttcaacacttatatatggtagatgaacacctaatatgaaaacctgtgagcggtggcaaatacaaggcttatcctgtttgatgtgatggcaaatacaatgtcttatgttgatcagccctagttccagtgaatctaactacagaataattacattcagcaggcaataatatgcaatactgataggaaaatgatttcagagatccaagttcacattgcactagtgaaacgtgatcccgtaggatcatagtcatgccactactaagtggttaggctcaatccttcctcaaatattgtgggaaaatggacaaaatctagtagcatgttaactgaaaattttcagatgctcccaaggttccactactcaatgtcagtagatgacactgttctaaaactcagccctaggctaggtaccagtgtaccacctaggtgactattgggcgctaggtgcccggtggccgcaccaattaggcattatatggtgctttagtcaaccgaactatccttgagggctcttgtgctcatattttagtgttctattgtcttaacttttatgtgatatgctcactaattgcttggtttcactagtcgcgttggacctaggtactggacatgccgaccatctagtgcctaccgccttattgaatgttccctacaagtaccattaagctccattggtatcagtacattgttcgccgcataaggacttcttcccgtcttcaaacattacaacacacatctacccatcgagtaaaccaaaaccaaaaaaaaggaacaattccaatgtatggctacaaattcaccacgagcatccagcaacaatcaagtaaagtaataatgcgtttgaaaccacatttcgccgaacacgtcagaatacggacagcggagcgacgtgtgacagcacgggaaggaggcgatcaatggctgcggaaggtgagggtgaaggtgaggcgagcgcatacataccagccttgacgagcgcgtcccagagctcctcggggaggatgcagccgttgtgctcgacgtcgatggcctggaagatgcggtagagctcgagctccttgtcgtccatgtaccgcctgaagtcgtcgtacccgacgcggccgtcgcggtcgcggtcgcaggcgcggagcagctcccgcgcgtacttgcactcggcggggatctgcagcgcggcgagcccggcctcgatctgcgcgtagtccagctgcccgcgcccgtccacgtcgaagaaggcgaacatctcccggatccgcgcctccctctccgcctccgtctcgtgcagcgccagcagcacgtgctccatggtcaccgcccccgccttccgcgccggctcgcaccctcccgccgccgccgctgcagccgtcgccgcctccgccttggcgacggggggcggggaggcgccgccccgtgggtccaccgcgtggaccgccgcgccgggcatggcgccggcggcgaggaaggaatgggggtgagggggaggcggcggcggcggcggcgccggtggtggtggtggtgggttgggttggtttggggaatggaatgggaatggaaagaggaggaaaggttggagaaggggaagggaatatacgtggatgtgagaggctgcatacggtatgtatgtatgtatgtatgtatgtatgtatgtatgtatacgtattggaataccgtattttttggggctcatggaatacgggaaaaatccgtatgtgtgggaggggcgcgcggctggatcggtatgggcagccgggtgccgtgcgatgggggacggatggttagatatccacgtggtcacgtggagatcttttctcgaataataaacaatactatttgaaatgaatgaattcttccgcagttccattccaagaagcctggaggtagttttggaaatataaagaaaaaaagacaataaaaacaataatattgcattgacactacaatatttatatcttatatgtttactattttctatataccattattaatcctaaacaacattagacggagtagaaaagattttttttaaaatataatactagcactatgacataatcacatgaaacattttcgataagactttattggcatggttctttttctgactgtgagaaaaaatgaggggttgataaaaattatgctcatgttacatctcgtgtctcgttagacctgtcatggcaccgccacctacatcacttgccattgtccataggacttagctacattggtgtcaccgacacgtcgtgtcacattgaactcgctacccttcactggattgtcttctcctcagtcgctctctaagcatgccatctcccaaacacccttcggaccttcacatcacaaaccctacacgtaaaataccaacccgatagaaccgttgaatagcatcgatagtctaaggtgaacgttttgtatccatagaaagcactcgtcgagacagttcaattgagaggtagaaaagaattagatatttgttggtatgttggtatgttggtatgattcggtagagaagaagcaacctgataaaagaaacaattttagggcccatttgaatcacaggaatgaaaaaacggagaaataggaaaaacataggattctgacaggaatgtaagtgtaaaacagaggattgcaaaacacagaaaaaacataggaatgaccgtttgattggaccacaggaaaaacgtaggaatttgaggagagataaagactcaaaggatttcttccataaggttctacctcttgttaaaattcctccaaaacttatatgggaagaggcattccataggaatttcatatgattccatagggttcattcctttgattcaaagggttttgtaggaaaaattcctataggaataaaatcctctaaaattcctataaatttcctttgaatcaaagggggccttagaaaagaaaatctcatatatttatatttttttcccttgagtgctaagaccacctcctgcatataggtcgggtggatggtccaacctcgtgcgagttgtgaatgctagtagtccccttcgtgtatcttgctggtgtctgaatacatttgatcgagccagcgaagtgcaagtgattctgatttcgagactgatggacagtgatgtatgatggtgtgatcacgagatttgtttctactccctccgtctcataataagtgacgtttttgactttttatttgtaacgtttgactattcgttttatttgaaaaattaatgcaaatataaaaaaagataagtcatatgtaaagtacttttgataataaagcaattgacaaacaaaataaataataattcaattttttttaaataagacaaatgattaaacattgacaaacaaaaactcaaaaagacaagtaatatgggacgcatgtaatagctgctgctaatactacttaaaatacctaccgtcctgtacaaccacctcgtgcttattttcagccccatcgttttgtacgcatgtgagaatgagctgtgatagataggtgcctaattcaagaatcatatctaaggtaggtccaggtactccggttctaatattaaacaaattcctagtacaagtatttcaaatagcaattacaattattttgagctagtatgattgaccaatatcatacttggctgagtctcatattgtaggaaaagttttccacgcacaagaaacgacaaactcattagcacataatttattaagtattaactatagtataaacttaaaaaatagatttatttaatttttttaaataacttatatatagaactttttttttaaaaaacatactatttaacaatttgaaaaacatgataacagaaaagagcagggcctggaaaattttcactctccctgcaaagattacaaataaaccccaaaaatgaaaattcatgatctacatgatgtaggctgagtttttgtttagataatggtgtaggcttcagtttattacaaagaaatattttcaacggggaatccatggttaatagtgacctgacgatcctattcatctcgaacgatctttgtagcgtcctgcccaatttgcaccttaaatatttcccctggaatctcaatcatgccaacgtttggcttattttgtttggaggatgtatggacactgagaaatggggaataaatatggaaagggataggcttaatacagaagaaagggaaatgaccaaagactatggcaaaagcaggaaagctgggaagcatcagctggtccaaagcagagcaggtctggctaccattttctccaaaacttccatgttacaactgaaagaccagatcagcaccaaaatttggtgcaacaagcagcatctgagagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactaccaggatgtatcttggttcaggcaaatgctaggaccagctgaaatcttcagaattccagacaagttggccaaccaaattcagactacaagcagtgcatagaaggtgataggctaactgtaatgtgagatagctttcactgctgaaactatcaatctagaaaaagcaccgacctagtgaaagaaaattcaaggtaaacagttcacttagaaatttcaaattctggtcactggccagtgatatagaaatttcaaattctggtcactggccagtgatattaaaaaggtaaacatgcttctgaaacttactgctcctactaccttttcccagaatgtgacgttgttactgtcaagtatagaaatccttgtccatgtattaaaacttggagaaagcagcatggtttgactcaagattacaagtctgctctgtcttgtccaattcaaagattggaaaggagatatacagttcatgcagaaaaaatttctccagacaggcacattgaccatgtgtagctgacaaccaccactcaaagctgtcttgaatcccacaggtaaaacctactctactaaagtacgtaccaagcttttgacacaatgtgccacaacaccaagttgtccaagacttcagtagtatgtatattcaggtcaaatctccaacaaaacatgcctattatttcagtactcccatgaggaaaatcatgattcgtgcaaaagaatagcatcaactgatcaaccaaattttgactagaaataggcgtgacaccctattattgggctggaaattacatatctagaagcaccacccaacagtgcaaggtttccaattatgcagcacaatctgaatcttgctactctatgtggtgagaaagggaggcaggttccccttcgtgccgatcactggagcctgagtgtcagggaagaatttcgctcctgggagctctgtcaccgtgccttccttcgtaacacgtaccgggtaggtcagcaggtgcccaggaaggtcatcgttaagctcatcgctcgcgtagaggtcccagtacttgtcagccatcttgttcaccctctgaacacactccaggctctctgggttcaggaagttgtcatgcagcatgccaaggtgctcataccacaacgacatccggaaaccgtggatttgtcctcttgcaaccaggcccttggtgttcaggtggcatggctggaatgcacccatggcgatctcggagtctctgcccccatccatggacctctggttgatgttggcagatccaacaatgatgtactcgtcgtcaactgaaacaaaccaaggatattaagttccaacaaatttatctttatcaacatgaagcatgtcatcaaagcacaggtactgaaataagagccagtgacaatatattgtctatcttacaacaaggaatgaagtaattgcgtatgttgcctagtgacaaggaaattgaactgtgatgtaaaagtctttcctaacatgtgggtgtcgaaattggggcaagtagttatgagtgtataaacataaaatgggacattggagatccataagaggtgctgcgattctgatttgtgaattcttaaagatgttaaacaatgcaaaaaagatcatgtgtcagctgcaatctggagtaaatttagagaacttgtgacaataatgtttttaagcatacctatcatcatcttggagtgaacatagatcatgaaccggcgtgccttctgtgccttagcatagtctgtgccatccaaagggcgacctgcaggttcatactcaccattcaactttacttccctgttccctaagcagaagaaggtaaggtaatccctcgggtcagcattgatcctcttcgcctcaagtgcaacggcaatatcatagtacatcatctccattgtcctcctctgccaatccagtattgcctgcactgatccactagcaggaggtccttcaggccacattggcagcacaacatagactgcaaaacgctcaccagcttcaatcttgttcacaatcttcagagaaatctctctgggaatcagatgcaacgcctcaatgtcttctggtctgatgccatcggctttccatgcaaatgagctgccaaggaagtactgattctcgatgtagatgaagttcttggcgcggcgaattgcgtggatgtatgcatcttggatgctcctgtcaatggtgttgttcttgccactgacaaggcctgatcttgcagcagcctctggagtgctagggaagccaaagcaggcgccgccatcgatggaccggaacaactgaacactccaggcctcaccgtcatcggggaacatcaccggagacggcggaataatgaggtcggccatggctttgaggtctaggaggaggtccttgtcaccgccttgcttcctccaccgctgctcgaagttgtagagcacatcccaagccgcggggccttcgatcttggagtggatgtcgtgccatggctccctcggcccgcccttggtgacggccgcgccgtcgaggttgggctggtggaagtcgctgtggtgcgccgtgtcgagcgtccggaagagggagtggaactgcgtgtcgtagcggccgtcgcagaggtcgaggccgccgacgaagctgacgatgcggcggctgccaccgccacgcggcactggcatgtcgtggtcgacgatgacggtcttctggtggtgggtgatcatgtaggcgatctgcgcgcccatgatggcgctccggccggcgtcggggttccgcgggcagaggacgcagcgcacgtcggtgccgcggaagtagtccgccgtctcggcgtcgtgcgtcgacatgaacccccacttcatgccgagcgactcgacggaggtgcggtcgtcccagaccagcaacagcacgcgcacgccctcgctggccttgcgcttgaggagctcgccgagggtggcgtcgccgccggggcgctgccgggtgccgtcacggatgagcgtgatctcggtgtacacggaccagccggtgaggtatatgaggtgcttggcgttgctgatggcgtcgaacacgtcctcccagcaccgcccctgccggtagtacccgccgccggcgagcgggatcctgggcgcgaacgcgtcgggcacgtgcgcgtcctggtacagggtgaccctgcacccggggcgctgcgagaagaaggtgtacggcacgccggggtaccgcgcgccggagacgcccctgccccacccatggcggtcgccggcgacgtcgcggaactgcagccgcacgtgtatcgtcggcccgtgcgagatcctcctcctgccggcgtcgaggatgtcgaggcggcgctcgatggcctcgccggacaggagctccctgacggggaggtaggcgcggccgatgagcgtggcgccgatgggctgcgccgccttgacggagaacaccacgtcggcggcgaagtgggcgcagtagatgtggaacacctcgtaccaccgcgggttcaccggctcgtcgtcgacgacccgcgtccgccccacccgcgcccggccgaggtcgatcgtcgcgtacagccgcgtcgcccccttcccgagccccagcgagtcctcgaacccttccacgaactgcacgaacggattcaaaaatcaaaccaacaccaaaattcgcgcctcctcttggattgctccaaccaaaaatctctcaccactaaattggatcgattttgagctcgaagagagagcgggattcgactgaccttgcggaagatcccgggggcggcgccggtggcgcgggtggggttggagaggtggtcggcctcgaggatggtggcctcgagcgtgccgtgcagcagcaggtgagccatggtcgctcctcctcggctccgccgccgcccgccgccgccgccgccgctgccgctgacgtcacctgctcgcggcgcgtccaatacgagcttccctccgagacgaaggggacagtgcaccaacaaggcgaaaagcgtccaattaggagagggaaatggaaaaggagagattctagccttttattttgatttcctttgctccaaagaaaaagacgtggcgtttgggatagttattaatgtcggatcggaaaatcccgtaaaaaaagttggaacagaaaatatttgggaaattggaaagaagttaaagggagaattttgggaagaagttaagggctgcttcatacagaatattaactaatttatgtggagtttctactatgtaaataagttagtacaataacagactataagccagctataaacatatatggagtaaataaatgagaagagataagagcagcggacaatagatttgtagccacctgtagcacagactataagacgcaatgtgtgtatcataggtgggaccagatattacttgtatagtagtatatgtttataggtaactattgtatgaattaactattttatgatttagagtcagtagttggctatactattaaacttgctctaatatagaggatttggggacggatcaagacaagaaactaataaaacatgggaaggctttggtaaaagaaaaatacaatattggcagggattaaactttgttgtctttgaaccattttgaaccattttaacaaaccaattaacttaagtcctatttggcatgccttcgaatttgatattcggggtagatttaaagtttgtatgctaaattatattgtgtaaaagaaaaaaaaattctaaacttcatataaaataggaatgaaatgatttattcaaatgttatcaatgtaattgaaaatctagatccataaatttgtaaagctagtaatatccaacttaaaacaaaaatgagtccaaagccgtgctaaagatgggtgagggttgtgaacactgaacactcaccttccgacatagaaaactgagcaatgaattagtgcacgattaattaaatattagctaaaaattaaaaattgggttaatatgattttttaaaaacaactttcatataaaatttaatgtaaaaacacacagtttagcagtttggaaagcgtgcgcgtgtggaaaacgaaggagagaagtttggaacacccacagacgaactcagcttttattggggagttaagacctttgatctccttcccgtttgcatggttataatttatgggacagtagaaataccccgtagcaagtcactatagtaacatgcaacgacgatgataacttaaacacactagtcatatccatattcatatctagaagtggttttgttaacgacgagtatctactgatggacccacattccatattattccatagattcgccgctatgtctcatgacctaaagttgtattctataaatacgtcgtttcctattgttgaaattgactaatgagtactccctccgaaaaactatatcctaggtcaagattatcatatcttgatctaggttgatttttttgacggagagagtatccaaattcattgttttaagtggtatcaaatccttatcttgattgtttttttttaacggtggaagtactgagtagtgattactcggagatgagaaaaatcggtggaaatgtgcccactaaccacgcatctaatcatctaggagtatcacactatcacacacacacacaccaccgtgacaccaggtcaccaacaaagtgtcaaccacaagacagacaaagaccaccagaaggcacaattggggggtccaggactgcccaccacgagcataaacgaggcgtacgcatccgcatcgcaatcgcaatcgcaaccacatgccgttcagtcgctgtagatcgtggagctggaggtcaagctcggtgtagtacgagattcgccaccacgcacagctcccggtgcacaagaaagcagaacggagcccatgcatggaaaaacgatcagaattcacaagaacacaggtgtgtgtacctgtgacactgtgagcttttgattcgcatgttgattgatctgctgcacatgttaattaaccgtgtggcatgaacgcatgcatgatgagcaaacgcttcacaggaggaaattaacgatgcattttatagtggatgcagcgtggaggaactggccgatcggagcaatagtttcttattcccaaagacggggagacagacgtaaaggaatccaatgacttgcgctttcggtatctagcttgggtctattcttcagagttattaaaagattgtgagaatttagttgactagtgagaacttagaaaggactactttctcagtttcaagttataaaattttctattacccacatttacatatatgttaatgaatatatgtcagtatttattaacatatatatgaaatggaggtaatagtaaattgttatgcatagtacgtccaatcaataggtccagcacatacgtatatatgtatagcagtactcatttagaaaaagaatgggctacatttaaggtcccacatctttcaacgaaaaagagttaaatttttgttacactctaaattacatgtaattacactgtaagtttgaaagcttatattgtatttataacttagtactcactccgttttaaaatgtaagtcattctagcat

SEQ ID NO: 81107 - DNA, 85160 bp, Oryza sativa
  unsure (1)..(85160): unsure at all n locations
ttttctacacacggagataatcataatccttgtctcatgcatgcatgattgaattacgtaaaggaaaagcgacgctgaaggttcttgctgagataaaagtagtaggatatgtatatatacgtgatgcaaatatgtgcccactggcgcgtgtacatgttgcaaaatactggtctcgaagaggaaagaaaagtcgcgaaaaatgaaaaatactaaccttgctcttctgttttggaaccagacctccacctgccttggcctgaggttcagttgcttcgctaaagcgactttatgcttctgctcgaagaaacaaaacaaaagcggtggttcagtgacccatatatattcgatcaaaaaagatgaacaaaacacaaattaatatgcgccatgtttttatcttaatttgctccttgtgttctactacaagtgcagctttctgcagctaggctaagcggcggcaagtcaatagaacgtaaggagaacgcgcggacgtacgtgacgtaccgggttgagcgtgctgtgctcccggaagcggtcctccaggagcgcggactgctccttggtcagccggagcttcttgcgggtgctcccgtcgtcgtcgtcgtcacgcccggccgccgtcgacgacaccctctcgccgtcggccttctccgcgcgctccctcttcacggccgccgccgccgccgcgccgacggacagcgacgacacgttgtgcgcagggccgcccccgccggacgcggtcgcggttgcggtcgcggccgcgccggccgccgcgtcgtcgggcaagctcagggtcagcgacggctccagcggcgggcactgcgacgacggcgacggccgccggcagccgccacggtgcgccgccgccgcgtcggtcgtccctcctcctcccccgccgagggacaggcccagcgccaggccggcgtcgctcaggtgaccgacgtcctcctgagccatgttgacgacggataatccaccagcagcagctgctcctgtcgccgccacttcgattcgcttctcgtgcgtgccagggctcgccgtctctctctcgtctctcgcgcgcgaggtgcaagcaagcgagcgtgcgtatcggtaggggagaggaggagacgagaggcgaggccggcggaaaggagaaggaaggaatgagagctcagctcagctcgggggaatgaattggttggggagttgagaatatttgaggagggcgccgcggggagacaagcggagacacgaacacccacccgcccacatcacacgggcgcagctcgcacacgcggacgcactccaaaggtttgacgagccaagccaattctgctagcctttttcctttattttcattctttcttctgaaaattactactactgcataaaaaagtttgggttttttatttttcggtttggatgattggattgagcgcgtttggaaggccacgtgggcgcccatgtgtaaaaagggcccggaaatattagaagcgtccatgtcattctcaaacccactgtgtatgcaccagtactagtttgcccatttttcttcttaactcgtgccggcccaattgcaaacatgcatccataatttgcatagtatttcaaaaggcgacgcatgcgaaattaatcaaccgatcgggaaatgaaagagcaatctatatatggcgaaatggatggctacggtggtgttcttttcttctgaagatgaaagattaaatttttttacgtaaaatgagatggtattaacgtatgattgattgagttttaattattacaaacttaaaaaatagattaatattatattttagagcaactttcatatagaaagttttcacagttgaaaagcgcggcacgaaaatcttaatctttatctaactcttatcggagaaaagaaagagacctaggttgcttatactattcgtgtgacttgctaatggcggggcacgtatacctgcgttctagagcagttaggtatgtcgtagctgtgtttgtatgagcgcacgcgttagttaaggttcactataaaaaacggtttttaaacaggcggctaaaatcgattaatcgactgagaggcacggttcggacgacctcttctaataaaaggtccataaaaatcatcatttttacggaggatttttttaagacagcggtatgtgaaaattgatcttcacatatgactaggttaagaccaactagtcaacgatttttggtgtaaaaaaccgaaaacaaatccaatcacagcctacaatcagatttagtacacatcaaattcacattcaacatacacagtcagttttaaaaaaaacattgacaaaattcacacaaactccccaaatccaagaaacaaaaatcattgacacgccatatcggtccctcctgagaccgtggatgtaaccggtatcggatccactgctgaatttgaagcattggacttggggctctccatagcgtctgattgagcaaacaagcatgacggtgcaaggggagtggtcaacgacggtggcgacatgtctatggctatatttgcaagagctggatccaactccctagtctagttttccgcgcgtacgtttcttcaaactgctaaacgatgtgttttttaaaaaagtttctatacaaaatttctaaaaaaaaaatcatattgatccatttttttaaaaaaatagcaaatacttaattaatcatagtactaatggaccgctccgtttttcgtgcatactatttggttggaaaccagctcttgccaacacagctaggagatagcagagaaggagagggcaggcataacggtgagataaggggagagggaggagaggagaggggacttaagtccctcagccggcccgccactattttagggtgtgtttggttcccggtcaaggttggatgggacatggcaatccatattttattggatatggcgatccagttttttgtttggtagagtgaatatgacaatctagttttttgtttggttgtatggatagaggtggatttggtgatctattttttttgtttagttggaggagtaggatggatgagtggtgttgatgtgaaaacacgaggcttgggagatctgcttaactccagtgcaggtccaaaactcgccttcgggtatgctagcgtgccagttgatttgatcctgcaatcaacaagaaacaaagacaaagaaaccgtggttaaatccataaatgatagccgatcggctaggtgccgatgacatatcatttatctttgagctgatgtcatatatgcatcgatcgacagtcacaaatagaaaaaaaagaactaaatctactcgatcggctgtagataccaatgatatataatctttatgttgatatatacttaaatcaagtgattgggataaatcggtcgccatgccgagacagtataaatcacttagatcgaagtatatactaacaatgagactatatacgttcatagcatagccgatcagatagatctaacatgtatcggctaatactccgataccactctatattaagatatcaaagcaagtagaatataccaaacgaagagcccaatatacttaaatgcaacaagatattaacataaaaggcggatttaatatatcaataaagcatataaaacaaatatagttaaatcaggtaagatcggctgaaaccccgatactaccctaatcggcaaccaagaagcaggctagagattgagattctaatcacgactcataagatcaaactcaactgatgcagctataagtataaaaagaaggacaatatctagacaatcaagccatgggaagtttcatagagtggtagatatcatatataatttaagccaacgttgatatttaacttaatcggctgccttctattgatagatgttagcccattgtaggttagatagcaatattgccagagattatataagatatatgataactcgacgaattacataagcaagattagagtatcataaagatggaagaactaatcccgagaacgcaagccgtcataacaagttttacctcttgttgaagatcgaaaccgatgcagctcaacccgaaagtaagaactcgtcgaaataaaacgaaagcaaaaagggtggcgatgcgccgagattatattgaacgtgtgttagtttgattacatagggttcgggtctatttatacccgaaaattacaagatatgtccatatcggacacgactattatctctaacaaactctaagataccataagtctttgcggcagacttttgcccaaacatatctctaaggaaattacatgaaatatcctaattaatagatacaatcgccttctcaggactctatccatgcatggcaatcatcttgaagcacgtcaacctaacccgacaatgtatgtcgtgtcacattgtcggattcggctcaatcggctaaccctgtttgactcgatctctgtcgaccctagtcgcagccgattcggacttcagccgatccttactctgtttccgggacgatttccatctcaaattccatctcggtttcttcttcatctccgattcttgaattaccaaatttggtcgttaataagtggttacaatcaccctttcattagaggtggtgagtatacctcccttaaaattcaccaaaccaaaaaaatatcaatctactacaataaaaaaaatctgaatagaaataaaaagatagaaataaataaaaacggaagaaaaagaaaaaaaaagtcttcttcaccgaccgccgctgcgcctcctctcccacccgccggcccgcctcttctcccgttggtcgccgccttgtctccaaattgtcgtctcagtcgtcgtcccagtcggtcgccgtcgtcatccagatctagtcgccgcctcgagcgctaaggctcaccgccccgccttctctcccgccagtcgtcgtcctggtcggcggcagcggacctcttcccgttgcgccaccgtcccctcttcccgcgccggccgagctcgcatcccactgcctccctcacgtcgtcgtcgtcgttctcccatggtgagaggggtgacgcaacccacatcgtcgctcgccctagtcctcgggcggctccatccggccaaattggccggattccactatccggcatctgaagggaatattcccctccgggccgccctatcccactcccgcccaccaaccaaacacccaaaaaaataggccaccatgttctatccacccaaatccctccatccaaacacatccttaataacatctcaccagtcccatatatagtttttacacgtggcatttagatcacatgaccccaaccattattgcgagcgtgttttcttagagcccattaatagaaatggaacctgtgcaatgagaaaattgttttttaagaagcagtatctattagaaaaaaaaatctatgttatggtttgattagttattgccaaattctactatagaacatataaaatttatatagtttgctagttgatatcgtaaaaatgtgttacagctagaaggcacttaaaaaattggtaattggacgaatgacacttttgacccaattgaaaagagcaattcttcaaacggataagaatatgcacctatggccacatgcttctaacattgtgttgaagtgaaaatttgaaaattatacaactctaaatttatcatcacctcaattacattactggcatgtactccctccatcccaaaatataacaacttatagctatcaggatttgtcccaaaatataacaacttttccaccagcattctcttcccaaccaattataactttccaccattcacttttcccctacctccactactcattcaattataaccttacactgttcatttttacttattttcttaacaactgtatccaactttaaaacttcttatattatagtacggatagagtatcatatttcatctttcactccagcggtaggttagaaactttttggccctaggtgtgttcttgttttttaaaaattttctctctctaattgcgctagcaattattcgctagcaaattattaattttttctttaatcatggtacactcataatgtccataagtaaattacacaatcttaccgtaataaaattacacaatcattagtactacgtgtattgccacaatcgtacaatgatttggatacggcagatccggcagcagaagagaacattactcattacccacccaaccacctgtgcatgtgtgcgtgcacactactcgctccgtttcaaaatatttgacaccgttgattttttaacacatgtttgatcgttcgtcttattaaaaaaatttgttaaatatgtaaaactacatgtgtacataaaagtatatttaataataaatcaaatgatatgaaaagaataaataattacttaaattttttgaataagacgaatgatcaaacacgtacttaaaaagtcaacggtgtcaaatattttgaaacgaagggagtactaatttactaggtgtttgtggttggcctgttgcacggtggattcttccccaatcgatcgatctcaaattaaaggccctttgcttcaaagtaaaatcattggaattttagaaaatttcattcttataggattttttttcctatatagcactttgaatcaaagaaatggatcttatggaatcctatgaaattcctatggattggctaatgccatgcaaattttagaggaattctaacataaggtaaaacctcttggaaactttcctttgagtctttttctctcctctaattcctgcgtttttcctgcggtccaatcaaacgaccattcctctgtttttcctgtgttttgcaatcctatgttttacacttccattcctaccaaaatcctgcgtttttcctatttctatgttttctcattcctacgattcaaaggggccctaactttccttcatttcctctcatcatccagcagtgcagctaccaatatactagctgggtttggctctccttttctccgagattgccattgcctgccgccgcccattgcctccccttcgcccaagttctactaataagcagtaggcactaggtaatttggcctcttgttgccatctttccacaacacctcgcggcttttccacatgggacatgaacacgcccctggaaaggtttgcgtttggtgtggatcaggggctgttagctagcccagtgacaacttttttaatggcgggcttggagttcacatccgtgtctccgtccatctcattcccggtcgccgcgatcgtccttgttaattagctagctgacctagctagcagaattaattatggcgcgacttctgctgcttcaattatatgctggagaggagcaggagaaggagtactatttacggttgctggtttaacattttttttctaattataaaaaagagacacgcgtctatatattaattttcttttaaaatatgtcattattttttaagatacgtttgactattctttttttaaccttttttcatagaaaataggccaacctttagcaataaatcaagtcacaataaaataaatgatacttatatatatcaaaaaatattatatatatcaagaaaataggccaacctttagcaataaaccaagtcataataaatggttaaacggatataaaaaaatcaaagatcataccacattaattctacataattaactagacacttttgttcgataaattatcgttggtcaaaacctgatttattggtaaagtaagaactggtaattatatcataccgtgtttggttggttggctcaatttgtggaagtaagaagaagcatgtttggttgagtaggtgtacgtactggacgagagcctacacccacgggtgaacggactatcaacctaggctaaagaggaccacaaaattcgagctttgcttctcagtccggccgagcttgggtactagctagctagttcatgggcagttgtaggcagggggtgcaagtctactcaccttcctctttcccattcacctcatggaacggtaagggtcttgaccaagctcgagggatgccaccactacttctttcatcggatctctacctcctctcctctcctttcctattctcattgtcgttgagctttttttctcatgttctcagttggaccgggcgggcacaagggtgcaggtgccaaattcgacaataaactcgatgaaggaagcatatttggacactacagatcgaggtgacgagctctaggtgacactagctgcctccaatagccaaacccctcataattaaccacaggaccgccggctccactgtccacgagccatgaagctgttatatctggcaggcttcaactcgtggttgttggatctagtggctttgcccgtcaaggttggttcgagcgacggggacgagaagtgtgagcaacgaacagtagccagagaggtcaaagaagtggcaagcggtggggctaaaggaccagaatgggtgggggagtagccagtgggtgagaaatagcgcaacgatgagcggcggagaggagtgtgagaggaacattattttctttcttttcttctttttttacaacccctaattgccattatataaaacttaattttaccatgtgacagcgtgtgatgaattatttgccaactgtacttttgtatgaattatttaacaattgaatttagtttaaatcaactaatctttgagaaatttagaattgacaaattttgagatgcaagaggtaacaacaaccagttttatacaactaaacaaagaagattcccacatacaacaatcccatgttgcattccagatatcaacctcatatatatccaagctgagtcaacctcttagccagactaacccttgcccctgattacgggagcttaagattctgagaatctactgtttggtagccagcttctgagaatttggagaagttggattttctagtttctgggttctagttcattttctggattctacgactacagattcttagaatctggatgacaatttgaattgtttaggagagatggagattttgtgagaagttgtagctactggaagctccccaaaacaaaccccttatatggatggctcgacatccaagatgttaggcaaccaaataatcccttagggaatgtaaggagttttttttagaaaaaaaaagataaatgaatgaagggaggaattaagcaagagagtatatatatatctagcgtgcataactgcactacgaatggttagatgatcgagcgacgcgtacaccgtatcgatcaatcagattctccgtgcccttcgcccatttttactagtagctgcatgcagtagtggtgtcgtcgttgttggcatgcatgcatgcatgagtgcgtttggaagatctcccaatatttgccgctagcatgcatgcactgagccctgattcgctttaatttgacaccaagagagagatggatggcattatattgcattggcaagagagaaggacgctccaactaagagcagctacaatagcaaggctataagctagctataaatatattttagatataatagaagaaagagaagagcagtgtgctatagatttgtagccagctgcagcacggactccaagacgtaatgtgtgtatgacaggtgggatcagatattaatagtatagcaagcaactattatatgaattggttatagataatttggagctagtagttggctatactattaaacttgctctaatggaggcaaatggggctgtggctaaatgcaccgtggcccccggtgtctcgctcacgagggaaaaacaagatgatgtggggcctaacacatattgcacggatgacattgcaaccagtaggggatttgaggctgctttgggcactagcttagcccttttggccttgctcccctaacttttcgcaatagtgtgtttgtgtgttgatgtggccaatctatctcgagagagccgctgagccatggagatggtgcatgatgagatatgtattgtcacagtactgtgtactttgtaccatgaaatggggggcttctttcaatggccagaatgggcgtaattatatgatcaccatcagatgcctcatggccagcttccaaccaacccggtctaaccaaactatactattagtcccatcatctcacctaaatagctgagtataagtcataacgattattgattaatgataaaagaataatttatatgtatgtgtattctagtgatttataagctaaagctataaaataaattacaatgaacgaaaaacatcaaaatcatctccaaaattaattcttaaaatttaaattttggttgcgtttgataaacagaaaagcaaacaataaagctgatgtgtgaaagcgccaaaatatgatggtagagtcatgggcatgtatgtgacttcatcgctttgtttaaattctgatacacatgatcatgaatataaccagtgggcttttaacacaggatcttaattagtgaggttgagatttatcgttggtcttctcgtaatttgacaaggcgcgcttattcacacgattatgtttaacatgtatatattggtgtgtgcatgtgcttttttccgtaattttttttacacgtataccggtcgtacgtattgtagttatttgtcaaatcccaaactacatgcgagaaaggacgatgagcgtactgacgatcgcagtagaattttcccgcggtagttccttcaccaagcttgaagtttttgttttttcttccttccgggacataagcctgaccgattgtgttgtgtattaaaactcttttcctttcaatatatttatgtatgtgtattttttttcgtgctggtgaaaaaaaaggaaaggacaatgagcgtaccgacgatttaattattggcaacagcgaggcttaatcatgttggaaaattaaaaatatatagaacttcttcgatgaccattacaaagatgtgtacaaactttaagactcatgaaaaggctatgtgcaacttctcttgtaccttctcactaaggaagtcgtacgtttgatcacactaaaaacatgcatatatacttttttttgaacattaacatgcatatatactgcttgcgcttttccatagagatcagttgacacagatattaaactataccaccttgcacctttcaaacgttgtcgtgtctgtacggcagtttagttgggagcaacagtacatattaactcgcatattactatatacttccccagtttcttattataggtccgttttaatttttctttttctatttaattttctaagtctgatcaaatttatagaaaaatatagtaatatatatctctaatataaaataaacatattatcaaaatatattcgccacacattctattaaactaattagtgttgtcaatgttgctaaaacttttttataaacttgattaaacctaaaaatattttactataaaaaaatatcaaaatgacttataatataaaatggagggtgtactcattactacgaagtatatatcttcatcattcttaaattgttattttaattacgaatactgctttacttccaattatatcaattttaattacccctgctttttactattaaggttatacttttgatcaatttttgcactagtccctactccctacttgtactacaaatctacaatcagtccaaacgttatttttttttatcgttttcttctctagtggattatatctatttattatactatcacctcaattatttattggcagtgaaatatccttttctattgctagtggaactcgtaaataaatgatgtacaatactaaccaaaccgaaaaagaactctaaagctttttcctaatcaaacttacttaactaagtatctaacggtaagtatggaccagattagcggtatgaaattgcaggaatttcattttgtaaatctgaatatatagttacaaaaaaaaagcattccactaaaaagttaaaagttaaagttaaccaagttaggtttggtctggatgtgccacatgtgtacgcgcgtcttggtaattttaagaattcgttaccattccatttggtaaaatttcttcttaccttttacctttctatattcttcccacaagtaaagaaaatcttatcaaatcttttggagattcttcagtgtcgttattgaagtaggcgtgcaacaacgacaattacaaccgaagagatgattaattgctctagacaaatgcccattcgtctcgcacctcaccactgaatttctcaatttacaaagcgaggcacatacctgcagtctaattttcaatggaagaaaaagacagaaaattatattttaagtttgaagtgttatgtataattactacaatcgccaaatcattagccctatcaagacacgccgtacatagatgaattattggtcgtcgaattgtataattcgtccttttcgaaaaaagaattgtataattcggctggatatcatcgtcatccgtgcacgtatcctcatctcctggggttaagttgttttgattagttagcaattttgcgcccctgaaaaaaaaactagctgtaatataattaacaaataaaagtgcaggtcagatacacacacatcaaatctttgatgtgtggtgactagtttcaattccattattaaaaaaaatattaaataagaacccgtgcacggaggccatggcaatatgcagaattaacaaagatcatgaacaggtagtttcgctcgtgattatccttaattaatcatcaactctgatcactcgccttgtttttttcgtaatcattatcacggggagatctagctgcccaatccaaaccatagagatatgtattgactttggaagccatcgtgcggacaaaagcagcatatctaatgatatgattagcgaataacaaaccggccctcctgcaaacgaaagcggttaaaaaagcgcgcgagcctaacgtttcacactcacacgtggcagcatctccttggttccacgtcagcatcgcatccagccgttgtggttccctatgtcagcagcattgcccgtggtctgatgtagacaagccctgagcaccacactgtcagcagctgatcctgtaaataatccaacgtgatttaccgtggaaaacccaaaaactacagtagaagtgagactacactcttttatctggatgatgagtgccaaaaacattattatctagaggatgatgccaaaaatattatagttatacaatacagtcatatatgaaacggaaaataatatccagtgaaaaccacccttaaatgttctctgaatttatgaaaaacatatattaaagattggtataggcatggaatgcattcccactaaatctttagtccaaactcaacttcatttagaagaagcataaaagacaaaattttgagggaataaattacattttttaatattagaaaaaatacccatgtgttgcaacgggtgaagtctattttaatcttattattgttatatggtttagttaatatgaaatttacagtgggagttcgtttgaatatatatatttttagaaaatcatgagctgcaattaggagtccgatcgtctcaaattagcatgcaagtttttttaaacggatttcttatatgattccttctgcattatcaaaagtgaacgatattaaaaaccgactcaaatacggatacgtattttcaaaagcaaacaaacttaaaaactgactcatatacggatgacgtaccaaaatactggcaaaaacatgtttaatttttataatagtagagatatagttggcgccaagctagataagtaattaagtattatattctatcttgtgaaaaattaattaaaaaggtttctaaagtatcaacctactttctcttgtcccataatataagagattatgttttttttaacaaacattaagaaagtaacaaaagaaaacaagtcatggtacaaaatgtgatagttgaggaaataaagtacaaaagtaaataaagttctaatatttttggcctctagaaagttgaattccacaaaagatttacaaaaccagattttttttttcttggaaaaatcttactaatttaaatgtccacgattacttgcagaagttgtaattagctaaggcttgagattcacttccattttgtctgttttctcactttcttcagcccaattgaaatgttacattttttttattacacggtaggggctcgggcagtgctggagttgaagcagaggatgagaccggccaaggtagatcgttcctggcagcatggtgctggaggcgctaggatcggtgggttcgacctccaaaatttgcgagattgatggcgcgatggttttgagggctccttcttgagcacgattggcaacgacggagctgtaacgtgtcggtgaggaagtcctatacgtaccggtgttggatcaacgctgaatcctaaggcgatgatgaaagggaacttcttgtgctgcttgatgatgtgaagacgatgacaaagaaattaaacgcccgcgagatcaatctctcatgggtgatgactgacgatgtgaaaacaacaatgaaaacaaaacaaaaataagataagggctgccctgggtgatcactactcctagggcaacaacggcggaaccgtaggagagatgctagatcgtccactctaataacatgaaaacttatggatcacttgtattgcgtttagggggactagcgtaaaaaaagattatatggcctgattttaagcactcccaaatagatagaaacagaaattaatcctattctataataacaaccggatcacatacaaccgtatccatatgctctaaaaagatcttgtgaatttttcaaaacaaatatgtaaaatccctgtacattatcttctgttataattaattattagagcaaaacaagttccttactaattaaatatacaacagtcaacctgctaatcattggcacggctagccaaatacatcacatttctagcccatgggacaactgcaggaaattacaaatacgtacaccaagtacctgcagcaagccagcaactgtagtagtatattttccttgagcacatcatagttagatgttgctatcagcaaacagtgacaccagatccatctattcattcatgtatggaaaagagagaaaacaaataaaaaaaaaggaagggcacacaagaaaaaggaggaaaattataagaagataacagaaactgccggatggagcaagagatggtgccgaccgctgacttgtcgggttagtgtggtgacacgttggatggacaccagatagggtggcgcccacaaatgatttgcaatcctggaggtgggggcgcatttgatccgctttgggaaccgatggtgacgatgataatcgccgtgcgattgtcgagtgcgcacatcggattgtctgtgcattggctcacagggtctgaattaatggatccccccctttttttgttctctttttccttcaagtcaattgccatgagatgactcatgggacctaatgagaaagtttagtttagtgcatacataattagtgcaactatactaaggttctgaaccgtgataccagacaaaaattaaaccatgattctcacctttcatctacaaaattagacatgtattggttgtggtttgtcatttgtaatatatccttgtaactatatattcaaattaagggacaaatgaaaacatcttttttaaagaatgagtgcggtaaaacctcggaattttaatccactaacatgtgggtgcgaagaataaggggatatataaaattaaaataatattaacagatttatcattaaaggtattataatatggttgtaattttaattattcgcacagatatatgattaaagaaataatgatagaatatcttcatttaatattgtgtcgatgttctaaacaagtaaaaaaagaacatagagagtaagtcagacctgtcataagtggaagaggtcttgtagaatttgcctttgtgctcatcctcatcacttacctcacaatagttgacattcgttggtgcgggagagaacatggaattgcttctgactcacttcatgaatttttccattgatttatgaaaaaaaagttctacttttgctctccttttatccttcactcatcaaaaaggaagcaataaagatacactcagttactttggtgagtttcatccttgcaatatcattaggtgacccatgatagtgatcattaacatttttttttaacttttctagagcatgcccatccaactactaataaccagctgtgcaagttcaagatgcaaaggtcgatgataacaagggaaaacaatagcaatcaacctgttctttccgatggattatattgaaaatcaatatgaggaagagaaagtgagaagtcatcagctaattaaggtactacaagcaacagtttagggggcagttcgtagtgctacttagggtgtgttcgaggagaaggagattgaggagattggaaagatacgtaaaacgagatgagtcattagcacatgattaattgagtattaaatattttaaattttaaaaatgaattaatatgactttttaaagcaactttactataagaaatttttgcaaaaaacacaccgtttagtagtttgggaagcgtgcgcacagaaaacgatgtgctttctcaccctatatcacacaaacgaacgcagccttagtgagggaaaacaaggagagtttgcgtcatgaacacatcttcatgtttgtgcaattccttctgggtcaacatccaatcatcgccaccttgtaatagttatcaccaatgtttgcaaatgctggggcacaagtttttgtttgggccaaaattgctgttcctacaagtggcagaccccagtctcaccatcctctctctgtgcctgctactactaggaagctataggggacaagggttccaatcttcacgtgccctttgaatcacaaccttatcaccacaccaattcaccatgccagaacaatctgtcatggccatgctttttccaccttgtactctcttcaggaatcacgactgcgacccaaaccaccgtatcactttttttttctccaatagttctcatctcttagatcgtgctgtagagaaatgaaaaccgtcacggaaatttccaacctactgagaatcatttctacaatagtggtatcttttttttattctagccatataaaattgatatttttttttctaatatctgtagtatcatagtactgatgtcgctaataaatagttaaattatgaatatgaaaaattcctaactgactagatatgatattgctttatatcgtttttatccctctctgtagcgtcagcatgcatgcaaatccatccaaaaccacatggatggaacaaatatatgacaccaaggtgtaaaattttggaatgaaatttcagttcttttagtcgcgctaatagaaacattaaggcctcttttggaatagagcagtttcagagttttttttcttagaaactaaacaaaatcctgcaatttttaaataaataatttcttcattttagagaagccctaaagctggtgaaacatacacagttaaagcttgttctttttttttctccttgaatttccttttttttcctgatatgttttacaaatagaactgttaaactctgcaatccataagaccgacattatggtttacataagtgtgctggagcctggagtgcaactgctagggctatcttgtggggatcttggactagtagctcaaattattgccggtgccggcatgaaccatgacctcaccaatatattctcttctagatcaagtagaaaaggaatactttataagtgtgttcaccagaattcttcaagcaattgcataccaatcatattcataagttctttctttgtcaagagagatttatgtgcaatgcacaagatccaactgtaatagtagttgccaacttgtaggatgccacataactaggttcgagtaatttttgctcaaatttcgatgtatattcctctgtattatcctaaaactgacttctcaattttaaattaattttaagatatataatgagtgattttacagtccttgagcaaatactgggatctatattttctagcgtaaaatttagtagtacttggaggtacggaaaatttccattaaaaattttagtatctattaagaactgtaaaatttctctaaaaaaaatagataagccgggtgctgcgtcaaagatgcctaaggcttattcttttcatattatttaccgggttgttaaaatggattatttgctcaatgctttgaaaaatatattttctcaagaaactttcttttactataaggccacttgattttttaagtttatttatcaaaatattctatttattcctatgattcaagtagataaccgcagcaacaatccggtcaaatatataatctatttcaaactgagcctgaaacgattcttgattataattgcacataggcggactcatgagtcatgacaaatatttctaacacttccacgtattgttgcgtttcctttgtctgttctcatgattgggtcagctgatcgagctgctcaactaatctgcctttgttaaccaagttcattatatatctgaatatctctatgcttggtaatgttgctcaacttgtcctttttcatgatatagcaggccgatctaccatcctttatcatcatttgtttaactaatccttttgttcttaaattaccatctaaaacgtatagatcactacttttgcactcattcgtatttttctacgtactttcgatcatgatctaaccaagtttctgtgtgcggttcttatctagctctatacaagatgcaacttgcaagtttgtttgccgactacttgatttctcaagcaaatagaaatctggcctatggtaatttccagcaagagaaatgtgttgttaacacaaaggtgaatcatctatctcttgagacctttggaaatctactcttgtgcgggaactaattcgccaaattcttcccagctcaagaggggattctatgtgataaggcaaggggatagattttccatgtgccaaaagtggcttagattacttgcaatgctgccgaaaatgcagccaagggccatgtggaatcctatgctgatgaataacttcagacatcatgatgagcagaaagaaattctgatttctgacgtatcatgagaaaggtactgaaatatcctccgagaaaaatcctgaaaatacgtttgtggactctgtagaaagcaatatattcagttcattttgcagcagttcatacttcgtttctgaatttatctttttcagcagaacaggtcctaagtacgattaacctgcacattatttttcttcctcagagattcttggtgtcttgtaggaagtaaacaagcaaatgattgataataacaacctgagatcacgtccatatctttttgtttgctttctgtctggttgaattggcctgtttgaggctaagacaaaccactcttccattagagcattaacaaaagaataggctaatcatttggtcatgcaaagtgctgataatatataaatgcaccatatggccttcagaaaggcattacggataacgctcttctgtttgtttggacttaatagttaggtcagaagcgattggccaataaacaatagacgcaaagcaacagagcataagccaagcacaagatctcataatatattttaggtatggagccatgtttctacaagtcaaaatgtgatgtgcatatcgccattagcaagcctccagtgcctctttagaaagggctattcgtttgactcgttattatgaggtggacatcattaggtgaagtagcaaaggttattgttcagtgattagcataagccccgggttgattgcgtaatgtgtgaacaaagaaaaacaaagtggggggttgcaagatagaataagtgatctagaccggagataattttgtcaaagcatatctttttgagtttttcctgaaaacaagtgttcgatcacagtgtgatcacaagaacagaatggactaggtaataagtcactacacatcgaattgacatatgtgcttatgcaagaacaaactgattggagaacagaagagacatggcagcaaaagagcttgaggtcagatcatgattttacctgcttccatatccagccaaggtgcaactgggagttctcaatgtttaacccatttgaaaaaatcgaagtccaccgaacaatatctgcctattgaaattgcaagttgggatgttgcctgtgtacgtgtcagcacaacagaagctacagaatttcccagtgtgctcctgtcagcctgaaaatcgtgtacttttacaaggacagatcaaaatatccagggacgataatgattagtcggcaatactaatcaaaaaccaccaatcatcggtattaatcatttgcttcttgtttaatatgtagtccatttccgactgatcaaaaaacaaaaccagctctgaatgtcctgattcctgaataatttatactacttggtcgtacacgaattctctcacactaccagctagtagtagtcagaacctatcatttgcagttgcagatttggtcctgcagattagtccaaatagaccaacacaatacaccttacttaaccttcaagcacgagtcggaaaaaccacacaccggcaaattaagcgcgtgcgtgtgtgcgtcacgcacaaacgccatcgccgagcggcgccatgatctagcagacaaaaggaaaggcaaaaaggaggagatgaggagaaggtcagaggatgaatcgcggcctatccatggtgatagcagaaagactccggcgctatcatgatgcactgtaaggcgtaggtagagataacgatgtccctttttttttataaaaagtgaatttgaggttttacgacatgtttttataaaccccagatttttcctttttattacggcgtagaggtttcatgaaataccatatttgtgtctatatcatatatttggctatagtatttacttatagagacaaacatacttgtacaaaatagcagatcgttttcttttaagtacaaatataaactgaccactttctccataaacatggttgctagctagcaacatgtaaccgattaatgtgtcattgcaactgcagtttatattgttgtctttgccttcttgtatgggagagtgagaaggaaagatactagacggtgaaaatgtttatttcaagccacaggtatttcttaaaaagagtacattttagtaaataccatgttttatggctaaagttgcataaaacacctgatattattactaatggcacataatctcggtttttatggttctaaagttccacaaaccctaccctttacatgtttgagcacacatttacttcgatttttaaaatagtctatattaaatttgtagttattgattccttgactaatgactaaggttattgatttaactcttcactactttaaaaaaatatttgataaaactagttacgatttgaataagtgtggggttttagaagcacttagatcataaaatctatggttggtgccacaagtcataatgcatgcatgtggtttctttaactttgaccatagaaaatgtgattttttaaaatttactctattaaaaaaaatactccgtgtaatacaatggggtataaaatactttgtataaatttggggtcttatatatgaagcatttttgtctcaacacccgggtttcttgaaacaaattataaactatatgaaactccatgcattgttgtgggagttttgtataatattagtagaaataacatgtaaaactaacatataaaatagctacactttatataattttcatctatgatcaactatgcaaaaaaaaaggagctatatataaaccatttgatgatgtggtttacaacaacttaaatcaaatatggttgatagtttaaaaaaaactaagatgatgtgatttaatgaggggaggaaaagaaaaaataatataatttgatcattcaaatacaaaattaaggtgatatgactttataattaagagaagaaaaggagtaagataatttgaaccatatatacaacatccaaggttagaagcaattgagatgatgtggcttatgaaagaaaagagaagtggtattaactacactttgtagggatgaactttcataggtttataggatgtggattttactatactaatgccatcaaaaagtatggttttgtaagaaagaaaaaaattgcttactttttcttatcttaactttagcagcgagctaaatgacaataaccggaaaagatcagatcgttaaactaaggtggccgtggatacgtcgaatatatgccggcgggtgatccacgcgtcgccggccggcgacttgagcggcggcacgattgaaaattccggccttttggagggagacggggataaggcacaatggcgcaagttcgtagctagcggcaggcagagagctctctgttaagttggggtttatgtaaattaatcttgccgtgccgggtgacgcacgcatgcacggcacggcaggacgatgcgttagcttttttgcacaggtagtgaccggctttgtgttgggggttcctggataatgttggcatgtcaggtcagggtaggtcatgcgtttttgtttaagccgtgtcggccgagctgggtgaacaggattaggagacagggacatgggggcaaagaaaaaaaaagatgaaaacaatcgatcgatggaggatgtgagatgcgtgagcaggcaccaactaatgatagatagatagatagatcagacgtaaggaggagaggaagagaagggttaagttgcatgcatcatgcatatgtgcttgtctactgggctatgcgtacctaaacactggtcgctaatgggctgtgacggcgatcgaccgaacatgtcctcccctccccggttgtttcactgctcggttggggagtcaaatcgcgcgtggttggatgcatcagcagcggcaggcagcagcagcagccttgatgtgtgtggtgggtggagacggagcctgtcgctgatgaaggggattagttagacagaagtaggagtagaacctatgaaccaacacggcaacacggcctgggccagaagtgagaagccgatggagaaacgcttccgggcccgcgtgctaccgtatcgggcgtgccggcccaggcgggagagaaggcggcacgcggtcacaaactcacggcgcggggacgcgttcaacaccgcgacgagcccgtgtttcggtgtttggggctttgggccatggggcgcgggtgcgtgagagcaagtctaatagtacagtctccaattcatctatagttaatctaatagccaatttatataatagctgcttactatattattcatatatggtcccacctattatacacatagtgtgttttggagtctgtactgcagctggctacagatttgtagcccgctgctcttctctattatcatttatcccattaaaatatgtttatagctggctaatagcctgctattgtacctgctctgagcggcaccgggtgattggtacgtaaacagcggcgcggcgtcggcgattccaccgcgcgatccttggcggattagcgggacgaatggcaccggttttccgcaaaagaagtctactctgactccctcaattttaggtctaatatgattcgtatctctcaaccgtaataccatacattttcaccctctagcttattaaaaccgtacaatttaactctcttgatggtttttagaccagtttttgctgacgtggctcgttactagtccaactgactgagacagacctacatgtcagagtccctcttcctctcctttcttctcctctttcctcttcacgcctccatgtccacccagccgcgccaccacgggcacaacgctaccacatcctccgtgcaagctgccctccctctgctctacatcctcgggcccggcctctgctgcggccacctcatcggcggcgaggacgcccttgttcatccattcctcctccgccatcgccgctatcgcgtggtcctccacgacgtgcctccgattggcatccccggccaccgtcacccattgccgtttcgcctgctccagcagtgccatcagcgacaccctcccaccccgtgctccccccgccgctggcccgctgctgccacgcgcggagcagtggccgtccttgtccacgttgtggattggtgtccttcaacgatgttagaagacgggtggtcatggttgtcgtcctcgattcaactcatcatgtcgctgtcgcggagcttgaggagtttgtggagtcagcatgcgccacttcttcgtctcctcgctgccaccgccacttctcttcacctgccatctctagccccctattgtaaacccccacccccttaactagtgcaacggtgccaggcctctccaacaccccatcaccgccatcgtccctcccttctcagcgtcgggccaacgggaccgagctccatcgctacggcggagcgactccaccatccaagccgccgaggtggcaggggtcttgtcctgatgagcacctggaggattgccatccgtctcccctccctcctatacaccgagccaacgaggccaaactttcttgttgctctgccatccatgccgaggctcaccgtggccgagcgcttgaaggaccgcccgccatcaccccttcctcctctgcactggaccaagctctatagctacggtggcatggctccgctgtccaagctgccgaggtggtggggggctcgtcacaggctcacagccgagcgcctgaaggattgcccgccattgtctcgctgctaccctactgccgagagaaaatactacatttgagaggagaggtaaggaaaggaagagaaagagaagaatcactgataggtgggtctcacatgctaacttaatctattgaactatgccaatgtgacatgttagcgaaaaccgtcgacaaagttaaatttcacagttttaatagttattaaggggttaagatatctggtagggatacatatcagattttaccttaaattaagagagtcaaagtggatttattcctccgcagaatcctcgccgttttacgctagttgaggcttcacgctctcttgggctcctattgtctctagtcttctgggctaacatcagatacaagaagaaagtttccgatgggctccggaaacagggttgcaggaagaggaataagtattgtcactgcctgcgtttattagcaaacatgccaaacaaaatacagcgttagcgaaaataaatatataaataactagaaacggctaaacaaataaacgacggtatgaatgctagtgtctacttcgttccatcatctcaatatcttcacaagaacagtttgataatgacatcctccatacatcgcagactatttaatgatcaggcaatcagcactcagcggagaatcagcactacattgcagtttccagggagaaacaagcactgtaattatggagacagaagccacagttgacagcaccacattgcagtttccagagagaaccaagcattctaaaaggattgctcatgaaaaagataatgaaattattgagacagaagccttgacgaaggcacgctgggaacattcagtgttagtgatttatacaagcactcggcattagaaaatcgatccattttttcatctcttctctaatccggtaagtgccaccattttctgggaagacaccctaaatctctcttcctcaaagccttgggattaaacttatttctccgagatatgtacactgactgctagaccgttacattccattttgttaatgttcagcaggactctttgcacttcagccgccgcttaagcacttcttgtacttgctttgcgcaagattcagcaagaaatcggtgaatatgtgctcataacctggcattttcccgaaccctgcgcaagcaagagggagtgagcgtacactcaagaaaatgctgctgcagaacaatgatcatgctgtgttaaataacaagaacacagaaattcgagacgacaaagtactactggataaactggatcagtattaatttggcctagaagtccaggtatgtgtagcgatgtatcctcctttccccttaggctggaataaaatcaggcctaacaaattctgcacgaacatatgaagagaagaaaagaaacgcaaatgatagtatgccatttatgaaggcagtgggaaaataactgcacacctgggaagtagttgatgtcaattatatagtaccgatctttggttccaagttctctgatcatatctatgttgaacaatcttaaaccctgaaatttttaagcctgtcagatgacgaccatatgaaacagagcttggttaatataaatacatggccataccagtcttccacgaagctcttttcccagtttctctaggagtggtcttggaggaagttctatcatgtaacagaaagttctgatcaatatatagcaaaagtttatctggtgccgtcgactactcatcaaaagcaaaataaatcaagaagtatcgatgtcatagaacaaacgctgtcctcgacttgatatatggtaaggaaacataaaaactctttaccatgtacactgcgttaaggttctaaagaaagtttgtgtttgaatttagtgccccctcttacattaatgaagcatggatcaataataaccaaaatgaagattaactacaatactgcagatgtctcacctgagatatgaggatcgaggtctgcatggtctgcactagctgcagcacatgaaactcttggaaatcgatagacgccaacattgtttaataagtcataagtgttaacatcaggaagagaaaacctccgtacaacttgtatagtttcaccaatgatgtacaccttaaagaggatcccacctgtagagggaatagtttaggtccgaacttctaccgttggaggaaaaagtctcaggatatgcaaaagtactacagttacagggggggaacagaacttaccatggttcacaaattcctggaggaccagaggaggatcaagcattgataaggatgcctcatcatatgcaagagatagttcgtgggatttagatgttccatcaacaaccaatggcttcgcaactgtatagacagaagcacttcgcatcaaacaatttctaagctcaatagttccaagaatgaaaagagaacatctcccaaaattaactatcaacgaaccatgcttaaatattatctgaaaaacagaccgcatgttcaaaaacgaactgagaatggccaggtgaaaaaatattgccggaataaaaatgttgaatatttttccgctgtatttaaacattcgcatgatttggcaatgttttcttatctagaggaaatggatagttttaagatgtagattatgaccaattacccaagggcaaggttagtccagccatggcaactgcggttggtatagaggatggatctctcataatgaccagttggcgtggagtgcaaacttctcctgcaatggttcaatgcataaacaatcatatattggtatgaatagatatgccctcaatagatttagttgatgatacacttttggaattctgccttttactatctcggtacattgtattcacaaccagctgcaaagaaataatgtttcccaatcaagcaacatttgtccttgaaatctctgcaaagcaaaaaaatctatgggtttctattgggaatttcagcatttctaagagttaacacaaatttcttttgtttgaagaaagaattacatagcagcattaattggaaattcctgaatcctgaggttcacaaggaatagaaaatatatattgtttatcttagaaggataaatattctgcacatcgcttttgaaagcaaaagtttcttccattctaggacagaagtttaaatgtgaatatatttttcttttttgcgactacacggcagacgcacacgcgcgcgcaccacactaactcaactgatgcgcccctaacacacactctaagagacagaaaccaacgacaatcgctgatctcactaagtttctagtgaaagcccacttgggtgtgcataatattcgtgagcatcaggatttgaaccctggcaggtggagtacctacgactacaccacatgaccagtgcttccctgacatgtgaatatattcgataattaaacagacactaactaacattataaacattagaaatggaaagtaaaataacgaatccattttatagcatataaatatacatgttaagcttcatgattaccatagaaactggataagttcaaatcagatacttctgcaagcatagattgccgattattcagatgattgatggcatttggtgggtcaaggacagtaacctctggatgttcctcatgataatccttcaggaaagtgaaaggagttaggttaacagagagtttcaataaatgggcaacacagattagaagccaacagcaaattccaagaattatggatttatgttgagctttacaatagggcactgcaatcaaatagtttggatatataatcattacatacagtgacaaacatctactgctcatttcctcagttgataacatatttccccatgatgaggcagtgaacaagtagaaaaaaggcaacgatggtatggtcatttactgtgcatcatcagatttctgcatacgtactcagatcttacctccagaacctgttgccattccttgctagtaatctgcacaaagaaatttcttcaataaaatatgcatatactttaccaaattacaatgacataattatcagaaaacattaattataactaaagctcataaatagatgatgttattctttaacaaaatgcatcatacagggccaatgggcagcactattttagtccagctttaaaaaggtcacgactaaccttgtgcaagataacatcaaatgggccttgttctgcaagcgggcgagtgtcatcaattgctacaagattaattcccttcttcctgacacagtacataatgaaacatcatgaaatagtgttatacaagaagaatggcaagaaacagaaatggatcctaacatccatatggaagtacaatagccatcttgaccaagtccaagccctcacagaatcaagaatttttttagtacatcatcatctctccatgtataacatgtcgtttgggctacatttatactctatcgatagtataaataagaatgataaaaaaaagttaaactgccttgcaacagagtatttctcaattatactttgaaaataagactactacagggatataaaaaagcgtttagagaatatgcaggttgtttgaatgaatatagttggattttgcataaatatatattgtttcctttattttcttggaataactaaacaataaatctatcgaaacaaaagcacaaactaggcatgcaatacacaaatagttttaagcaaaaacattttgattttgcataagtatttcatatattaatttcatttcccttctatatttcagcttgtgttgcttatgtctgcagcctaccgagcaactagcaaatgattgactcagctagtcagcttggatcttgattcagggagctaacaagacaatcacaaagatcgtttgtcagcggtccatgttgccatcaaacctagcaagtcagtcactaaattgtaaacgatcccagaaaaggcattgccatcactaaagctgtcgtaatccatgtgatgtgcttatccatgggattatgggaatattccaaactagaatcccagacaccaagtagcaaagatttgcatgctaagacccatttttgacaagttggcatgataatatacaattatagactatagagacccccgcatgcagtggaactgtcaacatgagacgcacgtaagggggcatctacaaatgctaccagaattcctaataaacactagccatattcttcagtttacaatatatcgcaaatgcagcaagcttcgcccagaatccactatcactagccgcccctgctaactttatactccagtagaggttcgattcgatcactacttgattagtgctacaaggaatagaattgcattccattcccaccccccattttgttatggaactaccaagttttttacctgttctcgcaaaaatcctctgggcttcagaaatagaaccaattacagcatttaatcaaagactcaaaatgcaaaactgtatctcataaaccatgcattcccccctcaaatcatttaccatttccctccaacagcaaaaaattctggttttagtgaaaaaaatttcgttgccactcgatcaacaagaaatccaacaaaaatactctattgtctcccaaaatcctccaccacggccacgaatcagcaggttcatctctttgagcgttgatccaggtttttacctcgccagcaacagcagattgggctgaaggaagctcttcaccttcttcttggtgagggcgtaccccaccacgagcctcgtcaccggaacggccccgccgttgagcggcgacgacgacagcgccgccgccggaaccatcaccacttcctcctcgtcctcatcgaaggaaacctccccgtgcagccgcataccccgcccgcaaggccgcaacaactcccccccaaaaaaactctcctcccctcgtctcgaatttgccccaagaaactaaacaaacaaacggcgaaaatcagggtgggaatccgcaggcaaaggcgggatcgagcagaggtagccggcttcttacgaagcgaaccactcccccctagctgttgctcgagaaggatttgggggaaggaaaaaaagaattcttgttaatggcgagacgagtggaaggaaggggaggaggaagagagcgagcgggtatttgtaggcgacgaggtcgactgccattttcctccgtgcctacccgcctcacatccgctgctgtccacagccgtgctgctactcaaattgcaatcttttttcgcattggcgagcgtcgatggagtagtacgtagtagtacaagatttgggaaacgtgttctgcggacgccaaccgatggaacgacaaaaaaaaaaaaaaaaaaactatgcgcgcacacgcacggccgtctcgattcagtgcgtcgccgttgaagccatcgttgtcggtagctgcttgcaggaagagacgggtttgggttaggccacacatgaccatagattcaggtgagtggtggtggggcggcgacaacgggggaggattgctagtatcgagcaaacgcgacagtgaccctgttggtggtcaggtgaagtagtaggagtaattttttgtgttgatgctggtggtgagatgagacggcaacgtgacaagtagcatgggtttttttgcttttgtgtggatcggttttgggtggtggttagataaattaactgagctgcagaggatttgatctcgctcagattagtcgtccgtggacagacggggtgagggtgcagagcgctgcagtaaatcccgtacgtcctggcgaattgtggaccatgtaaaagcccacacttgttatccagtgtcagtgcagtatgcggcccatctaaataggatcatatttgcactatggtccctactacagtattaccagtacttcgcaccgatttagaatgtgtttggttgcttatatccttctagtctagcccatttctctcatctaggttgggtttagaccggacaaaagatacacgcagtgacggagccaacaccgccgtaaagcctaggcgattagtaacgtttgttagtgaccgactgctacggcaattgaaacggcagcggtggagcccaggagaccgcccgacctgcccgggagctatctccgccgctggatacacgtgcatgcatttggttgttcgtattggtttagcctagctactataagattttgtttgattaatttcacaaaagatactatatgaagattttgtttggttggatgcacaaagactgtttagtctagacaagaggatacatgtgtaggtgtttagttgttcgcattggtttagcataagggtactgcggcggcgaaagatttactctaatgcaacgtaaaaacttaaatatgtgcaacaaattcaattaccaattgaaacatttactctaatgcaccaaacatcaaattaagagtttatcagaatataatcatgtgcgatgttattataaagaacacaaaaatataatcaaatcatagatcagataaatagttttatgaaaaaaataattttaaagctcgcgttatacttactcctacgtgcatgcacaaagagggaaagaagcatatattgtgtaccgagtatgtgaccgttcgatatttttgaaagcaaccggcgcctgacgtgtagcattgttgccattagatccccatatattacactacatccgtctcaaaataaatgaacttgtgggtttccgggttcaacgtttaaccgtccgtcttatttaaaaaatttatgaaaaattaaaataaaatagtcacacataaagtattattcatgttttatcatataacactaataaaagtactaatcatattttttttcaaataagatggatgtgtcaaatgttggacatgaaacccacaactgtatttattttgggacggagggagtatagctttgcacttagatccccagtgtttcggatcaagccctgaaaaatgcacttagatccccagtgtttcggatcaagccctgaaaaatgttttctcaaaattagaatggtagatgtagatggccggctgttgagctgtcctctcgctgacaggtttccgcttctccggccggcctcgcggatggattcgttggacgatggatccccttgccccctcgagcgaagaagatttaggcggcggtgggcagagaaggtaaaactaacggggcgcggcggtggttacctctcctacgctatggtgactggtgagcgggtgctgatggccggaggccgactgccgccgctggaggagacgctgcgatcgccgttgtacacagtacatctgctccaagagttcacggatgccgccggcgttgcatcgttctctcttttgttctgtgggctgtggcaccgtcagatcgacgaaattaatccttccttgcttggttgccatggacagcgggacaggtagatggactcaaagtagacaaccacgcgaacgaagcatgcacacgacgtttgtcattgtcatcggtttgctgcaggcagagttcattgtgcctgttattttcttcaacgaaaagtggataaagttttacttcctccgtttcaggttataaaactttctagcattacccacgtttatatagatttaatgaatctaacatgggcaatgctagaaaatcttataaactaaaatagaggtattagttgaaagtggcacgcttttcaaactgctaaacgatacgtttcgtgcgaaaactttctatatgaaagttattataaagggcctatttggttctctaccctaccaattaattggtagtgccaaaatctaggcaaattttggcactatcaattttttggtaggacaaagttagctagtttatgtttggtttaataccaatataaagtcaaaatttagtatgagagtaaaaaagattctagaatgtagctaaattgagcgtgggcactacgaattgtttgtcttcaatccaaattgagcgtggataaagggtcatgttttgtcttcaatccaaaacggcccaaaatactccctccgtcccgaaatattgacgccgttgactttttaaaacatgtttaatcgttcgtcttatttaaattttttttatgaaatatgtaaaactatatatatatatacaaatatatttaacaataaaccaaatgatatgaaaataattaataattattaaattttttgaataagacgaatggtcaaacatgtttaaaaaagttaacgtcgttaaatatttagagacggagggaatataagattaatctattttttaaatttctaataattaaaacttaattaattacagttataaccatctcgttttatataaaatatttagtaatctttatttcattttcatttttagaagattccaacgcttaaaaacatatcattgattcacgcggccgccgaggatgccgcttaccgaccaaacacgatccgtatgccgcgtggcaggacacgtgtgagataacagtgtacgctcaatctgcagaccatttgtttgaggagaaggaaataaagaagattggaaagatacgtaaaatgaggtgaatcattagcgcatgattaattgagtattaactattttaaactttaaaaaatggattaatatggttttttaaagtaatttttctatagaaaatttttacgaaagacgcaccgtttagtagtttgaaaaatgtgcgtacgaaaaacaagagacaatctcccatatctcccctgaaagaacgcagccattatggctaatctgtgcggggatcacggaggcgtttcacactatgaccgcgatctacgagactaccaaggagagcacgtacgcagatcgtgcgctaaactaaccacatgatcccgattcccgagtcgaaaaaacggggaaaagacaacaatacaattttacatcaaagctccgtaaactcccgaaactgaattgattgtttcctgaatcaaaagctcaacagaatcgagtctgtacaaattacaagttgctgaaaataagtaaaactatgaccgaactcaagaattgcataatttgcatcatatcacatatacccttttgtgttggttaattggaagatcacagtaaaccccctctatgttcatgacaataaacatttgagcaccggaaaaactaaagcagcatcagaagagaataaaccctgtcaggattggtacacgacacgcactgttcgattctacggagttagtcgaattcagccacggagtggagacaaatttgcaccttgcactagtaccctcggagtttcttggccacggtggtcaacacattgtcgccgatgtgggagcgcaagaaccggatgaactggtccttcttcatctgtcctctctgaaacaaaaagaaaatttatgtcattggattttcaggacttcagcttcgcttaaagttataacgccgttatgctgagctgaattcgctttgcacagaatattgacaggtagatgattctgttctactacagaataaagtcggcagcatattactacagaataaagtcggcatgatcatattaaaaccatagcagtgcggtacaaatcaacatttttacgtgctaattattgcgtatagtgaagagttagacctgaatacaacacaaaccaggcagagcaaaattgttcaactatatgtaagactaaggccccgtttgtttcagcttaagattattgtaatctaaattattaaatcagattactctaagctgaattataataagctaacataaaataagctacgagttgtttgtttctctggattattagaggcatctaagggtagtgggtctttagctactcaataatctagaaaaagcttctctagaggagattattagattatagtaatctaagctcctctagaggagattattatattatagtaatctggcttataaattataataatctaacataataatctacttatttgtttcagcttaatcctaataatccagattataataatcctaagctgaattaaacagggcctaaattcacctagcagatcagcagttgtgtttcagcccattgtttcgcttttacttatccaaacaatttattaaccaaaaaaaggtatagtaaaaccttttttatacgtgttcatgcggtaaaataaacaactaaaaaaaccacaaaatcaactcttatattaaattttgacttacaggcatgatcataagcgcgaaggggttgttttgtgtaagctagcgcaagattctaatcaatcatctatctagaaatgaaatgctcagcaagaagtaccagtttaccttgaagcagttgtacgtcctctgcaaagtctgcagcttcggggatggaacgaaccgctggatctccgtcagaagcatagggaacatgtcgcgagtagctgctggtgatggcttcttcagcttcgatcccaaccccgatgatcctgaaaaccacagtttcactgttatggcagtgccaaatgggaacagttccatccagcaaatttcagacacgagagaccaaccttccatctgcggcaggttgggccacctgaagctgaccacgtactctgggaggatcctggtgttcatgtctgtgctccatacaacgtaccaccgcggattctcaaggttgtcgacggcgctgtcgtattcgtcgctgctggggtggaattggggtgagctggcagggacggcctctggacggcccatcaggacgcggcacagcacgatgtgtgcctcgccattctcgtctggcttggtcagcatcgcactgctcgaagacaagttaattaactcgttaacttagttgaacattgactcacaaatttcatcccaatttataacaatttaggtagctactgtaccatactgtctaatttgctctaaattcaaacttagatgcaaaacaacgattggtagtttcattgtttagcaccaagatggcaggcagaaaataattttactcaagattcgtatggtaatatcgaaagatgaaatatatgaggcacttggtgaattttcagaaattactaaaaatgttctccccaatagttcaaagcatttgcagatggaaagagttgaaagcatttgggaaactcacctagcgtgagggtactgcggcggcgaaaggtgaacgccgtcgccgtgtgcgcgcccgccgagaaactgcccgttcgtcctcccgaagccgtgctccaccgccgcggccacatccgccgccggcgcgccgtaccacgcgaacttggcgttgctgccatcgccgacgccgcgagcagcggcaaggagctgtccctgcagatggaaggctcttgcccggggcccctgcgcgaccttgtgcaccgccgtgatcgccacgccgcgggccgccgccacgggagccatccggctgacgaagagcttctccaccaccttgtagaacttgtccgcctcgtccagcctcaccgccttcccccacaacgtcccgcgcgccttcttcctgtcgggctcatccgcctcggggcggctctccccggaccgctcctccacgccggacgacgcctcgtccccgtcctcctcctccgccgccggctgccgccgccgccgatcctcccccttcacctccgaccccgcctcgtccctctccctcttcctcttcctcccgccctcgggagccgggaagaagcacgcgccgcggtcgtcgatccaccccagcgcggcctcctcggcggtggcctcatcgatccgaaccatccgcatgaagtcgaacaggaacaccctcccaccgcaggcggcctcgcaaacggccttcccctccatgaacgcccgccgcagcagccccaccacctcgcccgcgacgtccgcccacgcgccgccctcgaagcagaggagcctcgccggcgcgccgctcctccggaacgcctgccacccacgcaggagcgggatcgccccaccgttccctcccccgcgtgccgccgcgacagagggccggtggatcgccggcttgacgtcgccggagaagtccatcacccctcccgacccggatctctctcgccgcctctgctctcccgcgcgcgcgcgcagatgtgcaggtggagaaatggcgatcgggatcaagtgggagcggaagacggaggaggtggggatgaatatataggttgaggccgcggcggggggtcggtctcttgaagagcacgtcggcgaggaggtcggttttttttttttctcacttgtgttctggggcggcgcccgcccgagtcttctttgcgtttgttggtaatggtaatggcggttttgcccctgatgaaggacagaaggagatgccttggtagagaagtctagaaatgtctagtttgcccccgaacctgttttacttgcgccagttgtttttttatttcttttttggtctggactactacttacttgaacggaaagaatagtgctccttcccttaaaaaaagaaaaaaatatttctcctctataataaattaattaatataagaaaattggtctaaaaaacggttacatttcaatttcatgcatacacatttgattgtatgagtttggttaattatataaaccaaaaaattgtttcctaacaatagcaaaattcagcatagcacttctactagtactagtccttgctcgtactgtcgtacataaagacttggctctttacttcaccttgggtcagagttgtcgcatgtgaagcacgctgactataccgattagtaccgactttgccctttacttcacctggacaggcccaggcgcccagccggtctccttgttgtataccagcttagtacgaaacgtccgttaatgcgaaaaaaagaaagggagaaaaaaagaaaacgaaaatgatactccggcacgaaaccggcgcgtggctttctctccggccacaaaaccgcgcctactcttctctcttgtgcgtatttttcttggcgcttaagattgctttcgctcgttcccacccacgatgttcttgtgaagcaagttgtttatttctcggtctagtaataattagacttccaggtgggccccaccggcccaccgccggacgaaggcgtggtaaaccaaacgctgacctttgccatcgccgttgaccatctgatcatcctacggttacgggagtttttgagttttcgtctggatagtataatggcgagttaaacgttttcaattttaactattaataaaaaattaattatataaaattgatgttattagatttattattaaacaatctatcataatgtgtaactctttttttatttaaaacatcttacttttatatatattattaattaaattagtatctctgagatcatgttaaagtataaaaatatttatattttagtacggacggaagttcgtgtgtttgtgtgcgccgtgctcgacctgtgttcgacttggcattcggcaacttttgtttgtactcctccacggattgatgtgcttcgtgacggtcaagtcagttccggaaatacagagaccacccacttgtaacacctcacgtgatcggctttgctggagtagcagttcgctttctctttttctgctctgctcgcctcctcgtgacaggttgtacgtggatcgcttgcacgcatcatcatttcgctagtgaaaaaaggcatcgcaaattttgggggaaaccgtttgaaattagcgtcgtgtggtcttcatcaagaagaaaccgcagaaacatatgaagacttgggggtgaagtacgtacgtacccgtttgggcagttcggctgaattagtcgtaagaactacacattagaaaatggtggctctaatccaaacattgtggggatcggatcggatgtcgtcagatttgtgtagaactaatccaaaccaaaagaagtcccgggatcggaaaccgactctcgaaatgcctacaaaatcagtcggtcgacgtgtgtgtactgtgtagtgtccgatcaacgtacgttttgttactggagatcagattatcagtgtcacgtctaattcgcgagaataccaatggatggctttggcgtgagacacgcacatgtgtgccgcgtgagtatgttgatattcctgtgtgcaggtatagagagatatgcacgccagccacgcatgcgtgaagcacctgacttgccagaaaatgcactgaacccaataatacgagcagagatgttttcaacatgtgcggaagatattttgatcttgaattggcaatgccccgagaaaagaagtggtcggacactctaaacataataaaaacagcaaaacaagaaaaaaaacagtttaaaaaaattatgaaaaaaatgaacataaacatatcgacgtcgattgcagactgataaaaaatattctctacattactatatgcactcaagttaaagaatttggttgaagagttaatgtgcctctaaactatggatcaaatagaatctaagtcattttaacatttttcacattatataaatgatgaaacggagagagtatatattatgtagataaagggggtttaataatattgtacttaccatattataaaaataaggtggaatacgaaataaatggacgatacaacaccaaaacaatttccgttttcatttatataagttttattgctctcccgtttcacaatataagtctttttagcatttctcacattcgtattgatgttaataaatctagatataaatatgagaaatattagaatggcttacattgtggaacggatgaagcagttcgttcacgatgactataaatttcatattgatcagtcgatcgatagaaatcagaaacgagcatcggttgatcgggatttttcgtgaacttgttcatcccttcatgcaattcatcagccgttttgggattgagctccccgtgacgcaacgcatgacaattgttttgccactggctaaattaacgaggctggttgaccagctgctgctagccaagcatcgctacgttgacctagtttggcacgacgtacacattggtccgaaccaagagaacacgtgtaagatggaaaaaaaaatcaagcagtggaattttgcgtgcattatattaggcgtataacgatcgtcaggaggcgaccttcaatggctgaaatccttgaattgaagtcagcaactggttgagaagacattaaggccccgtttggcacagctccagctcccaactccaacttacctagagctggagctgtgccaaacggtacagattctctattttctggagcggagttagcagagctgctctacaaatttgtactatgggggtggagctgggttttgctgctccacagctccactccaccctaaaagacccactaccctttaattttttaaggatatttacaccaaaataccattgaactaccctatctaccccatctcccgttctctctcctcccaatctttctcccttcacaccggcgttcggcattggcgtcggcgtcggtagcggcgggcagcgggcgtcggtggcagcgggtggcggcgacgacagcaggtgcgcgggcggcggcgggtcggcgacgcgtgggcaggacagcgcacgggcgcacaggtggcgagagacaggacgacgagcggatggcgactggcggggacggcgcgcaggcggcgaaagggcagagctcgctcgtccgccaccgcggcgacacaagggcggcgactggcgaggatggcgcacgggcggggacagggcggcagcgcgtgggagacgcaagggcggggatagggccgccgacggcgggtggcggagcgtggccggcaaagggcggcgcatggcaggggaagggcggcgcgcgcggggagggattggggatttttattttttttaaggcaatttcagatctggagctaaaaagtcagccaaacactttttcaatgggtatctactcccacaggagctagctctcactggagtgggagtttagagttaggagttggagtttggagccctaccaaacggggcctaaaggtgggatgatttaacccggtgtcctcaaatattattcatgagtcgttattagtacttgatttttttaagttaaactttttaggtttaatcaagtttataaaaaaaattaataacatctacaccaccaaaataatttcattacatgtagcattacatgaattttgataatacgtttgatttatgtttgaaatgttgttatattttttcgcgaacttaaacatgtttaacttaaaaaattaaaagatctgtaatgtaaaatggagggagtaggaatttagtgtaaatgagagatttaccgtagttgtgatgtactcgtactatataaaatgacacgcatatgtatacatattgtaggctagcttatagataggtatttttatgtatatataattcagtgaccgaataactgaatgattttaatatattcacggatacaaacaaactattataaaatcaaataatatttaaacaaataaattttatgaaaattatattaatcatttagcagctgtagaagcgtgttgaagaaaatgacaagggagagacgtccttcaattttttgaagaagaaattatgagcatgttacaatttaaataatgtaccttaaaattaaaatcacacaccccttaccaatacactgtcaaagtactaagtacatctcaaaacaaataacatgccccacaaaaccaaccgaccaactacttaatccattcacacgtaggatattaacggattaactaaactaatcttgaactcgggtctactgcttccgtggctttcgatgctgccaattagctaggctgcagatacttagcgcctaagctaacaaaccaactcgcagtagtccagcagccggccgcgctggtcgatattttgcgtcggatcatacaaaaaagtagaaccaaaaaaaaaaaaagataacgcgatccaagcgaactttttgatggcgacgttgcgagctcgctagcgatcatcgagctaaatatatagcacgggggcagcggctttacgattcattgcgaaccgctacctttttttcgccagaatcatatgcaaatgtaccttaattatctatattatattacatatcatacaaatatgacatattatttacaattttattatatttttaagaacttaacattcaaataatgtaagtcattatctccatatcattttcatattaattaaacatatacatctatcatttatataatatatagcatgcgttcattgatccatatatttcacagcaaagcgcgggatattaactacgactttctccgtcttataatataaaagatttagattgaatatatgtgacatattataatgctatgaatttagataatttttttatctagctttataatattaggatgtatcgcatatatatacgatctgcgagctcgatcgaaaggttgcgatttaattagattaattagtctcgtttaattaattgttcctacgtgagtacgtgcgccgccacaggggagcatatgcatgcactggttcggtttgggttcgtgagatcacttgcttaaaatttagtttcgcctttgctttggggcaaaggaacgaacagatgcgaaagagacgagccttgcggccactttgcatagaggaccctcacgttcaggcaaatccttgtggggcccttatactgccatatctcaaaacgtttttattttggtcttttttatatcatccgactgccatgtcgaccttgatatggcgtgtgttgtcatggtattcgctttagggaaccttcatggcatgcatagtctttcagtatcaggcctgctatttttcagtgtagtggtgtttctctttttattaaaatacatagtttatctcgacttttattagcatatttttcaagctgcttatgaaaactttctatatatacattactttaaaatattaaaacttaatttgttgtacgttaattactttttttatgtatcctagctaggggaaaaaacaccaccgtagagtcactcttggaaatggagtatggctgtgtttgcaaccccttgttcctagcccctatctctcgttttctgtgtacacgtttttcaaactgttaaacggtatattttttttgtaaaaagtttctatacgaaagttgcttaaaaaatcaaattaatctatttttgaaaaaagaatagctaatacttaattaattatacgctaatggaccgttccgttttccgtgcggagagaatgagttctcatcaagctcaagcgaacacagcctatattgtgtttctggctacgaaacttccgattatgcgtgcaaaagcaagaaaacagcaacttggtagcatatgattttctgtggtttatatttgcccgtaataggatttcatatgtaaaatacatgtggattaatctatcccagaactagaagagcctttggacaaaaaaagaaaacactcctttcgatttttttttccacatctctatgtgcaaagaaaatcaaaccctcacatcacgagacaattttagtcatgaaagtaaaaaagaaaacaatgattctcattaaacaggaaagtcgtagtattgaccattagcaggtggtaagtaagggacattaaagaataaaacttcttatttcatggatcgagagtagataagaaggtaggatttgatatactttttaagacagagtttaaactttattactttgggacgaagaccgcactctctcggtttcatatcataagttgtttaacatttttattagtcaaaattttttagttttgatcaaatttattaaaaatgtcagcaatttctacaacaccaaattagtttcattaaatttaatattaaatatatattttgataatatgtttttaattaaaaatattagtatatttttctacaagcttgatcaaatttaaagaagtttgagtaagaaaaaaaatcaaatgacttataatactaaacggagggaatatatgatttggggtcttttttttttcttcttacaagtggcagagtgctgtccataaaccataatattggcaagcagccgggtttgtcctgtaaagtgcatggaaaaggcagattcaaaggagcaagattaaagacgggagaaaaatagcttctttcttcttttggttttctgttatggaagggcagttcgcaaggtcagaattccacctagttgacccttttgacgcatcccctttccggttctttacgatattactcctacgtgccttactcctgattgtctattatatgcactaagcaaattaaagcacttaaccaaacggccggcatacgtagttaaggttttcagtagcatgcatgcatacacttgcatgggcgtcaaagcatagtttagtattgcactcactcactgatcccttctgctgagagggtgagggtgagggagagaggtcactatatataattatatatatatcaacatttttttatggaaagagagctttattgattgggagtaagtaacaggattaatattacattgatgcattatgtgcttaacacatgatggagcatgaccatgcgcgctaaactgcgcaatgaatcatccgcttattagcaaactgaggattgaacattgatatatgtagtttctctgtttatagatccgttatctaaaattttcttactctggtcattaattagcgtagaaaagttatgtatttagactagaaagagtagtacacatctaaacttgtccagaggacattctaaatttgcataaaattaaatatgtgttggtttacttaatttgtttaatacatctctcggcttatacctatactgtgtttttaagattgtctatatcgatgggatacccgtagtccggataaatagggtattatggtacgttggtacgaggatctacacgatacgacatcaagcaaacaaggagacaaagattatactggttcagacccctcgtaagataatagatctaatccagtttatatgagattgatatggaaaaccacataatacaatgagaacagatgaatccggcgttaccggctagatccttgtcgagatgattcgatgagatccctgggcgagtaggtttcgcgtcctccggctcgtagactttggcgggtgtgttggcgctatgattcgatgatctgaacccctcagagggtgttgccttttacaccataagtcaccttagtctccaagtagaacccggagacaatgaaccttgcacgatatagaataaacccaatcctctctgagtaggactctgataaccacttgcccgtgaggatattttccataatgtcttgtagatttccttacgcatatggaaacacatcgtatatatgaaggtatatcgtatccgtatattccgtaagtcataggttatgaggtatgccttactcgtaaccatgatactctataatatgcattttattttcacattggcactttgtttttataaaaggcattataatactcggcttttaacaaagccaaaaggacaaaataatatacattgttctttttttaagttacagcaagttgatagataagaaatacctatacattgttctttttttaagaagtatcaatcatttgatgaacttatgatacctatattagagcaataggctctgattggttgagttacgtacggccgataaccatcgaaatattaattaacgaagcaataaaaataaattgcatgtaaactttcatatctatatattgttaatttgtttctaaaagcccatgctagaatatatagagagactacaacgaaaaaataaagccttaagcaaactttagtttaagtcaaattttgtacagggctaataagccaacaagcgggtgatgagaggctaaaatgcctctttgtttgagtttaggtttattggtttggtttttaagctaatgtttccgttgatatgttttataagccgatgacactatggcagcttttttttcttatatattttataagctggtggatttaaagttatggtttaatggtggagtcaaagtctccatcccacataagaaaaaaaaacgaagaatgtttattttggcttagacttttcggctcgtaaattggtttataaatttaaaaaagggcctaaagcattaagtttaatggtgaagttataccctcagttgaaataagctaaaaagctagtttctccaacctaacttttggcttaacatgtgatagtggcttttggttttagaaaagctagccaaacaaaaaggctactcgtttgtttaggtttaaactttttagcttataaactggctaataagcctgaacagttacagctttattgatcaacttatttagtttaatgattcatttgcatgaaagttcctaaccacgggcctatatagcagaaggatctaattctctaactttccacttggggctataattcttcgaccagcatgcatgaattggcactagaccggaatttttctttgaacaagaatttgacacttggctagtgcatcttcatcaccttacttctttttttttctcttgtcttttacatttctttaggttctaaaatgctagagagagaagaaaaaaagaaacggaatctatatcttcatggagcattagccccaaagaaaggaatcaaggaaccatttctgaggggcccacagagtataaagagaagaataaaaactgtgaattataagtataacccaaatactacttctgaactgcacggttgcccatgtatatgctaattcctgagtatatcctttcctttgcttggttcatgaatcatgatgcaaaaaacaatattgaggacaaaggatttacttaacgaagaagcacctacaatttcaaatttacaataatgggatttcgaattttgaaattaaaggtgcttcttcattaattaaattttgatatcacctagggagatttttttgagaggcactgttttggctctggttaaatagaattacctacttcaaaaaaaaggttactgaaaaaaataggaccaacagctttcgtnnnnnnnnnnnnnnnnnnnnncgtttagtaagcgggaggtcttgagttcgactctcaacgaaagcaattcatttcaaatcatatttttatttgctggagaataaaatcattcgtaactttttttttgttgttgtcgaataaaatcattcatgatttttttcccatgactatcaagatgaaatcattcatatttttttttcttgaagatgaatcttctttgctggaagaaaacaataatttttaaatttttgctgaagatggactcattcataattcttaaaatcattttttcatttttgctgaaaaatttccatttcatgaatatgaatattctttgatggaagcaaacatattattgttgttgttgttgttgttgtttaagattaaatcgttcatattttttctgaagatgaaatcattcattttttttttcatgaagagggatcttctttcctgggaacaaacatttctttttatttccgaggatgaaatcgttcatacttttttctttcaggacaaatcttcttagcacatgtttatcgaaagcatgaacgaaaatatttcatcgtcttatgatatactctatctcagtttgtaattataagcatttctaaattgcttagcaaatattacagataaagagaaatatttgttaaagaaataaggattacaggaaatatttccttttactaagttatcacattggttaatttttaaattggttgtattctcttctcagcacctaattgtctggttgaatcccattcattggaataagtgttccccaaaaatatatattgtatacaaaatttgaatattataaatgtttgtatttggtagcaggattatccaactaaaagatactcctaacaccttttctattaaaggctacgttcatttcagccatttggcttattaagccttgtcttttcggaaaatatatcagtgtatgattaattaggtgctaactattataaacttaaaaatatatttatttaaatttcagtaaagtcttttttaaaaatataccttttagtggtttggaataaacatacattatataataattcgctactacatccgtcctaaaatatactaaatttctaaaatttctaggtggataagggtatatttacatacgtagggcctgtttggtttggttccaatttattaccctaccaaaattttggtaacttcaacagtagcaagtgtatgtttggtttgctatcaaattctacccacaattgttcaaattgaatactaatcaatttggtattgccaaaatttaccaatgttttggcactaccaagatttttgtaggataaaaattagctccaaaccaaacaagcccgtagacaaaagttactagtatattttgtgacggaagtagcaggctagcagctagtataactgtttaaaactgtgtctgaatgtcttgtaactacagagtgagtggcaataacaagaagttagcaacagtactagaacgacaaaaacagggtccaggtgatcgatacaccagcaaaatctcaaccagctgccgtggaacttttgcattatgcaatgatggaatgccggaaagtcggggggaatacccgggcgctcatcggagccagatctgcaggcaccaatgcgcgcaataccatcattcatcgacagacgcacaaatgagccgatctcgatttctcgggaacaatttgcaggagatattggatcctgcactggcagaatgtaaggacctgaaatgctggtaagtgtgtgattccctgaaaatgctgaaagtgtgcgactccgagcacagtgatgattgcgagcgcgacacaagtatgtgcacccacaatcactgaaaattcgatggtgtgacagcctcgtgtctcgttgagctgaaaatgtactggtagaattgagcagactactagtaccacttgcccaagcacattcttgattatctgtgtcaaaaattgttggcaacatcttgatgaatgatgagagtctcaagaaacaaaagatcatgcagggctgagaatcaatcattacaagtttgcaaccaactcggtactactacttctagaagcattatgaatctcctctgcggctctgcatatttcggggctgtctggttctctcccttatcaagtcattggtagtaccaaattcttgacatgtttggtattatcaattttttagtagggtagagatttattatacatgtttggataactaccaatatgatgtcaaatattgatcatatagagaagaatgttatagattagtaacaaattgatcattggcattaccaacaatttggcttcaatccaaacccacactattagggcttgtttggtttagtaccctaccaatatgttggtagtgccaaactctaggcaagttttggcactaccaatattttggtagggtagaattgtaaatgagtgtatttagatttatgccaattgaaagccaaattttaaattgtggtgaagaatattctagaattatgccaaattgagtattggcattaccaaagatttggcttcaaaccaaatcatcacatttactatttaaaccaccaaaaatttggtatggcaatattttggtatcaaaccaaaacaccccttactattcaaggtatcaataaattggtagggcacattttggcatcaatccaaaatggcccttcttgccccagaagtttgctgatgggaacaggcgatcatgttctcagcttcgtcagaactacaaggtgcagaatgcgtggacaaacactaggaactaccctatatgaattcataccaaatcatatactccagaagtatcatagtagtagctatgggtgtgtttagttcacgctaaaattgaaagtttggttgaaattggaacgatgtgacggaaaaattggaattttgtgtgtagaaaagttttgatgtgatggaaaaattggaagttttgtgtgagtgcatatactcatggacctagggaaaacagaacagtatggacactaaaatacaactctgcaatagctctgaagctaccatcctactaagtgtgtttagttcacgttaaaattgaaagtttgattaaaattggaacgatgtgacggaaaagttagaagtttgtatgtgtaggaaagttttaatgtaatagaaaagtttgaagtttgaagaaaaattttggaactaaaatcggcccaagccaatttgagtatgcactgatacaaacatgcaatgatccaataaaacttggctttctgaatgtaggagttgatgaaaatgaatataggcggtgtttagatatagggtgtaaagttttggcgtgtcacatcgaatatatggatacacatttgaagaattgaacgtagtctaataacaagacaaattatataatccgcctataaaccacgagacgaatttattaagcttaattaatccgtcattagcaaatatttactgtagcaccacattgtcaaatcatggtgcaattaggcttaaaagattcgtctcgttatttacacgtaatctgtataattagttattttttttatatttaatactccatacatgtgtccaaacatttgatgtgatagagtgtaaaattttgccgggatctaaagagacccatagagtagaaaatttgggactcaaaaaaatgtctcattaataagggtgtgtttagttcacgttaaaattagaaatttggttgaaattggaataatgtgatagaaaaattgaaagtttatgtgtaggaaaattttgatgtgatgaaaaagttgaaagtttgaaaaaaaaagtttggaactaaacccggcataaacccaactgaccaactgtgctgaactgacagccatttaaagttcaaatgtcaactgactactaatcatcgccaactaataaatttgacattttgattctttttttcaaacttatataactttaaccaaattagtttgattaaatctaacatattgaatatacctgtataatatgtttatttgtgttataaatgttgctatgtttttacaaacttaatcaaactaaatgtttttcgtgaacgtgcaaaaactttgcacatcactaaaacttaaagaattttaagttagaaaaaaaaacaacgtcatatagagtaatatgtaacggaaggagtactaaacaagtgctcagccctgaacttacatcttccatagtgatcaagaaagggatgcatagcatcaacttcaggcattcaatgcaccaatggataatgttttttcttactacacaaacatcgagtgatgagcaatgaatgattagagaaatgagcaaaagatctcatatgcatgatgcatcacaaactgacatttagcaggatacgcagaggaacagcgctagaacataaccacatcaacttattccatccacaatatcacacaaaaatggaaagaattaattagcatatgctagaagtttagcataattgcataaaccttttgatgcagttcaagcttagcatggagaacccaatatatagacttaaaactactcgagccacaacagcagtcaagcgctgctcgcaaacttacacgagaagagtcaggggcataaaaatctctccgtaaaaccaaaactcgaagaaggaacaaaaataatactagcaaaatggttcaaaattcagaggactttgctcaaagatatcctccacccaacaatatataaactactgaaaaggaaaattaactgaaaacatcaccaatgacccggagagcggtggcaagcaaagaaccttttagatccgtacaatactccgccgcctccggccgtacctatacgccttgtatatacggtacgaacgcacacacgcacgtagccttcttctcgatctcccttcgcatcctctcatcgttggtagtagacagtagtacaactacaagtaacgcctggctccatcctgtctgcctttggtggcggcggcggcggcggccgcaccctcttacacctacattggccgagactaggcaatgacagggctagtcattcgtgggtgcggccgccgggttcgccattggagaggccggaggcaatggaaggaggagcagggagggagacgactagaagaagaggcctttccggaggcaatgctgatcagtgtggaacactgtacatgggtacgttgtttgtagacttagtgtatagacccatatgccatttatatgcaagaaggggagaagcaaatccatggaccaggtctagagagaggatgggcctagtgggcatggttccgccagtgatgggcccacacggagatagagcgtgtgggtccttggtaggttgaatggggagatgggctatgggcctatggaggcctctttcagttttctgttggtggggcccaacacaggacattcctccctgtctttcgttttcatcgctttaaccccaaacctcccaaatgtaaagcccacaacgctcctcacctcttaccgtccctttccttccacctctactgtatgtggcgtcgaggaggaaacaacagtgctagtatgctactactgttttatatggctaattcacctgtcctaaaatataagagattttagattaatgtaacacaacgtccaaattcgtagtacaacctggttgtgttaaattcatttaaaatcctctatattttgagacagaggaaaaacttttctttagtaacatgcatgtttgttaggtaggaaggatatcaaatgtggtgtttttttaatgaagatgaatataaaattaggacatataaaaacaagaaagtcattattgtaaaattaggttagttttagttattacaaacttaaaaataattgatttaatatttttaaagcaacttttatatagaaagtttatgtacgaaatacggataaaatctgtatgttaatcagagaagaaaattgtgtttatcatatcacgagatgtcggcaagtttacgattgccatgcttaggtctgaagaagctacccaaaaattgtcctaccatttttagcgtgtagaaatgatcctttttctattactatgaaattcttatgtaatggatcggtccatttggaaccctatgcatttggaattgaaatttgtactggttggcatttgtggacggagggagtacgagtaactcgtaccgtcggccctatgcccggagcaatatgaatgccgctcagtggtgacgcgacgagcgccgtgcagccggtgcaggcagcaggctatcatctggtcccagccgcgtcaccgattcaatccacctgaagaattcctccagctagcggagcggtccagcccaatctcacgcgaagccatgcacacgcaagcagctctcgggcagagcgcgcggcgccctcgtccgtcctagagctgcccgacgaggccgatggcttcaggctcgccaaagccgcgctcgctatcgctgcctttgcacggagtagtgtctaatctgaccccgcgcccgccaattgcagtacacgacgtagggactgacggactgtggcctgtactactccagagtgtagtagagtctgtagagcatgtaatacctggactggagtagtggagtcgtgtctcgatcggcgcatggagggacggtccgtcgacgtacgtgtggaccatggaggaggagacgccgcctgcgacgctgagctgagccgtgtcgtgtgggcgtgtggcaatgtgccacgcccacgcgcaggagcgtggacctcgcgaattaacggcgctcgtggcctcgtgctttgctcgccccgcgctgcgcgcacccatggctcggctggctcctggcgacatcgtgggatgctggaaacgtgcccagaggcctcgtcgtttgcacctgcctacacacgcgtttgctagtacaatgcaaggatccaagagtatacggcggcaatgtaacgtaaattcctccaaggatttctactgtaccaaccacgttttgtgggcttaaacatgtactgtacatgcaacagagagatgcacgctgtcacacttcctcaactggctcgatgtcacacccttcaattctccttttttttttttcagaggtactcctgacattagtgaagcatcatctagtctagcagtaacaaggttaacgaaaggaaaaggtcaactttaaccgactcccttaatagtacgctgaatttaattcgtacctctcaacaaaaaaaccggatagaactactcctcaaactattaaaatcagtgcaatttgactctctcagtggttttaagtggcggttttactggcatgacactgttgacctgatattcatcccaggtggtgtttatgtggcattagagcatctccataagtgactctccaagttaaattttagcctacacatgaaaaaaactccctccatcagcctagctacttggattgccaagccatatggctggccaaacgagcttctcaactggccaaatttggccagcctcctcccagttgccaaacggtgggccccactgtgggtcccacctaactctttctttgcttccctcttctcttagccgacggccagctctcatgccctctaccgacggcgccgatggctagctcccacggaggtcgagatggccggcaagtggcgcaaggtggtcggcggcggcaccaacggtggaggaaggcatgcaatggggcggcggagggggacgtggcgaccgtgagtgagagagggcgcagagacgacggacttggagggacgtggcatcgagggagggggatggggcgcgatgcacggccgtcgaagaggacgaggccgacaacgccgttcgtcgtcggggacgcctcacgcatgcacggatccaccattgtcgactgccgccgaggagggcctcccgcgccatgcactcgccgctgcctcaaatgcgcgagggcacgccatcgccgtcgccgctcgggtgctgccgccgccgccaccgtcatcactcggcttcttccccgccgccgatttccgccgctacctccacctccgtcagatccgctcgcccgcccgctgacggcacgagggaatcgacgaggaacggtggcgtcgtcgaggtcggcgtcgcaagctgccgccgtcgtcgtcgtcgaggtcgtcgtggcaagccgccgccgtcgccatccccgccccgagctccgccgccgccgtcgccatcccggcgagcgcctcccgcctcccgcgccgccgcgccgccttccgcctccccgcgtccaccgcgcgccatgcgtcggccaccgttgtcatcagcgtggttgacgggaaggaaggaaatgggaaaagaaggaaaggaaaggaagaaggtggggaggagagagagaaagaagaggggcagaggcttacatgtgggtctgtttttattttggagaggattaacagggagtctgttggagtgagtatctagtttgactagctaaatcagatggagagttggccatatagatgtttggagagtccgatttagagaagctgctagagatgctcttagaattacaaaaatataagtgggacctatttgtcatcacacgcaaaaatatattgtaggacccactgacatgtggggcccacatgtcatctcctctctatgacccttcttcccatctccccttatcctcatccggcagtgccctccccattttctctcctggcggcagtgtggaggttgggcacggagatccggaggtagtgcggaggctaggcaagcagacctggcgaggtggcgatggtggcaacagtggtggtgtggaggaagctcatcgcccccctctctctcctggcggccatggacggcgaggaggagcacggcgcagcatggcgctgccatctccctcgctcgtcggcctcctctttctcccagcagccatggacgatgaggaggagaacggtgcgtgcgcggcactaccgtctccctcgatgtcatctcccttgctcgccgatcccctctccctcccggtggccatgaacagcaaggaggagcacaacgcggcgtggcgctaccgtctccctcaatgctatcccccttgctcgcaggcgtgggacatcgtcaacgctaccagggatagagacggagccagaggtggggaagggcaacagaaagggcacgaaggagaggtgagggaatgacttcgtcgggaggaccacaaccaccggtgaggaggcggtggcggagagtgagaggaattgcgctgcttgtttcgcgagctccttccccacacgtggtttcccgcgcgagatcctcccccacgcgctgggataagggagagacagggaggaggaagggctggagagagagaggatgacaagtgggccccacaatatatttttgtgtgaatgacagatggttccagatatattttttaaattctattgctacataagccatgtgggacgaagaccaggtcaacaccgctacgtcaacgtcatgtcagtaaaacctttgagggagttaaatgttctggtttcaatagttcggggagtcatcctatccggatttatggttgaggggtacaatacttaggctgtgttcggcacacccttttcccaacccctctccctcgttttttacgtgcacgcttttcaaactgctaaacggtatgtttttttaaaaagtttctatatgaaagttgctttaaaaaatcaaataaatctatttttgaaaaaaaaagctaatatttaattaatcacgcgctaatgatctgctccgttttctgtgtggagggaatgagttcccatccgtttgatgcgaacacagccttaagggagtccaaatagacttttttcttaacgaaaaatggcttagctcctcgtcgtcgtctctctctcctgcctagctctggcccaataacgatactgggcttcctttttctaatcaacgatatcaccgcaaaaaaaggaaaatctaatcagtgataaacacacactttaagccacgtatctttgattcttttccccttcttttcctgctatcttgggctcttgcctccttggtggactcgccgccgactactctcggagaaggaaagagcgaagaatggccgcctcatcgtctctcagagtaatcacggcgcccccaaaatccctccttttttcctttgttacatctcgttctctaattcgtgttggtggttggttgacgatgcagctaatcctcggctcctcgtcggcgtcgcgccgccagattctcgccgagatgggatacagcttcacgcttcttgttggtgatttgcccccatgttttctggagcttttttactctattattagtctgttttccttgtggtttatttagttcgtacttttactgtttcccttctaccctcccgtggggtttttagagtgcggatattgacgaaaaggagatcagaaaggagaagccggaggagcttgtggtcgcgctggctcatgcaaaagtaactcctttcctcctcctgttattcaagaacttggattctagttccttcgctaggaaggagaagtactgaagtactttcttaggaaggatagagaagagggggaggggagttggacctagcctgacaatttttggtttggttgtagactacttgtctattacaactattaaagagatagaaagagaatgtaacatgttacatgttcactctacagggctagaaattctgctttagttagaggaaaaaatgattttggtgggtttggattatgatagtgtagattggttgcatatacactagaattgttacatttggactattagtgtaattatacttttatcaataggtataaaaattgtatagcagatatattttcagagggatagtctattagtttcacttgtgtgggtcagcaggacgttcggctaggttttactatttactgcgagagaaacattttagggggacattttggaggtttgggcatgaaaaggtctgtccttttatcaacttccattaatttattgtatctgcttcaaaagttttatgttttcctggttctagatacaattttctttcagtgctgtagtgcagaactgcagactacagttcaactgtgcagcacattctgaattaggcattgactatgtactatgttactatggtttattaattttgcaggcagatgctataatggagaagctgagggataatgggatgatgaaggaaattcttgattctcaagagactacactgttgataactgcagaccaggtgtgtggcttacatctacttatgagataactgcttaatagtcagtaatgtgttgtggtgagatgattttaactagtttgtgtagatattgcagccaatttaaacaaacactagtctaggctgaattgttgttaaaagcgttcttgtggctgcatatttcaaaattgggttcagctgcttgtgttttttttctctgtttgattttaaacttatatgccgctcaaaagataatagtattgaccatcaaacatgcctattgattataagggcagtctcatagttattagggtatactaggatgggttctgaaggagtatgtgtaatattactgattgatccatctccagaggcataacctgtttgtttgcctgactcatattcatatgcttggcatcttgccattgttattttgatctgtagtctactcatgtttgatcagttatgcactgacttatagataatcataagcattcctatgtttgtgatttccctatgacttgtaacggaaaattggaaactgaaccttccatagccattgctaactaccttcatctgtttgtcatgactcatgaggcaaactagtttttgtagggcacattattatgacattagtgatttatggcttcatgggtaatcatgtttagcatatgcttggtctaaccgaaatacttagggatggttctgtagtaaaatgcatcattaatggcactcaactcacatgtatttagatgaacattttggttcttatttgttttttatccttctcatttttactttctgatggaggttgtggttcatgatggagtgattagagaaaaacctagcaccccagaagaggcacgaaagttcatcaaaggtttgtgctattgtgtataagctcaagttttgttcagatagtcctttccctgtattgcttgctggctgctgctcaactatattccgtttacaggatactccgaaagccatgcagcgacaattggatctgttcttgttactaatgtgaaaagtggagccagaaaggaaggatgggacaaagctgaagtaatacctaaatttcttgatgttttatttcggaacaggacatcaaagtcgtgcataaaacctcagagactagatttcatttttaactccaactctatttcaaggagagacctgaaacttgaactactgtgaatagttcaaatttgttattcttctaatatgattgggtgcgtgtgtaattatagcttccacttcaaacttggccgagcttttaatctgatttaagtgaactatgcaaattgcctcaagctctaaattctaatgttgtttagtgcttatcacttctgaaatctggtgggctaacttgtatcaaacattcagattctgagtcacttgtgatctttgtaaagtgatgggccagattgagactgatgtgaatgtttaaactaattgtagaacgctaattttttgcatcctgatttggctcagaagtattagctttctaggtcttcatgtagaattaggtgcacaatcagatcacactatcattgtttgtagacaaaaaaaattcaaactaatcctaatgattaaacataatcagttaggaccctatattgccattgatatgagttctggaggtggtttttggcctgataataactttccactataattgtctatgaacaggtttatttccataagatacccgatgaagttgttgagagtttggtaagtttgtagccattggtcgcaaaagttatttcttgctattttggcactatatttttgattccggagtttgattactttgatactttgactcagttgaacaatgtttttcacctgtttatatttcagattgaggagggcgatgtcttctatgttgccggtggcctgctggtagagcacccgctgacttcacctcttgtggaagctattgtgagtgtagttcttgcatatcctgcttcttggttcagcactgaaaatagaaacctttttacacatggtactcgcctgacatttgataaactcttatgaaggttggcaccatcgacagtgtaatgggactcccgaaatccctcacggagaagctgatcaaggagtcccttgaggagccatagctattttttttaccgggacaactgactgcccatgctgaagttcatatgctagaatttttcactcatctgctgcacaaccaactcgtcatccactctgcttggattggaggatggagatgcatcttaccgatgttgtcagcttgactatgctaagctacttgccgtgattggcattattgtagtaaaacctgagactttactatgtggattaatctgtttggattaaattttctctcttggtgcgtgatcatctctctcatgatggatgcaaacccggttcatctattcgaatctctgcggttttaggatgtgtttggcacttgaggttgagaactactccctccgtcctataagggatcttgagtttttacttgcactgtttaaccacttgtcttttcaaaaaattttggaattattatttatttatttttgacttactttattatctaaagtactttaagcacaactttcgctttttatatttatacatttttaataagacgagtggtcaaataatgcaaacgaaaacttaaaaccttatggggtggagggattaatcctctaggcacttaaaacataacggctcattagcatttaaagtaattttttatagaaaatcttagaaaaaatatactgtttatcagtttggaaaggaaaatgccgagtgaaaaacgatgtagaagctgggagagaagggaatatagagccttcaatgtgcgttgggacttgggaagttctgagcgagcgatgggggctttgttccggtttgaacggtcgatgacaggtggggtccaccgtaagagggatggccatgggcccacaaagcagagactgaacgctaccatccatccctggacgaaacactcgaaaatctcgaatctttctcccgttctcctccccacatcgccggcaccgcgaaccaccgcggccaccggatcgcggcgcggcgcggccgccgacgagcgagggctctcgaccgaccagaacaggtgcgctaatattttctccgcgtggtttccgtgcctcgtatgccctaacggaaggaggaggttgccgcggttaataatgttgggttatttttttcccccgcgatttagcactcgtgaatcacgcgctactctgttttggagtgaattgtgaatagtatgcacaatcattttgcttagctgttgacgcgctcagcttgctgtgtgagaaaacactgatgcctcatttatctgcaccttatttttttatggccggtgtgtttgctgtttagattcataggatagccagccactggctcctttgaacttctgggaaaatgttttactcatacgcttttctattggcatacctatgtgatattattcagattgagctgtttagttttgaatttaatcacatacctagagttgtcctctcggcaggttagtacaacagcaatagttgggcacttgagatatatttgtgggtgggatatagaacttatgataatggaaagtaatatcatagcttcatgcgctgcagtttaattttagatatttgtaagcaacacaaaaatggtagacatctttaactcaaaggatgctagcttttaataactattctccttttactactatcggaggccgctaagtattaatgttagtgaatttaggcacgcatgtatgtgcgcacactgatatttttgtgtgtcattaatgactggtggatggggttacttgtgtattggcctttgacttgatggcgccaaatgctttagtagttaatatacatggtaatatatcatgcttgtatgttctataattgcagtttgtgtcctgaacccacatagtatcttctgtaatcctattgtttgactactgcaattgtatttctatgaaggatgcagttatatttttagagaaagggggtcaattcttttttttttagtgaaaacatataacagagtttatacagcaagggaaatagctgctcacaacgcaataaaaactttgtaaccatataagcactaagcacaacaggctatccagatttaaccatggttacatcaaaagacactgctctcagcaacaacgataaccccagcttgaattttcaattcacaattattctatgccacatcgacacaagagtctagcctacagtacttcagacagccatcaccggggtcttttccttcttgctcaacatagactttcttttgctgcgtttaactcaaatttttacataaccaaatctatcttcaactaccatcttattttgacaggcaacaaagcccaaaggacggatcctagaccaacaagcacctactgattttgcatgtcctactacaaaacatttttgtgtgaagtctttgatatttggagcatataccaagtaaagtttcaacaatccaaccagtcatatatctttgagatcctcaatgtgctcaaacagaacactggaacatattatttctgcaaatcacaaaaataaagcatgttttttatagcttaacctgttcgaaactgggtattctttgaaaatagggaaaacaccacatgggaaaatgaccataacaagataattctttttccttgctatgcccatgaaagaaatgtaaatgatcattgatttggtctaccatgcctcacaaggcctttttcattggaaaaagtaatatgaattattgatttggatccacatccttagtaattagtttaaatctgaactaaatcccaaaatgtcccaaagaaatagccctcagaaatttcaaatgcaccttaaaagagataatttatgtttgtcctttatctacataatttccagttaaaagcttgaattattttgatctttgttgttggtgtgttgtgaggtcatggatgtataatggcgagtacacaagacaaaggtaaaactaatggaggtacttgggagttgggaccatataaatttgtataagttacatatcgttgacaaatgtgctgcatgtaggctgttgctgtggaccacttttctgtagcaccagctttgtttcttgactttgtacttatctaattttctctattgagctaatgttacatacacctgttgaaacccacattgaaattccaattggttccacttaatcccagtcaactttgtatatagctggttgtttggttctttcttatattaccatgcttaagagttatacatgaacaaattatctgtgatcaattttccttaggtcagagttttcactaagaacaagtttgcattactaaaaatatccttttcacccatgaaatctctttttgataacgtgcctttcgttgattttgggatttaagaattttattgcagggattatactttatgcaatccttctggcgagcaatctgctcaacccagacttgacaatttagtgaactttgggcggttatgtttcccttcctgttcaggctaaaatttccaaccagtagtggtactttcttgtctgtaaatttgtatcaaactgttactgattttatttgccccacctcagagcatactggatggttccccagtcatacttaataatgtatctgtgacatcttctgcttcttttagatgtccattgtctaacattgatgtaaggacaccgacatccttggcaagagaaaaggaagtggcctatgagttctagccttgttatagtacctcgtttgactccatgggtgctgttcctatatctaaaaattgagatgcacgtggatataatctgtaagttagctgcataagctacgaatttgtatgtttaacaagttaaacattagtgctattgtttgttcactctccttgcatttggtgcctcatagctcatacatggctagaggactagaagtatgtggttgaacttgaaatggtcaagggatgactagttgagtgctatgaatctgataccgtgtcaaccagttgaattctctttgagatagaaggctctagaaagaaagtgaaactctgttaaatgtgcatgaactttgcattttatgcagtgaaggatctttccccttgttttagtgttatactagtgatatgcaacattctcttacgttgaagcacttcaagacaagagtctgttgcatataggctttttagactattattttaccacacttcaaggaaataaggcgtttgcatataatttaggctattataccacagaacacatcagcacatgcactagaaaccaacacactacattagattcattttttcatgaaaaatactaatgtcagacgttgcaatcactgtttttgcatgatcaaattttggaatctgctagggctcagcctataagcttgagctttgccctcaataagcttaagttatggtcaaatgtaatatctgttaggacttaggggttttactagcttataaagataagctagagctagagagtatgctatcaataatgctgtcgagttcttttatcttacaaattttttatttatacaacattatttatgtcttaattttcagagtctgtttattacctattggtcatttaggccagaccgtcagaatctatacaaagtggattataaaagaatcttaagcttggcaaaagttccaacaagccttcaatatactcgcttcgtatagtttgcaggctcttgtaccaagggcggcaaggaaaccttttttttttctttttactaaattacccataattatcatagtactattctagatattaagggtgaagtgctttgatatatgtgtgctccctacattcttttacaaaagcttttacaattttatatggaggagggagtagttgatgtagtgttcttactttgagctattggactccagtatctatcatgggctgtgtggttatggctgaaccaaccaccacgattattgctggaatttttagctgggctaggctgtaagcactccagtggggcatcaatcactgcaccagacttgataaaaattaatatgaaacttgagctgtaccagtttctgctagttggaaatactgcagagctagtctaggagtttctatttgttctttgtgcttgcctgttacctattcattttgaactaccttttttatcttttgcttggtactacccagcagaatgctgtgagttattcaaatttcatcaccctgttttccagggcaccaatgatgtgtactttgttgcaactttctagctcacagtagaatcaatcattttgcaaactgatcataatgatcattaacatgctttgtcctcctcagggaaacaatggtggcaccaaatctactgatgtattatcttgatggtttctcttagtagctagtatcctgttactggctgggccatcttactgcattcttatctaactctgagagtttgctattgttgtgctgcgttgttttgcattgtggaaatctagttctttacaggcatccttggtaatgctaataagattttcaattactagctaaattccattgctttgctacggataaaaggaaaaaatcataatattgcgttaaataaataaaagcatgtttgtgatgattatgttacccacctttttgctacaacgaatactcacctcaatttaattttatatgtggctaaatatatctagttgtgtataatattaagaagtttaagggataatgtgtaaaaactacagtaggagtaggtggggtggcagattcactgccaccaccactgtaatctttttaaaggagtatagatgacaccaaaatagatggtttcatactaactgaaatatacacaagctgaacaaacttttttcatcagctactaagatgacaaattgagacttacaaagggttatcttgaactctttcatattcatattcaaagtacctattccttgtcaagttgggtacaacttagttgaagcataatttgcctatagtgtgattcatgtgtgccatgagtgcagttttttttttcccatttaccatatgtaaatatgagaatatatccaagtcatatcatcaattaagtgtttgtcatgtttttactgtggccaatgtataagccgtactagaccaggtgttctatctctctgggagatttactgtgatcaattatatgaatgtggcaatttgccagccttttctgcagtagcagatgtgcagctttttcagtgtgcctggtagcaataatcagagtcactaactcctatggtgctagtagggggtcaaaagtactgaaagattgtattaatattgctgctagtgcttctgtgcttgccatttgcatgctgccgagtgacgacggctgttgaaagctgatattcggtgaaattttaaatgctttgccaattagtgtaaaactgttgttctctgtggtccatgtcttctacatgtccttagctgtttgcctaggtagctacagttatctgccgagtgactgagtccttgtagcacatcacaaaagagttccctgttgttgccttttatgcttgccatcacatttgaaactagttttggacacacagtttcgttgggcatacagttctgctgaggtgtttgtggggtcttctatgtaaatgtttgctgaaaccttgtaattgatcctttctttccaacttcttagggtttcaatctttggatgcatgcgtgctttagtccatcattgatgtccccaaggtgcaagggatgatatctgaagaaaatatgaggggatgtttctagaaggtactgttgctttacttacgctccaacctaaacttgtgaataacagggcttgaactgagttattttatactccctccgtttcataatgtaagactttctagcattgcttatattcatctagatgttaatgaatctagacatatgtgtgtctagattcattaacatctatatgaatgtgggcaatgctagaaagacttgtattatgaaacggaggaagtactgtatatgtacataaactgcaaaaatgagctatagcacaatgaaaccacatcttggatgtgtttccaggatgtggtttggtgtgatgtgctaattcttaaggattgttcctagtggtggtgtctggatttcctacccaagttgctgacaaccaagatgaggatatggtgatatgctgattgtcatcaccgatagagacaggttgtgcttctgtttctgcggactttaaattttggcattttccttttaaatgcccgtccatcattatcccgaataaattcctgcatttggcgccagcataaggttctgaagacacctgattgctttcaatgcaatgccacagtgacttaaatgttctgaaaatgttagaaagccaagatctgtacggcggtggtatttactattgtcatcttgagcatgtgtcacattggatatgcaataacttctgtaatggcaccaatacaatcaaaagaatatgaccaacatgctacctgtaaagaaaaatgtagtttttgcacaggcctttggtggtacaaaagtgtagtttttgcacaggcctttggtggtacaaacattttgagaaattccagagaaagggaagagtggtactgtaacttgggttgatggtttgttacttcagttattcagcggtcactgtataatttcttcacatatcattgttcaaaattatgtagccttgactgatatcgaagggataggatgtgagaccccttgtgcccattggcacaaaatgccagctatatgatcaaatgataggggcaatggtggtcacacttaaccagattttaggagcaccaagcccagctggtagtgggggcaatggtgagaggagcattacacacatatactctcaccaggcagaattgccatataagtcccagcagatgcattcaccattggaacatattctgttcatgccttgtccttttttaaagagttattgattctgcaagatatttgcaaattgaactgattctggtgtacccacaacaacctgtttctgatgttagtatcttgtagaggttgtcaatgtatttttcaagccatgaagtagtatttattcatgtattgaactgttggcgattgcatgtgatctaattggccattactgtatcatgaacacagatgcaaaaaatgataaggtcatcccttggaggtctacggaagataaacctcatctggaagtagggttaaagtgtgtttgtcataacgtgcatctgatcctctctcatactgcagcgacgagatttaaaggattatgctccctccaaaatgttcgcaatttgtcactttatccgttcaaaagcaatgctttctatatgctcaagaaccaagcttcacaaaagacatttccaatccggaggggctcctgtggggcgtggtaagttgctgtagttctgtttgaggctagacgtgcccatgtcataatcgatatgtcacatgaagactgcagctgtttgatctgaatcaggtcccaagttcagtttgtggccccaaagcagttcttatttttcacctttagctgactttacacattggtaaaaaaaattcttgtcgttacttgtgaaaaaaaataatgattgaacatctgatgctggacctaagattaattgaacatttagaatggaaaaccatgttttcgtctgcagaaatggaccaatgtaggctttgagggtgggccatggtggtctggtctgcggagatggtcctcagatttggttttggttttaggctgctgcgtaattgtgatggcccaattgctcaccagatatgaattgcaacctaacaaacatgtagaattgtgcacaggaagtgactgaaatgtgcttctttttttgtaacagttgcacagggcgtcgacagtaaaagccggccaggaggataatcagggtgcccacaacagcagcagtagtactccgtacgtctctttacctcctctaatattatctgcgcggcttctttctctgtttgcttcgctaggtgacaaactagtaggagtagatgctattgcatttctccaatcttttcttctttttttcccctctcgcttgttaatcttcttgtctgacattgctagtcgttatgcgtgcaaagctatggcctacgggctatgttggccttcaccagagtaacgcccatgtccaactccctttgctgctttacaaattaccacaaatactgcacatcacatgcttcttattggtggaagtacacgcccgcgagtcattttcccgtcagatcatcgtgctgcgtcctgtctcgcgtcccagccaggggctattctagctagccagccagcgtgtcgcctattgaacgacgataaggaatgcccccgtgtcggcatggaaccaacaagctaccccggtcacatctttccctttactcaccgtgccggaagcaaaagctggagatgataacagcagcagcagtattattagcagctactcttatctatcctactaaaatatagcaacatctccatctacttcattattttaactaattataactatttctcattcaaagcaaaattgattttatatcttaaccaatcacatctcttatttaattcacacctattcttttgttttttgaaaaaatgtagaagtacttgtattttgggatggaattttttaagtacttatattttaggacgggaagggaagagaagaataggtggctaatttgtttagaggaatggcacagaaggcttagtaggtggctaatttgtagcaacacgcacgctgtgccctgcagctgctgccgctgcttcctcctcgtctctctccgtcacatctcctagctggtggatggcaacaggcatgtgatgtgtcatgtgtgccatgcccaacttggcactctctgtcagcgttatcactattactcttcgcccaaatgcttaagcccaagctgacacgctgtaagctttagctgcatagtatagtagatgggccaaacgtctcaacctcccaaacggctatgatcaccattcaccaggcgcgtcgacgcgagaacaagcgcgcccgtgtaaatgtaggtggcacgcacggtggcgtgaacacgagggcagggcatggcagagctccatgcctgcagccgcgcgcgagagacatggcgatggtgttacgtacggggtaacaagcgacatgatccctggccggacgccctgcctgactataattggcaccaccagccacctcacgtagtatacacaaataatccgatcgatgatcatatcgctcgccagccagcagcagcagcagcattgcgcgtacgtcgaccaggttgaattgcaccgtctctccgtcgcgtccgtccaccatatacatatacacttgactccgactcgatcgatcaacaaacagtcaatcaacatggtgggcacacatatccgtagatcatgtcacatggggcgcgcgtacgtacgcgcgcgcgcgcatgcacaggcaccacagtttgggttgggtgagcctgcagcagctagcgaacccctgttggacaacgcgtacgtacgggggagcttctagtggttgccagctagtatttccgtgacgaatcctagcagtagtgtgtaccaccatagcgatatgccgcgtcccgcccgggcgcgctccgccgctgcacgcactgtccgcgcgcgcgtaccggtcagcaaagggggggaagtgtgcgtacgtacgcccgccacgcgcgcacggcttttccatcgcgcgcggccgggcgccgtgcatgcgagttccagaggctatcaatggacgcgagatggcggtggtttgcgcgcgcgcgcgcggtgtgtaattagccgcggcatgcagctgcagggtggggtgggcgcatatgcatgtgcgtagctagcggtgctcccctacagccaactgctccctgcctgctaaccatttaccatccccacacacacacaccgcatgcaaacaaccacttgcattgcatcgcattcatccatccatctctctctctttatcaccagtattcatctcctcttatctctctggggctggcagtagttgtaggagtagtggtataggagggagaggaggccatggtcgatcgatgatgatcatgacgtggtacagggggggaagagggcaggcagttaaatggggaaagtactcaggtcccccgggcgagtcattgcacatgcactttgtgtccacttgattgaattcttcttgtctcttccccaccctctcccccctcgtgtccttgagatgcgtgcatgccatcgacatatgcgtacttgcacagtgccttgtagactactctgattcgcctacattttatatatgcatgatcccggccagtacgtacacgtacatgtaggccaccttgtctagctaccattattgtttacctcaggtaaactaagctttatccatgtgcaagcattgctatatgtacccaatgcttgtacatgtatgtcgagaagcttaattataccgggaggagtagcacgcctagtctttgtattgacctcaagagtcaagattctcgcactttcatctcttccaaatctcccacatgacgaggttgattgcggaacgtacgttcttttgttaagatgcctctactgtggttgctacagtattctttgatagatatatatatttttttagaaaatgaaataaaacctagcatccgcatccaaacaggatgtacacggccaattctttgatagatgtgatgtccatttcgtgagagtgtgtcgtgattcctccaaccgcgttccacaccctgctgtgagtatttgaagtaggggaagaagcaattgcttgctcctagagtgaatcggaggagcaggaaattgtccctacaattcacgacctatattgtggatcgcaaggcgaagaattgcacttgagtggtgggacacatttgggcctgattggcttattcaaattggtagttttcaatataaagaattgtgcattggtaccaaaggtggagatgtattcaccatttcgccttgaggcatcagcttccacacaatcttgaccaaatgtatatgtagttgtgacttgtgagccacacaatttgtacatactctctctcaaaggctgtagaagtacattcaccttgaggcatcagctcacacaatcttgttcaaatgctatgtagctgtgagctacacaatttgtactctctcacaggctgtagtacatctttagtgttgagtagacactgcctcatcagtcatctagatgtgaaggatccaattccatgatctataggacattttggattatcactttctttcgagctaagatggcacaaaggcttggaaggtgtctcatcgtgggcattgtcaatccaaccatgcgagttgtcagaatttgcataattttattaggtctagcaacgcatctatcaagttataagagaagggtaaatggagccactttgtccacgttgaaggcctagaaatcatcgcggtatcggagaaagagaaataagatctatgatgttgatcgtagtgggtctagattataaccatgcagatggataagtatgatgtatatgaaattattgcatttatatatagagatcacaaaactacatatattctggtcaaaatattgcaaaaatacatatttaaggtggtgtattacaatactacagatttaacatcaaatttatcaaaaaaatagatttaagggtaagaatcgcaaaactaagtattttaggatttaaatccctacaaataatgttatgtttgaattatagcatccaagttttatgattaaattgacactagacctatattttcatgatattttttagtactaatgctttgtttggcaatgctccatattccagatccatgctaaatttgaagtttctatgttaaattacattaatttaaaatttaaaatttcttctcaaatgtgaacaaaacaattcatcagaacactattaacgtaatcgcagatccaggtcgatccatgggtttgtggagctagaaatatccagctctacaaatatcttggattcggagttgtatcaaacaagtcttaaatttgtagttgtgcgatatcctagcttaaatatgtagttccgggataaatttggtgtttaagctgtagtgttgtaatacatcatcttaaatatgtaattttgtattagtttgatcaaaatatctgttgttttgtgaaatttactcttatatatataatgtgtacaaaatcattgtatttatataaacaggagctataattgtatatcaaatacaaagatacttttagataaactttaatttatctcagtacaagattgtgctggaattttggctagttaaaaataaaatttaatgaccaaagttgtacctggagatcatgttggtatccaaaacttactgtgactagagagggaacaatttgatagaatctcaactctggtttaaagaaaaaaaaaagggtaattggtactccagctagcattccaattcatccctgagattgtattacttgagacaggtgaaacatttttgttgtgcataatttgactactgtataatttaatattaattatattggttttctttgacatggagattttgtcttagttatgagaaaatttaattaattgcgcagatatttttggaacgacagctagctatttcagcacagagagatactagctagcattacacaataagctgctgcagcttaagtgggaggcactgaaatgctacacgttagacctgatactctttagctggaggattcctcctgaacgccgcaaagaaggccacctggataaaaaagggcaatggaggtgactcagtcaagttgagcaaggaacaaattcagtatgcagctgcatatatcgggcaatcttacggccagggaagcaaatgcaaagtccaccccaaaactgttgaggatgctttgggcgtttgcagcagaactgtagaaggaacagatactactactacaactactgaaaagctttgctccagaatgcaagagaatgaaaaaggtacaacgaagttagatggggagcaacaaggtgaaaggttggtggattgtacttgtaaggacgggaaaatcaatcagctacctcaactgtaccattgccatcttcagattaaaatggcagagaatttcttcttaagaaaaatagtactagtaaccaaattcctgcaggcttgcaggtaaggacgacagggcaaagagtaaataagagtacatgcatgcatttttctgcacagatcaggggcacagggtcgcaggatgcgcatggtgtttaattagaacaaataaatcagctctagctagatcgcaaaatcctgtactggccatcagaattcagaactaaggatcaatgctagctgccactctgaaaagagggggaggaaaagttattctcctcatttctttcacagggaccaccatcagctgctgtgctcgagtagcagtgaacaatggagcgagagacaaagctataggcagcagcgaggagtgagctagcactgatactactgggcgtatatgatcagctcgccattgtcatcgagcatttgagctgagctgaagctgaagctgaacttaattctctcctctctcagtgctgttttggtattgaatgtaggatcaaccgatcgatgcatcaattaagctcgcacaggcgcagggccctgacgaacggacgaactaacgagtaacgatgcttatcctagcctcgctcctgtcattctgtgcgtgaactcaatgcagtacacttcaccagtacagccatcatttctgggtgcccctggctgctgtgcatatcatgtaaatgcttgcctagattagcccccctcactgacgtccatccaacgtcgacagcttagcccatgcacgtatgtagtagcccgtcctacacctagcagtagtcacccccacaagcaatcaaaagtaaaagtgaaaacaacagttcacacaaattatactcgatcgtaatagtagcactactcgccatgtcccgacctcagattgatctttccgtccgtccattcgtccatccattctaatccggcaatcgcatcaagttcgccggatggtggtggtgcagttaaatcaggcgtactagtggtggtgaatgttggcgatagaggtaaggtttaactccactggagcgggatagtagctagccgctggacccgttggttccgacagtggcgaaaaatatgccattccgcggggggcgaagagataggggaattttcagacagccgcatatatcccccgcttgggctggcgagaggcgatcgatcgatcgatcgggcgagatatattccgttccaccccccggcagacacgctctcgtctccctcccccacgcacccactcgtgcgcgcgcgcgcgtgtatatatatatataggcagaggaggccacaccctccagggcaacccaaatcaccaacaccactacactacacacaccactgcgacctgacctgaacctgatcacacacacacactctctctctttctctgtgctcagtgctcacctctctggaaggagaccaaaaggccaaagagaaacacgagcaccaaccaacacagctgagccagagcccagagcgctagagccagcgggagatagccagtcaaatgtacttgtagcgctctctcgcacagcccggcgaccaatctccagaggacagcgagcgagctgcttccttcaagctttgtttcttctcctccaaacagcgcgcgctttttgtgtactccccgagagttgacagccgtcgtcgtcgtcaccatgtgcaactccggcaccagctcctcgccgtcggcgcctgcgccgccgccgccgccgctcacctcgttcaagcactcctcccacctcctccgcctcgtggacgatgacgccgacgacggccatgcgctgctgctctccaaggtaaaacacgcggtacatatgctgtagtaatacttacccgcggcttggtaattttgatggcgtgaacagaacatgtaggccattatatcaaagagctaatgcaagaagcacgcatagcgacatagctggctggctggctggttgtttaatgcttatttactagtagctaggcatcactggcagtaacagtaacgagaaagaaaaggaaagctccagctgttgggaaatggcagagctgatcaatacgtccatgcacacgaacagctgatcgagacgacgacgacgttgctttgcttgttggtttctaacatgcgtgagtgcgtgtctcccaggtggccggcgaggcgcaggcgatcgggcgggtgtcggtgccgatggcggtgacggggctcgtcatgtactcgcgggcgctcatctcgatgctgttccttggccggctcggcgagctggccctcgccggagggtcgctggcgctcggcttcgccaacatcaccggctactcggtgctctccgggctggcgctcgggatggagcccatctgcggccaggcgttcggcgcgcgccgcgggaagctgctggcgctggcgctccaccgcaccgtgctgctgctgctcgccgtcgcgctgcccatctccctcctgtgggtgacgtccacggggtacatactgaagcagctcggccaggacgagggcgtggcggacgcggcgcagacgttcgcggcgtacgcgtcggccgacctggcggtgctcgccgtgctgcacccgctccgcgtctacctccggtcgcagaacctgacgctgcccatcaccgcctgctcgctcttctccgtgctgctgcacgggcccatcaactacctcctcgtcgtgcgcctccgcatgggcgtcgccggcgtcgcgctcgccgtcgcgctcaccgaccttaacctgctcctcgcgctcctctgcttcctcgccatctccggggcccacagggactcgtgggtggggcccacctccgactgcctccgcgggtggccggcgctgctccgcctcgccgtgccgaccgccaccgcggtgtgcctcgagtggtggtggtacgagctcatgatcgtgctgtcgggcctcctggccaacccgcgcgccaccgtggcgtccatgggcatcctcatccaggccacgtcgctcgtctacgtgttcccgtcctccctcggccagggcgcgtccacgcgcgtcagccaccagctcggcgcgggcaggcccgcgggggcgcgccgcgcggccggcgccgccctctccatcggcctcgtcgtcggcgcggcggccgccaccttcatggtgtcggtccgcagccactggggccgcatgttcacgtcggacggcgagatcctccgcctcacggccgtggcgctccccatcgcggggctctgcgagctcggcaactgcccgcagacggccgggtgcggcgtcctccgcggcagcgcccgcccggccagcggcgcgcgcatcaacctcgcctccttctacctggtcggcatgccggtcggcgtggcgctggcattcggcgcccgcctaggcttcgccgggctgtggctgggcctccttgccgcgcaggctgcctgcgcggtgtggatggcgcgcgccgtggccgccaccgactgggacgtcgaggtggcgcgtgccaaggagctgaccaaggcgtccactacaggcagcggcaccaaccaccagcacgagtgcaacaacagcaacaccaacaccgccaacgcaaaggctaacaccaaaacgacaacgtctcccgccgccaataacatcaatgccggtggcggcggcagcagcgacaaccgcggttacgtgcccatcagcgagagcggccacaacgacggcagcgacgacctggagaagctggaggaagggctcatggtggccacgagtggcggctgctgcggctgcggcgacgcgttaggcgtcgacacgaaggctggggacaagcagcagtgcagcaacggtggtgccggtacggcggagggaaatgcggggcagaggaggggctcggcgtcgtcggagagggccccgctgatcagtgtgggggacgacgaggaggccggggaggagaacgacggcgacggcggtggaggtggccacgtctagctagctgctaatcaaccagcgtggtcgatccatccatcgattaattctggagaggttttgatcgtacgtacgtaggctatgtttgacactgatcggccggtctccatttcatctttctctccatcttgatttgggggtgaggtttagttttgtctgtataaccaagctgagcagctaattaatgagagtattcaggaaaaaaaaagagggagaaaaaaacatatatattcttcccttatttttcttaattaattatacttctatgtacaaatactaattagtttgggtgtaaattataattaaatcaattgatggtgattaattaagaattgacaagtgcatgcatgttgctgtttggcatgatgtggcagtactgtttgttgtgttgagagtgggggtgtgtgtggctttgggacctgtatatatcgctgttcccctagtggttacatacgtgacaaccaatggtggtgccccatttcggccatttcccaactgttccaacatcgctaagagaaaaaactcgcattggccctcctttaagttttctccgagatggctagcacagctacctagctagctacctttcttccttttgataaagtcgcaaccatttgatatctacaagcacttgggcgaaaaaaaggcacccttggtgttttgcgatttttaaatattactactgcatatgcacctttttatttatttctggctcctcgtgcaaaggaaagatggtgcgtgtgactcagtttctcatgtcttctatattgagataaaccttttgatcaaaaggctcttgccacaaatattaatttgccattgctcaccacacaagaagtgctctctcgagggtaaaaggatcacactagctagcatgaatttatactttctgtgcagatgtagaaatgtggaatataacccttatgtgggaagaaaggatctatatcataaccaaaatttgatgatgcttgccttagtgtccgtagcttataagatgagagagagagagagagagagagagagagagagagagagagagagagagagagagagagagagagagagagaaacctagagtgctagaaattcttgaacttaaacaaatcgtatggcaagctcttaatttggtgagccccggattgcgactagcatgcaactgttggggacatctaaatgtgttccagccctgctctatcataaaacaattattgttaaggtgtttattcctcggcccgctctttctatgagtggttcaaaaacatacttttgttcacaaatagatgtcatttgaggaatatttttccctagatatataggccctcttataagttgtcgagactcgagacttgtaatagaactagtgggcgtgtggggctattaattgcagttaacaatattagtttgaaagtggtaaatttgtcaaaataatatgatttgattgacgaccgcttcatatgcccgaaactaatatgacgttcaagaagaacggtgcgaatattagatcgcatttttcttaagactataagcgtacgtggtccaacatatcttttatcctttagtgttttcttatctatatttaactagttgatacccacactttgctatgagatatgtggataaatgcatgttatacattatagaaataatagatatatatatttaaagaatgtaaaaaataatgtgaagataatgatttgacattatttgcatattgagttataaaaatatagcaaaatcgtgaatgatatgtcatgtttgcatcatatttaaaactctagataataattgctagtggtgataatgtgatacacttgcatgttgagttttagaagttagtggacatatatatgtctaggttcgtatataaaagttgatttttttttcaataacaaagggaatggccacataggagcgttaaggaaactattcactaattttgtactcatatactagtataagacccttgctggactaaaaatcacacatagcagtaaagtttgccgtccaaggatacctgcaaaagcaccatttgcacattcatctccctcatttgcacctgctgaccagaattccctttttcaaaaaaagaaaagaaaacaaaagtcccctgatgagactcctgcctacagtttttatccgagaagacttggggtgtttagatacaggggtggtttagcgtgtcacgtcggatattatatatgtgtcgcatggggtgttcgggtaataaaaaaactaattatataatccattaataaattgcgagatgaatttattaagcctaattaatctatcattagtaaatatttaatgtagcaccacattgcgaaatcatggagcaattagatttaaaagatttgtctcgtaaattagttgtaatatgtgtaattagttatctttttagcttatatttaatactttatacaggtgttcagacgttcgatgtgacatggtgtaaactttttaggagggatctaaataggccttaaaacaaaaaaaaaaacaattggaatactaccgtgtttgagagtaccatggatttcagtagcagcagcagtcaatccacggacaggccaggaggcaggcaggagtgcagggcagagaagcagagtctgcagagagaaaatagattactcctacttgacaaggcgttgccaaaagacgaatcagaggctgcccaatcgccacgccgatcagatcagttgcgacgagacgcttcgggcacggcatggagagacagccgatcacaagcgcgaccaccatgcatgtcaattttgtcatgcatatgcttgcgccgatccattagaccatttacagtccgttctcctcattcgaggtgcatcagagtatcacgtagactaaggttatgggtctaaaatcttaattcttcacagtgcaaatggctttagttctaatatttttgtttcagttctaatatttttcataatttgtgtggatgtccaaaatttacactgaacaccctagaatctagaaaaaaaaataaacccctcctcacccctctctctcctcctctctccctactatggcagtttggcatcctccttcggctaccccgccgccggtgcccctctccccctcccctcctctctccaccgacgtcgacgccggtccgagcgtggttggcaaggggcaagcagccggcgagctccaagctacgtggtcggcgagctccgaccgacagagcgggctccgggtggcgtgctcggcgaggggcaagcggccggtgaccctgtctcctcccatagccggcgcccctctccccctcccctcctctctccgctgacgtcgacgccggtccgggcatggtcggcgagggacaggtggctggcgagctccaactgacacgacaagctttgggtggtgtggtcggcgaggggcaggcggccggcgaccctgtctcttcccacggccggcgctcatcatcttctcccctggtcggcaccctctgagctcggcggcgcggatcgaacgcctcgtcaatggctaagaaatcggcaccggatctagcggctcaccaacggtgtggttgagtggcctcagcggcgagcgggcggcggtaggcaggccctggtagcctcctcttctcccccggtgcttgttctcgcttccgacgccatcttgtgttgctgctctcgttctcctttccgctgctcttgcacgagagaaaggagagcgcgggaggggaaaaggagcgcggccgcttgtcgaagccacgagcggcgaggccctgacctccacaacacggagctgcgcccctctcccgcgccgcgcgcccttggtcaggccgaagaacgggtgaccagttttggctccgcgttcttcacgggacaacgctggtagatgatgtggcggcaaatattctgttcctcacgctcgggccgaacgacacgtccgcgcattgtgaatggccttatgtcacagagttgcaccagctgattgtgaaaattcggttatttttacaattaaatttagcttgtgtcaccattgaaaaacattttcgattatatgtacaaacaatcgataagaaatcatgctcataaaaaatcatgggtaaatatttaggaccatctgtgaaaattgttttaaaaggatcatctattaaaatagagttattttatagggatctctttagaaatcgtctatagaagtcactattctcacacaaacccctaagggaacatatattttcacaaatggttccttataatggatggctatgaaaattgtttgactacattaaaatatgatgggccgaataagcgggtaagtcctccctcccttcccgcaattccctcctagccttcatgcttatcgtcctcctttctaccatccgggagtggcggatcgacgataactgtggggctcgggagcgcatatcgatggtggcagggccaagaagagtggattcgacatcgatagatctaagtagcagtggatcgatggcagcgagtcttggggctgccaaatttagcggcgtcggcctcgggaccactagatatagcggtggtgatcctcaatatggcttcatttcagttacagcaatgatgaccgcaacagggtctaagactcgacaataacatcatgatgatgaccgtagtaaggacgtcgtctcggctgttgctaccacttttgcaaagggattatgaagagggacttgggaaatttgatcatgacctatgtagaactgcgattcgatgtagttttcatatttttttttacaaatatatttgcaagtaaagactactgtctatgaggcaggtaatttatcagaggcgagcgagtcacccaaccgcccacctgtacaaaccaaaattagtcacctgtatacaatggtagactggtagtgctttcgtaatagtgtgctaatcaaacaggaatacgatgaaacttgtgtactagaattgtcagataaagcaccctgatcttcttagatttctttggttatctttcgctttgcatggtagtattatcaaacccaacccactagataggtggcgaactggccaagtttatttatgtcaccactcaccgagcatggcccaaaggcaatatgggtccacaagacaagtcctaacacatatattcatctgcatattgtagagaaaaaaaataaatgtgcactttgcacatcactatatatcttttccttcttttattttttcgtaagtagatagcctaagttgactaaagtgttatttaatagtatcttgccgataggacatatgacttggtgtcttgcagattggactagtgtctaatgcatttataggatcatgtcatggtgtcaacgctttagtgatactatgttcattatttatgttttccgaccatagtgaaaaattaaaggtccacattattctaaaaaaattgctggggaatacgagtcatcaaattaactgtttgctttatatatcatacaggaaggaggaagacaaatgggtgtttgtaacaatatactcactcgggtcacagtctcacagataagtgaatactacgtaattaatttgacgctttcacacaaacacgacattgacacgaccgatctaggcctcctttgaaacacatgaagtaatgtcaatgtcctgtcattaacgcatcaataggtcagatattatggcttattaaaccctacaggaagtgaatcctcatgaatttgtaaaaaaaagtgttattcagtagcactacagaaaaaacatatgaattttgagatacaataagagaaaacatgaaatcttgtctctggctaactttcctctaaaatttatatgaaatgagctattctataggaattccaaaggatttttttgaaggtcatttatttcaatccttcatgattcctccatttttttcctttgttccaaagaagcctttatttcttatattctccttcttacataacctagcaaaattttagtatcataaaaaatatttctgagactaatttacttaaaccattttaacattttctttacaatgaaaatgttacacatagctagacgttggcaacaaggatacgaccacaaagttctgttttaaagaaatagagaaaatacgcaaaatgaggtgagctattagtatatgattaattaagtattaattattttaaacttcagaaatagattaatatgattttctaaaacaaatttcatattttttttaaaaaaaacacatcgtttagtagttcgggaagcgtgcgtgcggaaaacgaaagaaacaaactcactttcatctccaaacgaccaccggtgaagaagtgatttttactcccggttcgtaatcccccagtagtcctggtttgaggaaggggagaggaggtggaggagaggggaggggatgaggaaggggaggaggtagaggggatggttcggggatgaggaag

SEQ ID NO: 81108 - DNA, 713 bp, Oryza sativa
cccgcttggcagcgtagccggcgctctcttcgcgcagcgtggcgagtgtcctctcgatgtcgagggcctcccaccctgcaccgccgccgacctaccgtgcgatccctcgacggcgccgagggcggcgttcctaggccgggaggtcatctcgatgggatcgatgcgcctaggcgcctagctgagagactacgggaggaaaagggcattctctaccgttggataatgccccttatatagggaggcggcggcgcgaggagagccaagcctaagtggggaggcgcgccggcgccaccgtggcagcgcggaaaccctagcggctagcggctcaggttaatggggcggcgcaagcgccacagctgtggctgtgtggcaaactggcaaccctaacaagcagctgatttggaaagaaacaccgaaacaggaagccattcaaaagcgtacaggataacccaggctggcgaggcgcgggaagaaggataaggcgcgcgaggaagagggaatatagacgttggcgacgggaaactgtttaaacacgggtgtacgttcacccgtttcttgcatgtcaattaaatggttagaaaaaattttaaaaaatttgacatgataggttaatatgtaatatatcacttcacaaacatgcaagttcaaattcaactgctacaagttgtaacaaaaataacaaatttgattgcgaatatacgggctgcaggaat

SEQ ID NO: 81109 - DNA, 840 bp, Oryza sativa
tcttaaagtggggcgtgaaccaaaaatttggggaaataagctgctattagaactaaatcgattaaatccacacaagtgatatgatggatttgggtgtcttattaaatactgagatacgtatttgattgcacacagcaaagaacaaaatcgttcttggaacaacagatcaaaactaccagtaaaaacaaatcaccctagatggatcatggatctcccttccgctccacgcgagatcaggggaggggcctccgcctatcgagaaccgccgctgcggcgggaggggactgccacaagcgagattgggccgaaaatccccaaatcccagcgaggccgcaacaactaaccgaagaaaatatatttaaaaaaaaaatgaaaccgcgtacctgggcggagcacgatctggaggcgacggcgggtcgcggtctcgcggaggatggatggatggtggcggtcgagatcgcctcaagctcgttgcatctctctctcgctggttcgtctgttttttttttcccgtctttttctccttttttcggttcgaaattatctacgcccctgtccccctcgatttgttgtcgcctgcttccaatccaaattccgattgcgaattcgcctccctctgccgcgtgagcaggacgggcgtgagcccgtgaggcaatcggtgggctctggcgtcgcaagcgagcagagatgggccgggccaacactttgggccgtcagcagtacccgtggaccgtggtcgtgacatatatgtacatcttctccaaagttcctctcaaagggaaaaaaaaaactacctatatattcctcgacaaattctcttaaaagaaactactaacagat

SEQ ID NO: 81110 - DNA, 9373 bp, Oryza sativa
tataaatgttaataaatatatatatgtatctagattcattaacatatatatcgaatgtgggcaatgctagaaagtcttataacttaaaatggaggaaatacatatacagcgacagctctagtaaggccggtgcaagaacagaaactacatattttctacaactaggtattcatgcacgtatatttatgtagtcatataaagttctgtgaagatttccaacaagacaaagtacagagccaactcaagatcaaatgatcaatcgatcgagccctagctagcttagttttcgtgtgaccaaggtggcatgctggcattgtaccagcagtacagcgtacgttctggtagaagcgagtggcgtttggtgctgacccaacccaaagcacgagaaagccccccatcgtagttaattcgcactgcttaaaaagttcagtaaatttaaccaccactaccaggactaactttattgcgctgctgtcctagctaaacctgcccctcatccctgggatacttcaggtttcagtgaaataacccaagttagagctacccatgcattcataggatttgagtacttagtagttagtagctagtgtggcagtggagatccaattaatctaccacaattcgagcacatgtaatgtactacccgcaaggcagagctagctagctactcttctcctctcaccgaaccggatgcatttgccccgttgagtgcttggcaagggagtgatcactaaccactggccagacagtgccttctagttgcacgggaacaggattagcaaggggattaactcctagatgcaggttttgggcaagtccccaacaactcaaagcagtatgtgtaattgtgtatgcatgatataatgcagcttgttgaagcaaaggatgcggtgtagaacactgtacctcttgtggactttgtttctgacagaggtgtggcaggtctgatcatcgtcatccgtttcctgtaaccaaagccgcccaactcggacttgcccccaccgtttacctgcaaaaatgtgaaacctgcagaaaatgagatttaatcatcatcatcatcaataactgtagtgtcagtataaatgctgagagtatacagatcagaatttatatataggggattattgcacggtgtatatagtttgttatgttgtgtacgggcggtgtaccttgcagtctgccaggctgacaaagagcaagcagccctgaaagaataaatgacaaagaattcataagaagatggggtgcctcttcctttgaaacattaatcaatacatttaaacctaagtcatcaacaaataataataactagcatgatggcccgcgcagattgcgcggctagcatcattatattttctctcatataatagcatatatgttttctcattatattattcaaatatattaaaatgacaacataattttaaattttgcaataactttacaaaactactaatgtgtaatattcatattgcattttatatacgtgttagttattaattatttttaagataaaattttagttatttgtaaattatatatattcatatatggactctagactcgtcttttaatatttcttttttctgtaaattgtatttctatatagactatatgttcttcttctaatattatttatttttatttctgaaattttattatttctaattgtatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatggactctatactctacttctaatattccttatttttaattccgaatttcagttatttcctaattgtatttctacatggactctatactctacttctaatattccttatttttaattccgaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcctttttctattcctttaattatataatagataataataatttagatctccatcctattcttgaagtgtggcagtagatgatgaggttgttgattataactagtaattatcatacctgtcacataattgtgaaggtttgagctagagggacccttaagattttcttccttgaatcgctagtcctagcatttgtactgacaatgtatatatgatcagtgtggtgtactagcgtttatagtgctcacctgtcaacggtttttactggacgacaggtcctgacagtccttggcaaccaccacaaacctgcctgcacttttccatgtaaaaaaaggagtgcgtgcatgtgtacgacgagcagcagcagaagaagcttccatccctgcaggaactcactgacacacgtatctgtgtggagccgatggaactgtaaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgtacttttgtggctttgctttttctttcagactacttgctggattttcatcaaaagaagatgaggaatatgatgaaggtgatatttgtgaataagacatgtttcctaaatggttttaaaagaaaaaaagacatgctttataggataatactcctacaatcatatctatgaactgttcatcttatccaaagatagtagtactccaagattggaaaattatggatgattgtcatattaaagacaaacaagcaggagaaatatttttcttcctgcatcactccaattctccaaccacatgagtccactcaaagggttaattgatcaaatgattaatgcaatggaaagaatttggtaagatagacatggtgcaaaacatagtttactggaaaaaagccgtaatttccgttactacaattcagtaaaataaatccatactccaatgttctggttctgttctgtcttctcactttcatcaagggaaccacctagtttattaataggaaatacaccaattcctgcaggaaaaaggtgttccaaaggaggccttagcatagtaaaaactataatgttttagagcagtcgttgccaccagaaaaagattcacttgtgtccacttaggggggatttgctgatagttaaaagcaataattatgcaataaacagatggccataactcacaaggcatcaactaaattgcgacagtgcaccagactacatgcattatgtcagtgtgtttattcacacacaaatatatagcagcacaccacacagtacaagcagtggtgtttctaactgtgatgccaaccctccgaaagtaaaaatggtgacaccaatccagcacaaacaacttaaagaacttcaagataacatcatacgtggcatatcaaatgaaaaagaatgaaagcactgaaatggatggcaaagatcatggtccccatattatttccccttcctaatttcacaacatacaaataggagcaatgaagcgcgaatcagctccacagttggttctataggttggtaatgcatgaagtcaatgcgaaagggcccagtcagttagttggtcagtcataaagtacgatcatgtcaaaaaaagaagaaaagaaaattaacaatatgagaggatacactattctaaggtcttggatgttgatgaaaacaacaaaggcactacatttagtagtacacgaaatgacaaaatggcatatgattaagaccttagtgaaattcaacgatggccagaaccaaaagctatgcttacatagtgagccaacatttaagttttgatgcttaaaataaacaaattggttttcctttatcatcatgtcctttcagcagaaaagtgctcaccaatttgtgtctcaatccatcaaaacctaataaatgggtttcttgcataaaaaccatcaaactcaaatatgacaaataattctcctaatatgtgctgcagaacaaattgttaggtgtatgatgttcgcctcataatttagagatttgatactcatgctactgctcctaaattttggaaaagtaacagctcacaactagtttcgccttgataccttgtggtgccacagtagctggttaaggacctcccatgttgcaaaagcatgcattgaatatgtccagtaggatagctgtatcggtccccacaacattaactctgccctttgcttcaatctcattcgaatcaatctggtgatgtcatcttaattaagattgtaaagcatatagcaccaagttacgctgcgctcttgacactgtcatccgccagatctacctaaaatagatcaacacatggtccatgtacatgccaattaatccattaatgtcattgtcaagtggctgtggacgacagaagtgtagcaaattagcaatgagccaaaaagaaaaggaaaactggcttgtttcaacttctgactaatgagaaagacactcaagtacacaaacatgcgctgaaaacaacatatcataacttgtatcagtaataaataagcatttcaaatgagcaacattccaattccagggggctttccgttctttaaaatctagtaaagaagttaccatctggtgagcttttgtaattattcttcaaagcatgggtagattagttggttaagatatctatttagtgaagaaactacaattctactaaaaaatatgtaaaagagatacagcatgaaagaattacccactagtctatcaaaatctgggaagatgtcaatgaaatatggattcacaatgtacagaacaggtggcctgcttggcttccatgtgtaaatatactctctagactctagactttatccagtcaatcttgtagcaaaagatttaggaatcaagtctgacacaacaatttctgtaaacaactaccccttttttggcctctgtaaacaactagcagtagaccagccagtgaccctaaatgcaaagcgttggcaagtataactgctactgcatgacaaacccttgcccctctgagggcatagtaccatggcctggtggtcctagttagttgttacattttgatgtacttacgtccattcaaaatgattacatgcttggcatgtcattatcttggttcatttagcaaccaaatctgtaaaaagtctaatttttaacaatcagttacataaaagtcaaagatatgcatagtcgtcttttacaatttacactaccttattaatccccacttttatattgtggggtatatgtgcagacaaactttagtaactttgactgatatactggattgaacacatggaagtgataccggtgggtaaattgccaatgataacattatacttttgccagattttgatcgtaaagtatataatatattaatgactaagtttaaaactcaagggctgaacatcaaacagaaaaaattgtaaaaataataaaatgtataaaactatacaagtctagtttgctttcactttttcaagtcaagcattacaaaccagcaacagcaacaaaaaaaaaaaaaaagaaaggccaagtcagcttgtttccaaaaattgtttacttggatagctgcagttttgagtttcatcacttcaactcctcaaaactatgaagaccaaccatttggagacatatttagtatattgctacccaagtcattgcagagaagcgagtttctcaatataaatgaccctgtggccaagaagtagtctaaatcatttcatttgcatgttgttaaccccaatgtagttgtcagtcacccgatgcatgtgtttcagaagcatggtaattgagtaaagcgatacaatgaccagctggtcaatttaactaacagatttaactgtgtaaactcatatgaacaatcagtgactgcaaggttcaactattgacagacaagaacacaggtgtgcagcaggcactatgatgtatcacatagaccagaggcaatgctgatatgcatttcctttcagatttttattgttgaagtaatgaacaaatggcaaagtaatagaagtgcatattgtctgtcaaccacagtttaaatgtagcccaattagttctcaagtaaattcaatttatccaaataaacaattcctataaaaaaaatttaaccacccaatgatcaaatttaaccaagctacaccacatctttcgttgttttgttctgtacatatccaagaacatccaaacaacaagtttgaatgtttaacccatataattaaatttgcaaaagtgaaaataaaactatattattgcaattcagtgaagggaagtaaaggagaaatctagccagactggtggaaacaagataattattgctgttcccggcaaagactcaaatagtaatagcttagaacaggttggcaagtggcaatataa

SEQ ID NO: 81111 - DNA, 1607 bp, Oryza sativa
caggctagcttgagttgcagcatgggggcgagccagtgtgcctggggtgaacacgcaaagtacgtgagagctggcgtgtgtcgctagctgtgttagcggtgtgcgcacacctggagctctcccgttctctcttccgtgcttcgtcgatgtatgaagtatgaacgggagacgcatcggattggattgacggatgggggatatgtgcacgtgtcacgtcgttatcgatcgatcggatcgcggacgcaacgcgaaaggagaaaacggtggccgtctctaccattttgccacatgcgtgaaactaacagtagtgatgcggggaccgcaccagagttatcggccggctagcttgcgcgacgcgacgtcgcgaggatgtggtcgatgcggaaactacaggaaccgtcgcgtcgcgtgtgcgcgcttgatgcggaaagcaccggagaaaaccgtgctttgctttcttggatcgcgatacttaaccagcgtgtgctgccgcaccgtgacaactttggctacaaagcctaccggaggcaacgcgcgctctgcctaacgaacccacggatcatcatgactcatgaggtgtagccgtgtaggtgtttgtgccacgacgccgcgggttctggcgttagtcgcgcgagggatatgccaggcgcaaaaagaaatgctcggcttcacgttttttctacatttcgccccttggcgttgggagaaagatgggaaccacggcacgatgcgttgcagccttgcaggctttgcagcgcgtggtccaagttaagtgcgagttgtttcggggaggcaaagcaactgggctgtcaattgagttttggcggcgggtgaataagattttctcaaatggccaccactgccaaaggaaaaagtacaccgaaggtacctcactagtcatccggatacaaaatcgtccaataaccgcaaaactagatatatatatattccccttaactatacaaaaccgatcaaaataggtccctcggcggtttttgaccccggttttgttctacgtggcagctcagtcagcgtgggacccacatatcagtatgacactctctcttcctccccttcactcgcgccgagcaacgcgaggcgacggtggtcgcgactccggcggtgaagggcggtggctggcccggagctcggcggggcgaggcggaagaggaggagggcggcgccgtgacgacggccggcgacggctgcggcggtggcggccgttgtggccggctccacggcggccaaagatgggaccggggaggcgacagcgaggagccgagcgccgccactgcgcttcttccttctcagcggccgaacgcgtcgcctcgtcgccacgtcgggaacctggaagcggcggtgcgttggacgagtattcctcgtcaatccggaggcggagcgcgtgcaggggcagcgcggagaggcggagcaggagcggatggaggcgggacgggtgggagagcgaggcagtgagcgacccgtcgggggtgacggccaccgcgccacgaccgcctcctcccaaccgaggcggcgtcttcgccgacctccgcgccaccgcctactcctcccaaccgaggccgtcgcggcctccccctcctcctcctcct

SEQ ID NO: 81112 - DNA, 29482 bp, Oryza sativa
ggccggccccccctccccccccccccccccccaaaaaaaaaaaaaaaaaccccaatcccccttcccccgcttgtgatttgtgaagcgaaagcgaacggagcacataaacacaattatatcctcccccgcgaatattcccatcgtctccttcctcctctcccccgcatatcctccgcctccctttcccccctctcctcctcaaccctatttcaccaccacctccaccgctgccgcggcgagaattcgatcggttcttggcagccgtagtgcagttttgtgcagttttcttctctcttgttgttgaggatgaagtttgggaagagcctgagtagccagatcgtggagacgctcccggagtggcgggacaagttcttgtcgtacaaggatctcaagaagcggctcaagctgattggtgggggtgggggtggggaggagaggcaggcgaagcgggcacgcgttgcagcggatggcggcgaggaggaggccgccgccgcggcgatgacgcccgaggaggcgggcttcatgcggctcctggaggccgagctcgacaagttcaactccttcttcgtcgagaaggaggaggaatacatcatccgccagaaggtgcggcggtgatcgatcgccatttgtgcttcggttcgaatcttcttcttcttctcgagtttcttggttctgatttgggaaatcgacgctgtgtgtgtcaggagctgcaggacagggtggcgagggcggcggggagggagtcgaaggaggagctgatgcgggtgcgcaaggagatcgtcgacttccatggcgagatggtgctgctcgagaactacagcgccctcaactacaccggtgagtgtcccagtccacgcacttccccacccgccgcatcgcaacacccgtagttttcagttttcacatgtctttcactaattatattattgcaaagggttcgttagctgttgcttatgttgtttgttaactcttcttggaatgttctgtgaattggggaggtagtaataagagaggttggaaaaactggttaacatagtagtttagtatccttattagaattttttttgattggggaggtagtaagagaggtagaaaaaaattggttaatatagtagtttattagtgttctcagaaaggtaatttagcacgcatcatagagcaggcaggagtaatggaagtttcctgaacataggtcaagaaataggcgacttattgtggttgtgggcagctatggtttcgcatgtccgctacgcagcactcgtgtcgctgtcaaggagaatggatccttgtatggcaattcagtgcgcacacgtttttgctctctattgatgaatggatacttgaggttgggctcagcagctaatgttgggggcactgtatataaacagtttgttttctcgtgcgagacaagcaatttatagtatggccacatgagtgctaacattgtttatggtggagcactctgttcctttctgctgcaatttgaaatggtaacagtgtgtcatgcatccttctatcgtgaacagattttcctttgactcgctataagaaggtactccctccatcccaagatataagtatttctagctatgaatttggacaactgtgtccagattcatagccaaaagttgctatattttgggtcggaggtagtatataacaattgtaaacaaataggtcaaaaaatttatccttttcaacaggctgtaatacagttcgtcaccaaccaaatggtgcatagaagtttctacaagaaatatttgactaataattgacttggtatcagatattatcttggcaatatttttcactaaaaatacagtctgattcagggttcacatgatgatgcagtagtgtgtagtatagtatagtgaccttgccctctactgcagtgttccatggtagtctggtagattatctgcttccttacctgtccactggcagcatatgcagtgcatatgcaaagtaatgatgtacaactgtactgctttgctatttttcggttggcctttgttatgccttaatgctgagtggttgattttcctctttatcaatgtgagattgtgagtggcttctaatatctggaaattttcattcctagcctgggggttacaggttaatcatacaactcaattaaatctaggtcggtttctgttggcagttgggacgaaaattactcacttgaatatgatgttagagcatcatttctatcataagctccatagttgttttagaaatattgatttagtaagcagggcagcgtatgcctcccctcaccaaatccaaaattaaattcactatgcatcatttcaaagattgcctgaaattccgtagatgcattaataatactatatgcacaatttgcaaaaagttgggtgtacagtcatctgcagttagataaataaattaacttgttctaaattcccaggaagcattcacgcctgaaatactgtagtagacaagtttgcaggctaatttttgcaatatgttataaactatttcaaagacatttatagtttttatttttagtacggcgcaaaatacatatttggtaaacgggggcacatgcttcattgccaaatatttttcatcagttgacgagtcttctgattaaaagtcatgcctaacgaaacaagaaagtgcaattcatgttacgtttgtgatttgcgttccagctattgaaaataaaagaaattagttttgcatatcatctaaagatatggtattgctcaacagaaatttgtgtagctaatttcatgatcttcattagttgactcttttatgcttagctgagatgtgattgatggtcctaactttgcatgctattcgtcatcctagtgcttctttagtggactactttttaaagtcagttttttgctagctgcaatgaacttgaggctaatgagtaccttggttactgtgttattatgtgcttgtggacaatggtttcggtggacgtactgtgaaccagtgacctgtgaccactctttgtatcagcatcttgcttttttctgtttttcctttgcaagatgcaagttgatggtgtcacagacctatatggctatattgggccaggttaacacacactaatttggggagtcgacttttcgaatgtgaacacattctaaagatgaggatgtcacacaaaaagtaaatttgttgttttgcatcatgcaagcttagtatgttttgctcaaccaacagaacagaatgcaagttgcatgcttcttatatgcctgaagccctgaactggaatgtgttactgttaataaccatcattggtgctttgcaactgcacaatacatttctgctgccattttgctcatatcatgctggtctatttcgtatgcttatgcgaataagaaactatattagtgttgtacaactgtctgaaagttttctggttatcatttgcaatatgaaatgttatcctatctcaaccaaattgactagcatctcctttagtggcaatgtggtaccctttacacatcactaccatgctagctttcctgatatgaaaatttactggaccatgcctcacgagaattcaggttcattagctagggatgtgacaagttacaaatggttttggtgcctcagacagacagatgccacagcctgtaagccatacaagggcgtattttctatttccatcagtttgggcagatatcacctaaactaaaatgtttagtctgattgaaccactagcaatagctcatgtcagttatccctgtttattctcttgagggaaaactctttaagaaaagttgtgatattggaagtggattggatgctatttgaaatttggaagatgtaactcttgtactttgttttagattttcaccagttgatacttacgttccatgttgctgtttacaggattagttaagattctcaagaagtatgacaagaggactggggctctgatccgtctgcctttcatccagaaagtgctacagcagcctttcttcaccactgacctcctgtacaagcttgtgaaacagtgtgaggccatgctggaccagcttctaccatcaaacgaactgtctgtatcgagtgaagatgggagaggcgatagcactaacgaggacaagccttcgaatcccagttcatccttggttaatggtggcactattccagagttagatgagatcgagtacatggaaagcatgtatatgaagggcacggtcgcggcgcttaggtctctgaaggagatccgaagcggaagctctactgttagtgcattctcattaccacctctccagggcgacagttcgccagaggagcagcaggaactgtggaataagattccggtgattgagcaggccgccaaatgacacgaccggcatttcactacatggttatgtacactgcatgaccttgatcttgacatttgctggagatagtaccggggatctcattcccctgtcatatattcagtaatttgtatgattccaggattcctaacagttgtaaaatggtggacatgttcagtatacattgtaaaatcatagaaacccatcataaccatcagacagaactgagatgttttgattcactattgtgagttaaatcctgtactttttgctgatctacatcctctttcatgaactctcggtacagaattagttaatgttgcagtataacaattctgattttgacaatctcgattcggagatgattttgttaaagttgtgcaacgtcttgttatgagttagcatcatgtgtagcacacttccactgaacttgtttgttgcctggaaattgagttgattgcgcagtttttactggaatgggaaaaaagttttactggaggggaaaataagatgtctgtaaaatttattcagagacggcaagtattgctgtttaggtgatcaaataagatatttgtatccttttgcacaatcaaattgactatcatatagtgaatctgtttgtgatcatgtttatattatctttgatgaccatgcttatttgatctcaagagccttgtagtttactataatcatgttccaggctcaacaacgtgggcctaactaggctcaactttgatttgcacttgtttaacaaaattgaggaatgttctatacctgtttttagtggttgagactgagacgtaaatgaaaacttcaaccaaagttgagaatttggagagacgcaaaatggaccttttcctaattttgtaaacttgtagggactaaaataaattaagcccacagtttagcccattttcacaattttgtgaacctgggggcccaaacgagattaagcccacatacatttcggctcactttcttgagggcccaaatgaaatttagctacactatgcagtctggcccattttctttcgccacaagtcagagcagagcagttgcggagtgggaaaccccaaaacccccacgtcctcctcctccgccgccgccgccgccaccgtcgccgtcgacgagccatgccgccgcggaagcgcccgccgccgccggccaaggcgccggaagccccaccggaaaccaagcccaagatctctccgcccgctaaacccatcgccgcggcgccgccgccgccgaaggcggtcctctcggacaccgtcctcgccgccttgtcgcagcacgagcgccccatctacaagctcgtgttcgccggcggggacaagggcatgtcgcagacggagatccggatcaagaccgggatgccgacgagcaccctcaccaagcacctccgcggcctcacctccaagggcgtcctcaaggtggtcaacagcgtccacaagcgcgccgagaagatctacatggacgtccgcatcgacccgtcgccggagatcaccgggggaacctggtaccgcaacggccagctcgactccgacgccgtcgcctccgcgcggcgcaggtgcctcgaccagatcgacaagctcggcgtcgccacggcggagtccatccacgagggcatcagcagggaatgctccaacctagcctactcgaccgagcaggtcagggacatcctgcgcaccatggcgctcgacagggaggtcgaggaggtgaggagcaccggggcgggggagttcggcgacctcagggcagggagggtgtgctaccggaggggcggcccggtgcagggcggcatgatggagaggatcccgtgtggagtttgccccaggatcgatgagtgctcgccggatggcgttatctcgccgagcacctgcgtctactacaagaagtggctgcagatggacttctaggtggtgagctctcttccgcgccgctgtttatggtgcgatcgcacgcacaattcagcttccaattgctcaattggcatttgatctatgctatggaattgccacagttcatacattgcggcatgtgatcccggataggcccatgagatagacatactagatgatatcatctgattatcttatgtttgtatttaaattagtaagatttgtttctataatcattattacttagccttttcccctgttagtctttctcatgtatttatctgcaacaagtttagaaacctgtccaacatcaatattccaaattctagggtgcgtgagagtttcatccattgttactcaatcataatatgggacctgagcacaataaagcaattgcttctttacaagcatgatctaaagcattctgctattaacaaaaagaatgatcaacatcggtgaattgaggcttagtttgtcgcgatgtaaagtttcgccattatatgaaatctgaaaaccctgatggctttaatgaatagtaacctgcacatgcaaatcttattgtatctgtgtttcccaacgtggtttggactaagcattaaataatgttaatctgtcacaactcacaggtttgttgtacatacatttgtaagtgtgttgtcccagtagttatactggttgtgaacatatagatattgtttctctgaaaccatagtgcattctccagtcctgtttgtccaccacatttaccacacagactgattttggacgaacctataattgtttaatcatgtggaatttgtgtacactagttcaaatgctcatatatgatctggatggatttcacggtgtagaatagtttactaatagcgccaatttggttacctgtgactataagaagtggtctggatgtggatggatttcacagtgagccagtggggtctattgatttgtgcaaaagacggaaccagatgttctgtgtacgcatgaacaaatcagatacttgaaaaatgacagtgctcagtatcacatttctacatcactatgtctctaactaactgctgcttaacattgtgatacattatacattgtatagccacacctatgtacaaaacagaatgaaacaaagaaaatgtttttttatgttagagcataaggaccacaaaaaccatgaatgattgcagagctctttcgtgagcttgtatgcaaattggaagaagctcatgagagatcatgaccttcatggaatggtctacacctagtgaatcttgatctttgatccaaggttcaaaccaacccaaatatctacaccaacaaattgttcagttagctccttactttttctagtacctacccaaagcagcatcttgcattacaatagaatgtgctatttatgattaggaatttagaatttatgtctattctttgtatatctcatctgtcatctctgatattctaaattttgacctttgattgatcccaaaccactaagtttgtagtgatgctatagtaatttaggtttgaatgttgagagaggctatataatactgttactaaggcatgatgtgccttctttatttttttttgtttctcacaatgtcatcaaaacaattctaaaagtcttctcaattcttttagtcaacttgagggaggacggtggcgtgctggagataatgtatgacaactattttatcaagttgttgatataaatatttgtccaattgtccatttccttctttttgtctgtgcgtgtgtgttgtgtatgatacaaaccacacaaaggatttcatatattaccgtgaacacttctaaaattatttctgtggaagtcaaggtggcactttttctttattaccttcagtttagcccaataagcttacaagatattccaatgatgtattttgcagctttaatcttctgtgtagcaagctgatcaactaacatgtattcagagaaatgggacaagctgctgataggctaattcatgaaaataattgttttgtccaagaacatgggagttgacatattcttcttttatggtttgtactgtcatttggcttacatgttagttgtgtcatcatcttcatcactcatcagtctcaaatcaccttaagatgtgtgcactgcatctgaaggtgatgcactcttatgacttataagttgtgagtctttcatagaactatccacaattccatattattcatattgatgcactgttggcgaatcctagattttgcttccaacttggaggttgagttccatgcttgcttctgtccatactaggtgactgaatcttatgttactgcaaataaaatctcgaggtaatttgcattttatctggtaaatatacaaccgggtgtccttcataaaggatttttctgacaatgcttaacttgtgttgcatcctggagcatcatttgcagccatttctgaaggtgagtaagtgacttccattggaattcaatcaaaatttgaaaagcgacatctgatgaagatctcagacgcctttaaagtgacaaggtatcttcttggaacctgtcaaaagtggattatcctaacaacatgttaacaccagagacttggtcttgcagctccacgttgggcgttttcttgtacgcttctatggttgtgctgggccaagcgcaaggaagagcaacagtctgagtcaggtcatgtctcatgcctcctgctgctgctgcattgtcaaaccgggagaaagtgatggccatctctgaaacaaggtactcgctcagctgttgctgattaattttcttgggaagacgtgttaagttgtgttctttacccagcttacctgctaatcttttttgtgctctttaccagcttacctgctaatctttagcaatgagcgcgatctgcacctggcggctgtgtttaatttgcctttgcattgcatacatattgaagcagctccgaagctacggaaaaagtgcggttgctttaggttaatcttcgctcaccagtgacgttttttattccgatttaacccgtgttgtgtagtatttgttagtgcttggttatatatgtcaactttgaggtgcagttctgggtgaaaacggaaatactgtattttccatcagctgtaggcttctcatttggttctgaccacatgtgctgtgtacgcatatgaactacttgttgcaaattgcaatatggggtattgacttttgtcatcaacatcacagggataaacagtccattgaatagtacttgttggggcaaggtacaatagtcaatagaattaaaaaaaaactagttaggagaaaaaaactgggccatgaacagcgataagcggttttgtactaggtggtttcagtcgtaaaatttaataaaatataagtttgaatatgttcgttttgaccggttcaggggctgggtttgccaaatttcttgaaggttttccgaaatctgaacttctaacgtcacaaaaaaaacaataacgagccctcagctttctagtcattttgggactgctaagactgcttcgtggtccatgtatatctataaacctataacatccctttcttctcttttatcgaatctttcacataggtagggttcagtaaaccattttggttagggttactattatcccacactttagcgattattgcggtaacaatcccacactttagcgattattgcggtaactgcatggttaccgtgaaccatgcagttaccattaggtatataccgtggttttgaaaaaggttattttgaaaaatgttatcacacatgataaccatgataaccgcacggttttgtaaaccatgcatgtagatagagtgtcaccaccgctcacgtctccttgatccaatagatgctcgctagcctcaacacactgccgcgcccatggcttccctctaaatttgccacttccacccatccacctctatgtgttttattggagtttaagtcattgctttcacatgatcgctgctaggggtggatccaccacctagtgacccgggcaattacttgggctcgttaggtggacacgtgatgctaaattttcagctaccgttacactccatcaacgaatggagttaagtttcccaatttaccttttctcgcactaacattttcctaactattaaacggtttgtttttcttaaaagaatatgaaagttgctttaaaaaaatcatgttaatctattttttaaataaatagctagtacttaattaatcataacgctgatgaatcacttcgtttttcatgcgtgaggcattagttcccaacttcaacgtctgaacacagcctagtatgtttgaaacaaattgagtcaaatcatcacgtatggacaaaaagtgatatttcaaaagtttcaagcactttcttatacatgcgccaacttgttgaattcattggttagcgatgaatggtgtcgaattatttcgtatggatcaaacctcacagtaatcgctttatcataaaatctaaaataataaattgaaaaaccaacttttccattctctcttcttatagcatcaccaacagctatctaatgttctatcccctaaatctctttttaaaacctctaataagaatttaaggatttaaaatacacttctttccaacatatagcctaaacctagctccctaaaataaaataaagtgggccatcctctcttcgccggcgatctcgctcgcacaacttccatgcaccgatatcgatcgcgctcctcccgtatgcgatcggctttttgggagaatgtggctattccctagacgtggagaatgattggggattctaaattcttttcacttcaataggataattgttggatcccatttttcttatagaaaaacccattttcggggattaggttttactttaataagggaagagttggtcaatgctcagatatatctaactttgcaaacaaggccctgttttatccaacactgtctctcccggccttccacaatactccctctatcgaaaagtctaagtcatatttcatttgtcaccaagaccaatgagaaattaacttatccactgtgacaaaaccaaaaaactatatacatacatgtaatcaataagagcaaattttatagtgcagctgactgctacctccaattttagccatatcatttactcattgattaagaggcaacatgtacaacaatttacctccaacatacaaaccccaatatttcttttggttcattctcacactattttattttgttctttgagtatgtgtagacataaggaagagtatcttcagacttacttccttctaacgtatgtcactgacatatgttctctctagatagtggacccatatatcagtgacttaaagtcagaggatctcaatccctagcataaggggtggctcaccctcttcttggttctcttttccacctcatcactttgtcatatgttgtatttttaaggatagcattaagaatcttatagtacttgttctaaggattaagatgattttttgggttgcagttaacagtttaatttagtacatatagactataaatatgacaaaaggaatcataaaattaaataaaaatatgtgctagacttttggatggagcaagtagcaaatgtgggcaccctttgtctgctcctggcctcgtctcaaggctcggttgctgccaaaactcgaaaaacatacaaacaaaaaaagaaaccgcttcgtgcccgcggtctcgctaacctttttctgctgctaacacttttccacttgacggtttgacgcgcgcgcgcgatcgcgccgtatacgccgccgcgcgccggccggccagatcgtacagcgggaccgcgtccggctactatacgtgcgtgttccccaccaccaactctgtgtcgactgcatgtcgacctctctgtggctgtggttgcatgggcgcgcgaacgcgtcggcgaattggattgttcctggcgcgcagctgatgcgcacagtacggtactgtacatatgcgagtgtacgtgcgttgcaatatgtgatatctcgaggtaccaaatgttggatataggtctaacggtttggttttggctaagtactagattaatagcagaactggaagaaggacaccgcgcgtgagctccatcgcgcatgcactccaacgtacttactccatatgatttttctccgtttcgatcaccagcttccgcgcatcgtcctcgctacttttctggagcggggcctttacgctctcgtcacgccgcactcgtataccattaccacctagcagctagtacgtagtcgtacatgcatgcacccccacccgcccagtcaccagcgacgcgcagacccgaaacgttctgaaaaaatcgcaccgtcaacccacaccgcacacgcgcaacgctgcatcctgccatcctcccctcccctccgccacgacgacgacggcacacgctcgccctcctctgcactactgtgcagtatcccaattgcggccgcgcgccaatgcagcgaccagccgaccacgcgcatgcaactgtacgagcggctcgacctgatcgatcgcgtgctcctcgtcgtcatcgtcgcgcgcggaccggtcgacgagtgatgggcttccgcgtgtgtgagcagcgatcgagctgactttgcaaccgagccgatcgacaggccggccgggcggccaatggcgtacgtacgtgagacgggccagcgtgagaccgggcgaaatcgacatcaagtgtaaaataacggcaagaggggtgtggccgttttttttttctattctctctctctctatctcaaggcggttttgtaatcgctttttgggcgctacgaatggccggggagattttcatgccacgtcgacggccagccggcttctgcctctctgcttcctcgtcccgtctcgccttcctgtggcctgcaggtggggcccaggggccggagggacgtatacgtgctagctgttccattgtcaaaaatgttggttgcatgatgttggcgttgtgcgcgtgtgtggggatctggtgtggccgaccataatgtcgtctatctctgcttgtaacttgggaatagattagtagtggtaggacgaatacgtgcttttggtgtacacgctttgtgcgttgcatttagctcgctggtgattagccgccagcatgtgtggagaaagaagagcatttatatatgaagtttgaatattttgttttgctctagctagctaggtacggtggattgggtcggaattttgtggtctatgtactgaaacttaaaacggctataatcacattgtttgcatgtctagttaggagaggtaatggattaagatctatgggtctttctcataatcttacatagccccttatatgtttttagtagcaaatagataaaaatttaacacacccaattttagacacaatccttctagattgaaaagttaatcccgttactcctcctacttagagtgtgttctctctcgtacgcaaaacagaatatgcattaacgcatgattaattaagtattaactaaaaacctttaaaatagattaaatatgatttaaaaaaatgcatcgcttagcagtttggaaaacgtgtacgtggaaaacgagtgagatgaagttagagcaagtttaatagtatacccaactactagctccaaatcatctatagttaacttaactagcatggtggcccgcgcagattgcgcggctagcatcattatattttctctcaaataatagcatatatgttttctcattatattattcaaatatattaaaatgacaatataattataaattttgcaataactttacaaaaatactaatgtgtaatatttatattgtattttatatacgtgttagttattaattatttttaatatcaaattttagttatttgtaaattatatatattcttatatggactctagactcgtcttttaatatttctattttttaattccgaattttttgtaaactgtatttttatatagactctatgctcttcttccaatattatttatatttatttctgaatttttattatttctaattgtatttctatgtggactctaaactcatctttcaatattctttaattttaaattttgaattttagttacttctaaattgtattcctatattgactttaaactcttcttcccatgtttttcttaatttcgaattttagttatttataaattgtatttttatacggactctaaactctacttttaattttattatgtttattccaaattttagttagttttaaattactatatggactctatactctacttctaatatttcttattttttaattccaaatttctattttgttttcttaattgtatttctatatagactctatcctctacttctaatattctttatttttaatgacgaattttagttattttataattgtatttctacgactctatactctacttctaatattccttatttttaatttctaatttcagttatttcctaattgtatttctatatggactctagtctcctcttcaaatattccttattttttaattccgaatatcaactatttcgaaattgtatttctatatggactctagtctcctattctaatattccttatattttaattccgaatttcaactatttctaaattgtatttctatatggactctgttttttctttttctccgattaatgtgagaatttctaggccatgagagcgaacgtggaggattctttttctattcctttaataatataatagatagccaaattatataatagttacgtataaatatatatactacactattaatatcttgtcccacttgtcatacacacattgtgacttggagcatgtgctgcagctgtctataaatttgtagctcgctgctcatctctctcttctttcatctcctcgatatgtgtttatagctggcttatagtttgctactgtacctgctcataggaggattaacttaaaaacagtcttatagtatattgtttggtgtatctatatagtccaaacacgtattttcataaaaaaattataaaagtattttacaaaacttaaataacgaatgaataagtgtgacaagtcaataacattttatcgagaatagtagagatttttttcttgaaaaaaaacagtagatatttcatttaaactatgaaaagacgacggtagataaatattacacgagcagccccgtgaatgcaattcaggcacagctttgacaacatagatacgaacacattggatggaccgagtggcacgtgccacgcagtatcactcttgtcctgtcgccttcgatttctcaagttgaccaagccgctctttaaatccctaatggctaatgctgccaaggctgcctccccctcttctatctatatatctcacttgcacctcgcgacccattttagcctcttgctgtcccactcaaaatctctttcgtgtccacctcaccttgcaccacctgctccgccgccgccgccgccgtcctcgatccatccatggccgccgcgagcttcgacggcgccggcggggcgctcggcgtgcacgcggcgtcgcgcaagatcgggaaatcggcggcgcatcagcagcagcggaagccggtgatcatttacatggtgtcgcccaagatcatccacgtcgaggcccacgagttcatgtcgctggtgcagcggctcaccggcccgggggcggcggccgcgggcgacggcggcaagaaggcggcgtcgtcgtcgccgagggaggcgcgcaggggggcgccgccggtgcgcgtcaaggcgcgggccctgaaccggcccgccggcggctcggccgtgtccgtgtcggtgacggcgacgatgcggcagcagcagcagctcgcctctccgtcgtcggcggcggcggccgggccgtcgccgtcgccgtcgacggggttcctgttcaacgacctcagcccgctccgcggcgccgcgctcaagggcgaggccgccgccgccgcgccgctcgtctcccccggcgccggctggcttcagcacgtcggcgaccacttcttcagccccgtcggcgcgccgggggcgctcggctcgccgtccgccttcctcgacatcttcgggccgctgccgtcgcagcaccaataatgatacaaatctcaccggagcaacggcgacggcgacggcgacgcagtcgctgtgcatgatgcatggtcgccaattagggttttcctctcgcgaccttgcacttgcacggcgtaataatcgaaaaagaaattccgaaatgagcttaaaatcatcttggtttgcatatgtataggcttgtaaattaattagttcatcaaaattgtagataatttaggtggtttacaaaattttcccttaattgctcgcatggctctacacgcatgagccatggctgcagcaagggaagaggtcgatcgagttgtgttctattgatttgttcatctgattatacatagatgattaccttttctttaatccttttttgcgattacttgtccttaatttatttgcttgtgcaacttaatttttttgttacagcatagaccatatcatgatatgggatattatccatgtggttttttaattgttttgtgcagtacttcttgcacggcattgtaaatatatcttgatgcacttaattatgatgaattaattgtttttttaagctcgttgtagtgtcgtgcaagtagatcaattgacagtgatttgctcttgcagctggagaattaattaggcgcttgacacaaatattattgttatatatagttgtacagtacaagttgttgatgcctacctagcaatatatataagtgaattttcttttcctagctagctcgatcgatcattctgtcttggacatggaaacgacgacttctaatgattgctcgatcgaggagattaagagcagatcggtgtctgattcacagatgatcgatatctcttgatcaacattgacagagagccataaatggattagttagatacaattcaattagttgccaaaaactgacatcttaagccagttgtaattaacttattgcagttggccggatgcatagagtacggcaaatgggacccgagcgtatagttgtgtgcatttttctgataattgttgtgtgtgcattttaaagacaaaattctcaatcagtatatatacataggagtatatggaatgaagttctatactatattctgcacaatctcaaagtcaaatttcattgttttcgaagagagggagacaggccaacattaactcctcaaaatagtatattcctaccaattctctagttttggtctcgatcacctaattcggtcaagtcatgaatctttaattgacttattaaaaacctcatttatagcatgttctttttaagcaatggaagaacggactaatgcgacatgcttcgtgagctcctaaaacggtgccattttcaacaaaatattttctatatataaattttaaatctgtttttcaacttcacaatagttaattcattcgtttgtaccttcaaatagtcatcacaaaatcattcggctatttaggggaaaaaacatgcccgatttatggaaacacaatgcccatttcttatatttttatcggtgtaaaaacaatattcttaaatagtccacatttgccttttgaaaaccgtctctattatctgtctgataatggtcttcagttagtatagcattcaaccacctaccatgtgcgcatcagttaaaaaggcaaggtgaaaagttaaaacgtccgaagggcatttggtctagtggtatgattctcgcttagggtgcgagaggtcccgagttcaattctcggaatgccccttttaattttttttacgccctttctttccagagttttcacaagctcactgcatgcaattatttgatttcttttagtttcattttgatttattgttttcagttcgtatggtgttttggttggacactaattaagacaggcataaacatcctttcgtttattttccttcaatcttttgcagattaacagtatgctctccatctatcctctagggttttgggataaaagcacgcaattacgctgttaattccgatgagccatagcgtttctactctagctgaaatccagattgttgctgcattttcaccgtgcagtgaaatttctgtgaagagctcgacggagaaatacaagtgatgcaaggccagaaaaaggcccgtaagcccaatcctgatatgggccacatggtcaggcccagtttcttcacagctgaagaagtggagaaatgcacccacggagggagaattcttcatattcatcactggagcagataattttttttctagtaattttatcccccggaattgatcaattactactagttcatctatattttttttctatattacattattacacataaatttaaggttggcgaagtgtttttttcttaaagaaaaaagttttacttggatcagccaatacagcagcgagagacaacaaaatgtcagtaaatatagggataacacaaatcgacccgctgacaattcattcattctaatttaactaaataaaatttagttgaattataatagatacaataagtctgatcggtaatgctagctacactggcaccagccagccccgatccacacacacagaacagatgatttgctacagctacagaaggaccgtgcagcttgctgacacccagcacaaacgatcaatgccactcatgatcggtatgtatactcatctctagataaacaaacaatcgatctattactagttaattacatgttagtaaaaaaaaactagtaaattacagtgtagggtccctatcggagactatgattgccaaattgaaagtagtgttctctccacaccgtggatggatatgttcgaccatccaccaacaccttatgatttttatgattaatcttatgctaaggtcaccgactcaccgtcacaagattgggcaaacactttggtgtcacaatcatcttcagaataaagcgtttgcacgcaactgccgtcccagcagaaaggattaagcaactgccgcccttagcagtaaaatatcttgattctggtaaggacggcagttgctctttcaggcttctcttaaattttaaaatcaccctacctattcaataaaaataaatcctaatactacttagactaaataagtacttattaactaatttaataagctagaaacttaatttattttccgttgtaacgcacgagctctaggcttgtattgaaataaatacagttgcatatcttgtgccaacaaaaaaaaaaactgcagatcttattttgtctagagaggatctaaactgtaagatggtacactcatgcacagctaataagtataaatcaaattaggcttaattaacttttattctctctatcttataatataagacgtgcacacatttcaatattcaactttaaaaacatttgaccaataattattataatataaattaaattttatttgttaaaattaaattattggattaacatttaaatttactttaagatgattataattttgttgcaacaaaccttatatatgagaaattttaagttaaaaattagttttgaagattgtactaagtttgacaatagcttatattttgggatgaagggagtaggtcctacctactactccatttcaaataatgcaagcggttagagagagatttcttcctcttgagttaaacccgggagctgtaacgtcaaacgtgcacgcctgccactgcactaacctttgcattcataagcttgtacacatatatttcgttgctcttgcactgatatatggacgtcatctttaaattaaaccatcacgctgaagtttagaccgcatttttttaagaaaaagaatttcactggaaaaattaattaatatagcgacttctacaagatatccagtttaatccactaattacgaatacggaaaattcccagcttcgaaaccaagcttttaattgtagtttcagcattttccaacgatcaatgtacgttgctttccagttttgtgtgggtgaagctagctagtgggtaacattgaagaaagatacatgtggccacgctttcaaattcactgcgtgacggcaccggaaagctccatccccctcaacccatgttattattcagctatccactgaaaaaaaaaaatcttactccctccgtttgacaatataaatcattatagcattttctatatttatattatttgtctagattcattaacatcaatataaatgtggaaaatgttataatgacttgtattgtgaaatgaaaaaaatattagtttcgcaactttttaaagtgaagaacgacagaagaatatcacaagtgatcttaatgttttctcacttcaagtgtaaatagaaagcatcaaatacctttgtaagtaaaatttcaaatagattcttacgaaattggtgtgtttggagcatgtaaactatagcggactagcggtgttaagcctctataagcaaaaggttttttttttttattttcaaagcacactactatagtcgtagtctcgtagattctcatatatacatgcatatatgcgcgcccatccctacccgctgttgacaagtatatacgtcgtatcataagtcgttgaaagagtgattagcacgttaagtctactatttaaacctagtattcacttatttaaatatttatattttagaacagaaagagtgttaaatatagaggaaggattttctatatgagaatatgtggatatcgcatacagttctacggacaaaattactgtatggattgtaaatgagactatgacaattataaatcacgtgcatggacaattagacgactgttcttgaattttactaactccttgagcgtcccttaaccattaaaaaatgaagggaaagaataatattaaagtccgcccggttcttcgtataaactattgtgcacagaaattctacattatgaaaattgacatgcatgggctaattttttttattttgcaataaataacggaaaatgttagcgattgggcgctcgatcagcgccagaaaaatcgtgcgcccgccgcttcttgcgcctccgcgcgcacctccgtgccgtccccaccacgttccccaccacatacgccattgcaacaaatcacccacatattacgaaaacgctctattaagaaaatccgtttcattttttgttccaccaacaatgtttcagcaattatactcgtgatgtttcattatgtatagatcaaatgttgcggtgaattgaaacatcctttcgctatttgatgaaacattatttttatatatggtaaaacaacttaaaaaagacaaaaaaaaaacattgattcatacgttgcagcaaaatgtttcatgagtggtgattttgttgtgtttcaacttttaaaacgattgaaacatttttttaatctacgtagttaaacaattccgaactacttcgtgcagcgtccgatttatagacgcctctagataacaactgttttttccaaatgtcccttaaccacatataatataaaacaaataaaaaggacagttagaaatgggcgaacatttcgacatgggcccatccggcccaataaagaactaaaaaagaggacatggacatggaggagctcgcatccccagtccccgtcacgtggacgcccattggccctcccgccccccatctccaccatggcctacacgtcagcgaccgtcccatctatcactccatcccctttgggaaatcccaccacctaccattccccatcctctaccctaactcactgacatagcgggcccacttccatccgggcccacctgtcattgtaatgggtacgcactatgtaggtgagaaaggagagtcccttacccgtcgtcttcctcctcgagacgccattgctgccgaggttgcttgccattcccggccattccaatccactcccaccaccaagcgcgagctcgattatttttttaatcgattttctccgatttaatccgtagaaaattccccactcctcctcctcctccaccgccgccgccgacgccgcactcctcactccgcagaagcaacaccaacgccgcactccaacgccaaccgcctccgcgcgcggcccgtcgccatcgtcgagcaccttcacgcttcctcctcccccgcacggaacggagacccctagcgccgctataagagggagagaggtgggcgggactcatggcgcccgcggcagcgtcgctcacggcccccaacgcactcgcggcgacgtcgttgcccttcttgcacggaaggaagagcggcggcggcggcgtgtccgtgcacgccggggcgccttcgccttcgcgggcggtggcggtggtggcgcggaggttgtgggggagcgctagcagtagcaggaggatggtggtggcggcggcgacggcggcggagatggcgcccgcggcgagcggggaggaagggaagccgttcgtggaggagatgagggcggtggccatgcggctgcacaccaaggaccaggccaaggaaggggagaaggagccgcaggcgccgccggtggccaggtgggagccctccgtggacggctacctccgcttcctcgtcgacagcaagctcgtcttcgagacgctcgagaccatcgtcgaccgcgccgccgtcccctggtgtgagtgatcggaaaagctcttcctcctccgtgctctactttggaccgcttggaatttttgtggatgacgtttttttttagaaaattttgaactgaaatgatatttgattggttcatacggcgacacccatgaaagttggaaatatttctcaccttctgttctagaatagtcaaatagtataattgtttagccagaaaaaaattggatgcacagctttttgtgaaggaaaatgtcaaattgaagttggatgtgccatatggtgggagtaggagcacttgcaaaccccctgttttgagtttggtttggatgcttgagaaaatatatgtaatccaagttaaggtattaaaagactttgagcctatgattatttcatgtcatcgaggaaattgcatcagctttggataagtcagctaccgatctgaaatttaaataaaaaaaatgtatatttccccttctgttacatgatatgctcttccactgaccataagaccagtgccatgtgcaggtggatccaatttaagtaacattcagcccacattttttaaaataaaacaaaggcatttctttgtcattgagaggcatccttgcctggcatgctgctagcaaaacatttggcaggcacagaatatgtttttgggagggtcttgataaaattgtttaggtgtttcgaaagtgttaaaacgctttactggcaacatttctttaagagtatcatcaaaatatcaatgtttgcctatatgtatcaagtaagaagtacaggaagccatgtgcatgtctatttgcagttggttggcacttggcggtataatcatctaaagtagtaccttactattggttcctattctatgggcaaacttgtatcgaccttctcgagagacatcctatattcctattcatggatgccttaaatcactaaaattttcattgtggctccctctgctgtttagaggtggcatccccagcacagttattttctgtatccacactcctgtattgcttcccttaatcatgtataagtcttgtattttggcattgtattgtttcgacacttggaattagaaatccttatattacattaccacttggcatgctatgtgcagaattacctcggtaggtttgtacttgcaaacagcttatgttggcaccatggtaccccaattttacatactcttgttctgttattctgctatggtctggtatgcaaataacacaataaacgttgcctccaattttggggggtgcacatcatgcagttattctgctagttgagttatgggcagcattttctttataacaggatttcttttgaaggaaatccttgagtctttataacagaatctttctggaatccgccttgtccttaacccttgagtctttgttacaccctttcatggacctacgttgtccgtcaatttgcctccactagctctctgtgtattggatggttggatgtgagaagcctctttcttattgatgattactttgcattttgcaaggaaaacatttcactagcaaagaaaattaaataatatataatgttaacaatgataccctttatatcttctagcttgcttgctgaagttttatggtatctggattgtctgcatttatctgtattggtgaaactctagatttttctatttgttttacatttgagttttagaacaacacgtagcttcgtgtttggctagttgaccagttccacttaagtacttctccgtttcatattatagtcgttttgattttgttgtagtcgaactttttaaaatttgaccaaatttgtagaaaaaatatagcaacatattcgacacaaaacaaacatattatccaaatatattaaatgttagttttaatgaaactaatttgatgttgtagatgttgctaaatttttctataaacttcatcaaacttctttaagtttgactaggaaaaaatcaaaacgacttataatatgaaatggagggattagtaaataattgagaagcaaataatgagtacctttattctactcctacataataccgtgtgcaatttgtttgcacctgaaatcttagcaggatagagaacttttgtagttttgtttatgctgtatggaagtatggaacaatgagtcataattacttgaacgtccacataaaatctgtaatattctttttagatggaaaattgaaactactataaaacagctagaagatttcttccatcaatatttgcaagaggctgcttattgacttcctatttatctgtatgtatttcagatgctgagttcaggaatactgggttggagagatcagaacaactgaagaaggatctggaatggttcaaggaacagggtcacacaattccagaaccatctgctcccggcactacatatgcttcctatctggaagagctggctgaaaaggactcccaagcttttatctgccatttctataatgtgtattttgctcatacggctggaggccgaatgattgggaagaaggtacagtttctgtcttttttaatgatgaattttttatatcattcaaaagctcactatcttttggtaacatagttcagaatggattcctataaatgcgtagaatattagctatcgaagcaacaaaactgacactaacagaaagtttgttctttgcttcattgcgctttcctgactgtatagtgtggacacttttgatgtgagatggtttcttttcttaggaatcagattgaccggttgctttggatgcttatattggtattttgttctaacaaaattatagagtacgctagtcgagataatgaaaatactacataaggcagcgagtgctttggcacgcagtcccttttaggatcctcttgccactactgttctcaagttgtgctgctcatagacgtcaaggtttttcaacccacctgacattattacaatgcggttttgtttgggcatatgaatagcagttttccatgcttgccacctcatttggttcaacttgtttgaatttcttaaacgtttaatcatgcccttgttatcatcttaggtctctgagaatattctgaacaagaaggagctggagttctacaaatgggagggcaatctgtcccagctgctgcagaatgtccgcaacaagcttaacgaagtcgcctctgtaagtccaggagctctatttgccacgccactatctcccccaattctttgatacgagcagtttgaaatgttgctaataaccaagctttaattgttccatttgctggccttgcagagctggacccgggaggagaaggaccattgcctggatgaaacggagaagtcgttctcgtattctggagatctcctccgtcacatattcacctaagcttaattgatcacggtgtctgctatctagtcttgataaacgctgtaaatactaaagttcacgtcagtcagacagactgttactggacactgggcagaggtcatttacttactcaaccagttggccttgcctcccatcaaattgccaaattctaataatccttcggtgtgccacttgtctgttgctgtgctagcatctccttgctaattgccaaatgggtaatttaactgaaagttcttgcgttttcaggcgactgaaatgtgacaaaacaaatagcataaatgttgttgatctcctcgacgtattctccaaacaggcttatcagttatcaacatatgtaactcaaatttcgagtgcaaaataatgaagttctccctccacaccctaataaacatacaatttcacctcctcgcaagaaaaaaaaaatcagagaagtcctttttttttttttttgctagttgagagcaacttactagtatagccttggtccaaatttcatccctgaacttttatatcatcaaacatactacgtctttcaactaaaaaaatgtttgcttttttatgtgttgtttacgcgtagcgccaacaaaaagaagatgccacatagaagttgtaagttgtaacaccctccacaccatgcaagctacaaccacttgtctttttttggtttcagcccttatcagccaattacatttttatttaaatactcagattttctttattcatatataagtctaacattttatattacgcactctgaaaataaaaaaacttatataaacacccaccctcccctttcactatacctatacgtcactcctccgtctcccgtcgggcggcatcaccgcctctcccctccttagcgacgcctgcaagaagacgagctcgagctcctctctcccctcctcggtggcagggacacaaatcgaggtggcgtggtgttgatagggacaacggcaatggatctaccctatataacgacctcgacgacggatctgccgaaagcggtggttggggttgtgaaatagctggcactggtgcagattgaggcgccaatgactggcgaagcttcccggtgacgtcttcccgtgacggagtgtcttgccatcgtatatgcccttattcttccctgccattcccctcgccgtctttgctaccattgcagagtccgtcctcgagctcgcccgatctgcacgacgatgacaaccatgacctcgtttatggctataagggcgagaggcctcttcccaacgcgattactcgcctaatcctcacgcgtggctctatcgagaacacatgtgcctcctgtaggattcgtgcaccctagcagatccctccttcttgacgcgaatattctcgttgggcagggcgagaccgcacgtcagttaggagtgttgggcaatggtctaagaagtacacgaagcttaggaacaaattcatatcaatctaaatgtggttaactcgaccataattctaggaaatacatcagacatacaacaattcctaatatataacttgtatatgtagcggttgccaacgttgtgatcggaggcggtatataataataatcatagtttgagaactttctaaaatctccaaaactttagaatttgtcagccccgggcatgaaaatatttcacttgaaaatgccttttagaaaaatgtaaaattgtattcaaagttcaaacaactttagaccagaaatttcgcaatttcggatttattggtgaccgatatttttttagctttccaaaattgttaaccctgcatatagtctattataccacttttggtttcagtttgtttgtttttttcctccatttgcattagttatcccattggctacaagctaggcctgcacgcttaccgccaaaaatatcccctcgcaccaatcgtctcctcctgcatatgatgacgagacgccaccggaaagcatctccgcctaggcatctctgatctctccagggaggggattttaatctctcaagagctcgtcccctccgttcacatatcacttaaataattacaaaaatactttaaaaagtgtaagaagatatgatatattgcttttacatgtcgcgacgagagccctacctaggctctgtgcactgctggttgttcccatccggaaactgtgcgcgcggaaaacggagcaatccattagcgagtgattaattaagtattagctattttttttaaaaaaaatagattttttaagggcaacagcaatgtttatgaccgagttcggtagtaacgtggacccgcatgtcaggcggtagtagcaggatatgaacgccacattgtatgtgtaagatgattggatataacatgggccccactataaaaactcaccaatcctcagctgccgtgactccaactgcgagaaaacaatacgttgatacttattgacattgtacaaataacataacttattatttgttgctcggtagtagccatatgacctagtagtacttcatccgtttcacaaggtaagactttctagtattgcccacattcatatatatgttaatgaatttaagcatatatatttgtctagattcattaacttctaaataaatatgagtaatgctaaaaagtcttacgaagagagtagctatttactactttcacaatgtatcttacctagtagtaaggatattttaatgcctaatacccacttttcatcaacattgtggatgccctaagtaactttcgtatataaaccttttacaaaaaacactgtttagcagtttgaaaaacgtgtgtacggaatacgatggagaggggttggaaacctgggtgccgaacagacccagtcgttctcttctgccggctcaatttgtcgtcgtcgtcgtcttcctcctcgatccatatatttctctccccattcttcgattcctcggcgaccacctgtgcgcattgcgttagcttttgtgtcgtgttgctggctagctatagcttgctgctgcgccggcgagtgatggaggtggagagccggtacgtcgccgtgaggcaccacgtggaggggctcccgtcggaggacgacttcgaggtgaaggcggcgagggtgaggtggtggccggagtccggcgaggtgctggtccggaacctctacctgtccgtggacccttaccagctcaaccgcatgaagcgccgcagcgcgtcgcacctcgccgtcgacggcatcgtccccggcgaggttatatgctgttcaccctctctatcgcaggctagccttcacacacttcgtcgtcgagctcattttttctcgtgtgttcgtgaagaggatcgacgcgtacggcgccggcgaggtggtggcgtcggcgt

SEQ ID NO: 81113 - DNA, 3087 bp, Oryza sativa
ctctcgccgtcaccgtccgctgccaagcaccggggaggccggtgcgtgcgaggacgcgtgacgcgggactccgggcaccctcctccttcctcttccccggcccgagaacggagagctcgctcccgcgccgtcggcgctcgacaccgcgcccgttccggctcggtagtgcctccctcccgttccccttcctcactcgccctctccctccctagctcacgtggtagctcggctagccttccggtagttcgtagaagccgcccaagccccgccgccgcctggcatggcctcgccgccattaccgcccgctcccggaggctgccgtcgtcgccagccctccacggtgccactccaccccatccgtcgccggaaaacgggtttcccaactcccttgggtgctcccaccgccttgaatcgacctctcgtctaccgccgccgtttcccctctttgctcgccgccggcatgcgccaccgcgattcgtcgccgccggcctctctccggtgaatccgggccggtgattcgctccctcttgtccctcccatcactccggtgtccttccccctcccttgaatccccgtgtgttgccccggcgaatgtcgccgccgtccgccgtccatctcggcctcccccttcttcctccacacgccggcccgcgtggctgccacgaaggcgcctcgtcggcgccagctcggccggaccgggtcaagctgaccccggtcagccgctccctccgtcccccgctcgcgcgcgtgggcccgtcgtctcctagtcctccgtgcaccgcgccgtgcaccgctccccctcctgaaccccagcaccgcccctgcgtgcgcctccctcatcgtgaaccaggccgccgccatgcgggccccacccgggaccccgtgaggtgaacttggtccaccggaccgctccctctctcccgggcgcccctaatgggccgcctcctcgcgcccgcgccggcccatttggttcggccgagccgcaatagccttcaggccgcgccctagccgcccgaaggaagtctaaatgacatccctctttccttttcttttccaagggatttaataaatcctttttcccctattctataaatcaattccttattccaaaattctataaatcatttcccttgatcctgcacgtaagtgacagtcaataatattcttgagaatattatttctataaatttcataaatcaatttccccttgttccacaaatatcttccttcgcccagaaattccacttaaacttccaaaattcatatatctcgatccgttcgtctgattgcccccgttcaacttccagtaattccgtaaaattgagatctatggcactattaattagtctaaatagggtctttcttttggtcttttggttaggttttcgattgtttgcatatagtcgcggttaccggattttcgtcgatcgtggatttctcgaagattcgtgaagctcagtgaagaccttgagcaaggcaagtcaactttgaacatcttgcacctataatttaaatctaagtatttcttttccgcaaatattgcatgaataggatttacataagtaattcggccgcggcttaagagatagcctgccggcccccaaatcctaactgctgcaattaccctccttgaattattgaacacttaaacctcatttgtcagctgttgtgcttcgatgcatgggtcctcaggcacacgcatcggaacaccttccctcaaatttaaaatatccaacgatgggtaaaacttggggttttacaaaagacttggaaaaacccgacacctgggtcggtgcttgcgaactaaatgaatttccaaaatcgcagaccgggggatgtaccgggagtacggtttcccgctcttgcactaaggaccgtttccttggaatttcatccgaacataagacaagtgcgaccacatgggcgtaatgggacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcataagatgaacctgtgtcgactttcgaaatgccttgtcatgaaagcctcaaggtctccagatgtggccgttctgcacaggctggttgatccgggttagtaatgtcgtgtgggtaaagtgtaccccatctgcagaagttaacaaactgttcgaatagccgtgcccacggtcatgggcggatgtgaagtgattcctagcgtagttttgtttgactactgttttgtgaaattgctgttgtgaaatgggatcgatgtttggaaaatctgtggctgatgggatcagctaggctcgggtggccgtttgaaagctgttgccgggtgccaaccttgaatcaattcaaagactgatacattgcacatactcagactggacgagacgcactgtctcatccgtgtcgtttgagaagtactcatttagttgttttaaaaggagtttaaataaaatcaattgcaaaaacaacagccttcccttgaagcctgcattaaacacttaattcccatggcttgctgagtacgaaagtactcacccttgctctctctctctctctctctctatatatatatatatatatatatatatatatatatatatatatatatatatatatatatatatatatatatatggttcctccgccttgaagagaagatgaagtgaagcgaagattagggtttcgtcttggttcctaatcgttgcctgtggtgttgggtgttagttcgttggttccgctgctgctgttgttgttggtgtttcctcgtccgcgtcatcggttgtattctcgggctgtcctgagctgcaacctaagttaaagtaaataagtcctctatttaatttaagaattgcaatgattcatatttgtcaccgtgggtaccagcgctatgtcctgggactggtactgtgatcgcggtttcgtaggaagcggttcgcgccgtttttcctacgacacgctcctatcaggtgtcgttgtacggcggtgcccgattggggtgtgacaatggagg

SEQ ID NO: 81114 - DNA, 8030 bp, Oryza sativa
cccggcggcggcggcggcgccatcttgttgaaggtgttgtagatggagaaggagagctccgtgtggaggccggtggtattgttcttgctaccaccaccaccgtcggaggacgggtggagggaaggcaggtggccgtcggagaaggctcgccgcagctggagagaggacggcgcagccgccgccgacgacggcgagaggaaggagtgcaggaacggcgtcgacgagctcctcagcagcatcgtctcgtttctctcacaccgtctccgcgtcgtctctagctatagcttggcatcaaattcctcgagatctcacctcccgtgtcttcatttatagtatcacatgatggatcgagccgtgttagtttaatccgtcggcatggttgttttcagacttgctggtaaggcattaaagcgtgttcaagttggtgcatgcacgtgaatcctcatcggttttacaaggaaagaaaacccctcgagattgagatcggcaacgtttgctcggtctagaaacaaaaaaaagttcaaccatgcgtacaagttcatgtatacatatctcactgacctcgtgactctggcttgacctctcgttttcaacgacgagcatacagcccttgctagtgtgcagttgcttagcctttctttcggagaagccgctagatttttgggccacttggccgagatcttatctcgttgagtcgttggattggcttggtgaccgcgagaacctcgtgggcatggacatgcagctgaacgatcaccgtggcctccggtttagcctacctccacgtgcacggccctgactccgtggccgcaagtcaaaaggcataatatatatgagtactacacgcatagtcaaaatgccgtgtaagcagcaaatgcaccgcacaagctttggagcaaaaggattacttgacacaaatcgtcaaacaaaaacgacaccagaaagaaaatgagaaggctagctacgctgacgagagaaaagaaaaaaaaagggaaaataatgatcctactagtgcattcatcaatcgactagcgtgaaaccattcttgatgtactgcagacaagggaacggcaggtccagcgcgtgctcgaccatgttcgatttcgacagaagcttgccaagaacaaagtccctacggctaagcccaagccgtgcaccgcttgctatggccctgtcacggcaggcgacgagggtgatgttgcagagccaagggacggccgctgtgaaggctagcccgaaatgctgcttgtacgccctgcagacctgggagacatgtttgcccagcggaagaatgctatccacagaggaggttttctccacaccagcaacagatagctccgagtcagagtgtaggttcaccaccacggtgccatggacagggtggactttcatctcaaggttcttgaggaatgttccctctgcgtcccagagcttgcgaggaaatatgtcgtcgccgtcatacgcatcgatgaagaccaaatcgtatacattgctgtcgtttgcgacgaaatcttcagcgtccgcgatatggaggaaaagccggtcatggatgcctccccacaacagctcattgccattggcaggcttcgtgggctccggtggtaaccctttcacaggtaatgaggggaaacccatagaatcaattgaagctgaagcaacaactggatcaatttccacaatatgaacaacagcacctgaaagagtcgatatatgatcaaacatatgtatcaagtgcaaagctacagaatttgaagtttagactccagcaaattaagaaaatctggcaggacaaaaccactgagtatcaacaatctgaattcaagcagttttgtgaaaggaatacgctttttatgaactaatagaagttggcaattttgcagttaaacaagttaggtgtagcttgactacagactgcaggaagcaaagtatcggaaaactgaaatttccatatgtggtgtactagctagggaatgagcattcttgaggctagtgactatatttacctctgaatttgctagccaaaaccaatggtaagctgccaccaccatggccaatacaaagaattttcatattgttctgtccagaaactgcttgatggagatcataagaacaacaaggtagtgctgtcaaccctgctgataccatactcttaacatctgtaaataccttctgtcagatgtgtaatatggtacggaagcaaaagataaaatgcagaagtcaacccaattgctttactttatcattgaagactttgatgcatgtgcaggcaaccatattatgatgataatgacatctaagtaacttgcacttgcaatcttgtagcaaataaataatcaggggaatcattttactgatatcatttgactaccacgaagtatgtgtacactgtgtatttgtgttgtgcatatgaatggatttttctgtgttgtggattaacagatataaatgataccgtgaagtaaaacctaacactgacctattatggtcatcaagatttcatcaaaagattgaagtgaactcacaaggaacagccaaacaatgtggttgctgcatcaagtacatccccgtgtcacccgaagacctgtagcaggccattactttggcaacactttgccgcgtatgatcattgaaccgcattactcgccactggtaacctagtatcttaaactggttggcaccaaatgaatttgggtatattcttgcgttcctttcttgaagccatctctctgttactgtccactcgtcactggcctgaaccgcacaacagttagtctcaacatgaatgcaaaacagatatcatcaattcatcataaaaagctaaatcatggctaacaagctagaactttattaacggtagagcttccacagtgattgctgaatagaccatactccataggcacatctagattaggagaacaagtgttgccattgacctaaacgctttgcccgaaactggaactacaccaaaacagcaagcttttgactgaaaacagcacgattgcaaaagcccgatctctacagagaaatctgaggcctaagttgcaaacatttgaggaacggaggctgtactgtctcgctaacgagttcctgtccccgcttcataagtttttcaatcctttcctttctccggccccagcaaggaagcagatcaagccggaaaacagaggcgaggtttaccgggcgggatgcggggtacgcggagacggagacgacgccgttgccgtgctcggagtggcggcggaagacggtgtgcgccccctcgccggggccctcgtcctcgccccaccactcccggtggtaggaccagtccccctcgtccagaggaggctggcgccgagcgcccgcggcgacagcagccggggatgccgccgatgagagccgccggatggcgccgcgggcgcacctcgacgccgccgcccgcagcatagtgtgctcgctctcccccttgattgcgcgggcgtgtcctgttgacggcggcggcgagagccggtgacccgcacaaggagaagcccacaggaaacggcccaaaagcccccgaagtacaagggcccaatcctcctgggaagctgagaatgattcaactggacctctacatggatgcttgacatttgtccactcaccaaccctattccattgctaccatatgtaggaactaccaacattcaaatgtctttacatgtcctctaaaaaaagtctttacatgcagaaaatgcataaatatcttaaattgtttcagaaatttgaaatgtaccaatagaaattttgggactcaataaattgtttcagaaatttgaaaatgtactgatatgaaagagaagaaaacaatgtttgacaaatttgaatatgtaccaacagtataaaaatgtttcagaatcagaaatttgtaaaatgtactaagaaaaagaaaaaggaaaagaatgtactaccaacagaaaagaaaataaataaataatggcccatgcaggtctcgaacctgcgaccttcgcgttattagcacgacgctctaaccagctgagctaataggccgagttgaggattttataagctactcattaattaagttactaaaaagaaacattaactgcgcatgattcgatttcccgacctcgcaggccacacgctaacaaccgagcacgagcaacattgcgacgccgactatggttgcgacgccaaaatttctggctctcatagatcacgttagtaaccgaacaacgtgacaattaaccaaagcacacgcgcgagcgtgcgttggctagatgcatagtcggccttggtgctcggtgcagagccgatcgctagtcaatgtacgcaaccagccaccgctctaccggtccgcggcccaatcacgccaagtacagaagtgaagaggatcataatccgcagccatcgcgcgccgcaagcacagcaccaggagaagatgatccgattgaagtgcaaaaccgtgccagtagctaaacattattcgcgcatatcgcatcctccacacgttattcttatttctcttgcatcaagatacaaagttaattacaagcagacacgacacgcatctgggtgttcttttgttatcacccagagtccagagagaacaccagacctaagccggcaggcagagcaccgttgcatgtcccctgcgtcacaggctcgatctcacacccacagaccgatccagtagctaactaagctaatctaggacatcttagcgtgctgctcccgctgcatcgccacgtactcgaacaggctcccgtcgtacatgcgccggatggcctccctcgccaggtacccttcctcgtccctcgccagcacgtacaggatcgtccactccagcttcgccgcgaacctacacacacgtcagcaaaacaaaaccaatttcagtatcatctgtcaattgagagtactgcattgtctatttgaacacatctagtgtgttaaaagactgatgatggcttaccatccgaagagatcgagcacttcgcggttcccctcggtcatctgccacacctccctgtaggtgagcctgtcaggggacgtgcgcgcgtacttgctgaagatgttctcgaagttcaccggcatgaacctgcacccccacgaaatgttcggatcagtattctgggcagcagcgagagtgacgaaattcagaagaggatgtatgattaccggccctcgttatcgtaggtcccagagtcactcccgtgcttactcctgtggatgttgtggatgtagatcgggaagaacggggacggcagccagccctacaatgatcacagttcaaaaaaaaggagtttgagatgctatcgctcaagttatacccaagatcgatcagctcactcacaggcagcgtggggtagctcatggacacgttcacgaccagagcaatgaggaaggacatgatcatgttgaacccaagcgcacggcaccctgcaggttccgtcagtgcaccgatcatgcatgccatttgattgcaagatggcgatcaaatgaatgttagtatagtaactcatttgggtcaaatatatactgtaccttcgtaggtttcccatgggtagatgatgccgttgtcgtcgcggtcgaagaaggcgacgtgctgctgcagcacgctgaggtggtggtgctcgtgatcgtccgtcgtggttccgtctgggtggtagatgtccggcgccgccagcgctctcgcaagatctgatcatcaaacaacgagagacgcatccatcttcagctaattgtattattgttgaagtattcgaaccatggagaagatgtgtactaaagaaggcatctcgcatttgtgcttacatggcttggggacgtgttcctcgaggtcgccgcggacggggcgctcgacggtgaccggcgactgcagcgcgacgatggtcagcgagtccttggcctccacgcccgacacgccgcgcatgtccccgaccttgcgggctgccacggcggcgccgcccctcccgtcagtcgccctcgtcgcgcccggggcttcggtgccggcgcggtcgccgttgcgcccggccttggtcgtcgttgtcccctgcatccctccgcttccgcttggcgcggcccaaacgaccgaaacacactcgattccctgtgaagagctcgtagtcttttgagagatcgatgagatcgactagtcgcagttgcaacgtgtagcggcggtgcaggaagtagcgtcgcggccgcggcggggatatataggacgtcgcgatgggcgcgtggcgacgtgtccaccgggaagggcacggtggcgcgacgtgggcgcgtgcatggcgttcggagagtcgcgcggccgtaacgtgtcgctcggtggacagagagggggagcgtacgtcgtcgtgtcgcgagtcttcgtgtttcggtttcggcatcacgcctcctccgggtacgcctcagaaagccaacaggtggggtagcaatcttgtcccatccgtcacgccgacccagaatcccagatggtacagaagcagggggacgttgcctcgttgcacttgcacgttgctctgtatcgcaagtctgcatcattgcaggtaaggttaaaccatgggccgggcccaattaatgaacgagctcatatcatgtagtaagagaaatatggcggaaaaagtacaccgaatgtctcttaacttgtcgtcgagttacaaaatcatccttgaaccacaaaatcaaatagaacgcatccctcaacttacaaaaccagtacaaaccagttctctctgcggtttttgactccgggtttatctgatgtggcagctgactcaacgtgggactcatgtgggtcccacatgtcggtctcttgtttccctccccttgttgaatagcctctgtagaccaagtccacatacccctgcctctcactcctttttttttctccctgcctgtcgcatagagaagcaccagagagagttgacgggcgatggcaggaaatagccaagggaccatgacccggtcggcagcggagggagtagatggatgtaacgctccgcttttcgtgagatgttaaaaactaattcgccaaaatcctatatgcgaaaatttcgttatttgtgtgagagtctaagttgtgccaagatctcaattcaaatctccattgttgttccctcccgtcgccatcaaaatcctccacctctaaaatgtcaatcccgattcatcttctaaagtcaaacatcgaaattcaatcccgtccttaaaattccttgccaatatttctctcgattccaagaatatcaaatcccaaccttgaatccctccttgtctatcgatctatctacctgttcatctatctatctacctatctatccatctatctatctatctacaagttatccatcggttcgtccgtctatctaacaacctttgaattcctgtcccaactccaaggatgtaaatccaaacatatcccagccttgagcttcaacctccaagattcctcctttttcctctttctttggaaaccaccccaaataattcttcggctctctagatacaaaaccaattcgaaaatattgagttttcactttgatctcccttccttgactccaccatattcccatgagtccaaatatcaagttcgaaattcaaattccaaatctcaatcccttcggaatcgatctcctcggcaaaagtctattttgcctccctcttggtcgttgggccgattcttcctccctcggcccatctcccctcccagccttcctctccccccctctcacgtgcgccgcacgtgcctgctcagccgagcaagagagaggcagcgcctctcttcttcctcgctctcttctcgtctctctctctctctcgccgctccccgccagcgctccgccgattcaaaccgccaccgccttcgctcgttcccgcgcgcgctctcgtcgtggtggccgaccgccctcggtcgccgtccgccctggcccgcctgcgccgtgcagccgcccgtgcccactctgtcgtcaccccacctctgcgccgctgtgcgcgtgcgtccaagacgtggaggcagggcctcggctcccctctctcgcatgctctcccacctccct

SEQ ID NO: 81115 - DNA, 9977 bp, Oryza sativa
gccagcgccgcccacctcatcgccgaccccatctccatcctcctcgacgacctcctccttgagtgcctcgccggtgtcccctatgccaccctcccgcggctccccaccacttcaaccacgctcgttgcctccgtcgcgcccacggcgagctccgcccctcattcctcaccctcttcgtcaggccttgtagaagatcctagtggcggcgcctagggagagatcatcggaggcgatgaggtaggaggcctgaggccacggcgaaggatgccgcctcaggaacggtggcgcggaggatgaggacggggagccaacggatgttggcgtggtggtggtgatgaggacgaggagccagcggccaccgactatgccatttttctatgcagctacgccccgtcgccgccgccgccgccgccgctacgctccaccaccggtgactggatgggaatcgatcccctttctcctttctcctgtaaagtcaacaaaatagccatgggcacatatgtcagagcatgatggaaaacatttgaaaatcaattaaaatggttgaaatggcattctagcaaattggcttcatttgacagtggcattataacgaagccatattcgaaagtggcattccagcgaaaccccatcccgaacatggctaaatgtcaattttctcgagaatagagagacgagaagagttgtagtgggctgggctgtgtcttctcgtgggctcttgaagccgtgatttggagtggagttggggttcgcggttgtattccaggctgggccggatgcttctctcggaattctttttatttttcttttttatatgtttttggttttcgccactgagactggggtggctaatgggcgcgcgcgcatgccggcgcgcgccagctggccccctcccgagcgattctttttccttttattttttcgtgtttttttttcattttcccttttactttttttctgattatttttttaatcttcaacatatgtgttttcaaatgtttcgactggaaaattttcaaatctcaagttaaaattttcaaatctcgagttggaagttttgaaatctcgagttgaaagttttcaaatctgagttggaagttttcaaattctgagttggaagttttcaaattttgaattgaaaatttttaattttgagttgaaagttttcaattctgggttgaaagtttttcaaatttgagatgaaaagatgaaagtttttaaaattgacttcaaaaatttcaaatttcgagttaaaagttttcaaatatgggttaaaagtttttaaaatttgactccatgtatagatttcttttcaatcttttcaatctgttaaacaaaagctatcaaaaaaaatcttacgttaattgtcgttattatctctaactaacaggattagttagtaggtgtctccgagaaaaaatcccgccgcgtgctcgttggcagcgcatacgcgcgagctagcttttcccctgagactgagagcatatggtcattgtatgattcatatgagagagcaggtgcaataaggtccaatcagcagacggtacagctatccacgtcaatactataatctaaactgaaagagtgaaatgatgagagaaaaagtaagggcgctaatcctatcgcctagcgacacacacaaaaggcattgtagccaacattagagcaggtccaatagcatgttataagccagctacaaacatattttaaagagttaaataaagagagagaagagcagcgggctacagatttatagccagctatagcacggactccaagacacagtgtgcgtatgacaggtgggatcaagtattaatagtatagtatatagctattatataaatgggctattagattagctataaatgaattggagctgctagttggctatactattaaacttgctcttaccatcggtgttggctgcaacagccattgttatactcccaatgcactgagtagaaaggatagaatgattggtagagatagaaattagactagaaaattataaagtgatttattggaacccgtgtgtacctactcaatagcaatagctattgtacattcaagctggagtatcttttactgagataaacatttttattgccggctactaagggagtgttcgttaggtggagataggagagattgtctctcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctaattgtactgagaatagaatcatgtggaagcttgtacaatgtataggactagtaaagttctatggatgagcccactatgttggtgcatcagccttacggcctcatcttttcatttatacttatagttatcagctaaaatttatttttttaatcttaaatttagagttgattttgggattttctcatcgaattttatttttcagctcttgcttttaggtcactaagaacacgcatataaaagttttattcacaaattatttttcgtttacaaatatgccgaaacgatggggcctttagataggtgggctcggacatactttctctcccctagagctaggcactctgactagcatctagggcatgtttagttcccaaaaagtttttccaaaaacatcatatatatatatatatatatatatatatatatatatatatatatatatatatatatatatatatatcgaatctttagagacatgtatagagtattaaatgtagatgggaaaaaaactaattgcacagttatgatgaaaatcgcgagatgaatcttttgagcctaattaatccatgattagccataaagtgctacagtaacccgcgtgtgctaatgacggattaattaggctcaaaagttccatctcgcggtttactggcgagttataaaattagtttttttttattcgtgttcaaaaaccccttccgacatctgatcaaacgataaaacaggcccctagttctatggtggaaagggattagaacaagtgctacaatatgtatagagtcaatcctacctccttttctctcctatagaacccttttaagtctaacattgcagatgctatatgaggggtataaatcgaatttcaagtgcaaattgagaataattgcatatcaccatgagtaagtggaagcaagaactttttcgaattttgtttgagaaaaggagcttgtatttaacttatcatttggtaaaaggtaaaatctctacatgtcaatcatttacccagggaagaagagaagaggtacacggaagactgaaatttcaatcagcggttaagattaaacattactacaattttccgtacatttcacaatgcagttcttagttacttatggggttttccttcccaccaaaataaaattatagatttcccctaaaaataataaaactatagatatatatttaagacaaaatagatttgttgctagctcttactattactagttggtaccccgcgctttcttacaagatatgtgaataaatgcatattatatattatataaattgtagatgtatatatttaaataatgtgaaaatgatatgaaaataatgatttgacattgcttgcatcttgagttctaaaaataatgatttggttcatttaaataacaaaattataaatgatatatcatatttgtatgatatttaaaatactctagataataattgctagtgggtgatgatgtggtacacctgcatgttatttaaaattctctagataaatttaaaatactatagataataattgctagtgaatgataatgtgacacacttgcatgttgagttttagaagttagtgaaattaactttataataataagataggatgttgtgtaatgtttcgaaaacgctctgcaccagtagggccagccagagaaaagtacgtatatttagctagtcatatacttagatggttccaaattgattcagttcattcatagcccattataaagaagcttccatgtttataagagacggtcgttgcagtcctcaattctaaaagaaccggttagttgaaccatggtttagaattcatattaaaaaaaactatttactccatcaaaaaatatatgaacctaagagtggtattcatagaattagaacgtatcctatccagcaccatattattgtattatgagtcaatacagttctgcactacattcatcacagatataatatttactatagcttaaatatagtgggcaggtgataaattaaaatagtatttcacacatataggaacagcatgatgctctcctggtccaaaacaatcgagaagatgattaggatatgccattttgatgccatctgcagatcaatgttccatgctgcagttacattgaaaaccatatcctccggttatcttccagccccatcattttcttttaattctaaaccatccaccaggcaagttgctgctcctcatcacagtggcaataatgtacttaatttttttctattcttcgcgaaaaatacgtgcctgcaggctacagtgcaaaaagatattactgcatctagaaatttatcactagatattatccatctttaaatttgaactctataaacttgtcttttttttgaaaaaatatatgtaaaatacctaaaagtatgtcgtattaacatagtgtgctcatcctaaatactccaataatcacaaaacttctgtataccgtgatctaattatccaaaacttattgatcttcaaagtgaaaaacagtactcctagtactagccaacgttgatgggtatttagaaggcaaaattggttatatagcattaaaagttcacgtttttagttttatagcaccgaaagttaccggttcactttaatagcacccaaaattcaccatgttctcatttttagcacttccgtcaatttttccgtccgtcttgatcgatattgatctagccacacacacgatatgacatttcttgatctagccacacacacgatatgacatttctacctctcatttacatgcattatacttgtacttgtgaggggtagaaacgtcatatcgtgtgtggctggatcaataacgatcagacggacggaaaacgatcaagaattgatggaagtgttaaaaatagaaacatggtgaactttaggtgctattaaagagaaccggtaactttcggtgctataaaaccaaaaacgtgaactttcgatgctatataaccaattttacctttttaaaacctggagtattattttccatcagaaatgctcctgctcgaagtattgctacaactgtacaggtgagcacggccactcccatctccgtgattgcgtcaggcgatgagaagaatatgcgaggagaggtgctcgcgtggattcgggtcattttcgtatttttcaggcggagtccgcaccggccagtaggctgaggcagctgttgcttcttggacagttcagagtttcagagtttcagaaattcagatgatgggggaggacggcctcctgtttcttcacgtcgcgtcgaattgtactaaaaagggtcgtcctttttcgagagtgatcctttgtggagcggatctcgactgatggttttggtttgccggggggtttatcgctctccaacgggatgcgattgggatgggcggcaaacgggccggctggatatttttgcaacaacggcaggttttctctctggctaaaatcgttcgtatacagactctgtaatactccctccgcccataaaaaacataaaaaacaaatttagaatccgatgtgatatattttagtactacgaatttagacatatgtatacctagatttataatactaggatttatcacatccagtatatgttatttttttttatgtaatggagagaatatgacccaacgaagacatgatcatgtagtgaaatacttctaattaagttaacacatttctcgtatcctatctatgtatgctggtgtttttttaattagaagtgttctctttcaataaaagatatagattaaaagaaagtgatattgaagttttacaattgtttacatgttcgtttttgggagacaaaatcaaaagtccaaatatcaccataaactttagatagaagtccgtatagtaccttgaattttaaaaccagacatccaaccccctagatttagcaaaatcgttcatattatctcctaaggtggctttgtatagttgtttatatctaatttgtatataacttggatgagtttgatcatatgacatacacattagacatatgtattaaaattttcacttcaatctttctttttaatcgcttgttagctctcacttacaaacaagtaccaacgtaataatagtatggtatcattgtataagtataaattgatgacttacaattgatgatatgcaaatatgttacattagttatccaaagttgtttatttaagcttccaaaatatgaaaaaccaccatccaaaatcaccttaggggatgattataaagtttagaggttagatgtatggttttaaagttcaggttgatgtactttcatccaaagtttagggggatatttggacttttaccaattataaatatatgtatattaagaaaaaaaaatttgtaaataaatgttagctctagctacaattttatcttgaccaccaattaatcttaaatggttcacatgaaagattttcccgtacactagaccctttttgttttcaggtggatcataagtgcaaccgcacaggaaaatggggacaggtgctgggccgttgcccacatagaaaaatcaattttcgtgtgcggatcacttaacaggcccacacacgaaaataagcctattttcacgtgcgggcctgttaagtgacccgtacacgaaaatagcctaccccacgcgctgcccatcctcccatctccctcttatcctcctccccatcctcccatcatgcgagcgctgccatttatcctcctccccatcctgcccatcctcccatctccctcctccccttcctcccatctccctctccctgtccctctcctcctcggcgatggcggcgctctcggttagggcggcggaggcggcggcattggcgggcgcggcggcgacatctgcgagtacggcggcagcggcattggctacggtggtggcggtggagcggatccgtctccggccgccgcgtggaggccggatccgtcgctggccgccgcggagaggccggatccgtggcttgccaccgctgggaggccggatctgtcgccggccgccgcggggaggccggatccatggtctgccaccgcggggaggccggatccatcgccggcgaccacagggacgacatcggcgggcctcgggcaaggcggcgatgatgacggtggtggcggcgacaacgacgacgacaggcctcgggcaaggcagcgacgacggcggtggtggcggcgacaatggcggcggcgatggtgttgacggcggctagattagggtttgcgggtggattttgatttttttttcggtttcagttttttattttctcgtgcgggtggcttaagcgtccgcacgtgcgggtgcatcacccgcacgaaaaaatcgggattttcacagactccacgttccagacgggtggaagctacgcacgcgaaaattgattccacccgcacggaaaaatctttcatgtagtagtggttagaatacatagttttatgtttacgacacaatgcactttgattatagagcatcggtctcttttaagtatttgtagatctgttttggaagaaagaaaatatgagaggtcaagtttaataaatgattagttccacctatctttaaacatgaacggagtgctatattgtatgataaaactcatgcgatgtatgacgttttgcatagagaacgatcaaatccttcataatactacaatgcaatgcaataagttatcatctacaatactgacataagtgaaagggtggtaatttgtgctaccaaaaaaggattggtctatgccataatactagtaaatagtatgtgtccatatcaattaaatattttactcccgacataaccatataattatgcaaatatactttaaaatgagtgtgccgtaataaaagcacaaataacatatcatacaaccacttgtcaaataacaattcaaaagcaataaaactatgaccgtatgtggttgtctttccacatggaccaaaagtttgaccaatggtcatgtgtacttttccctataccaggagataaaaaataatatctcatgatcatgtcggatggaccgcacctccgaccaatgactaacatgcacttttttggccgaccactaacacttcactgtcttcaactaatccaatatttattggtcgcttcagatcttttctaactttaatctcttccttaaatattcggacagccacccaacctttctttaaataataagacagtcacttggtgccacgtgggccactacacacaagaactcatgagaaacactcaacttttcctccaacgaatccaaaagtatacttcttggacacatcactgttccagcatgcaagagtggctcatactgtagagcgcacagactcagagagaactcagcttagcttaggattagttactttaaaatggaatcattacactaaaaagacatcgaataatcacttgctcgagtgcaaagttcgtgtacacgaccacgataatctctctctctatccagaagataatttcaagtctcataggcttttttttttcatttccaggtggcagtgagagagagagagagagagagaggacatgggcttttaagggcgacagtgacgtgcagaggatctgtgacatatccggatggatattcccctcgcgagcaaaggattatgccccgaatcttccatggctgcaggtcattttggctcatggcgtgtacggagtacattgtacttggctgagggatttcttgcggatcttctgcgccgttcaggttgtgtttcccatgttggttgttttttttttaaaataagttcttgatatatgcggtgggttgggttagttgtctactcccagatagctacgagtatttactcatggccagtagtatactcatgtagcgtcgtcgcgtccgcgcttcacaagttttatactatgtcatatgaatggctattaaaaaagaagagtcgtatattattgagttgcttgacagaaactttaagatgggctacataagtgatatgacaaaatgaaagtgatatagaatatgtatcggttctttcaaaatagactgtgtttttgttatgtggtgaaaatgttttattgatgtttatatattgaggaaaaagtgaataacatatttgggtaaggattattattctaattagttaaaggcaagtcggtgaaaaaaaaaggcactttgacgctagcacagtgtagtaattcaactaataattctaactctttagtggatctggtatttatacactatggctgtttcagctccctgtctataccttgtcaaattgcaagacgcatgacaattaattataggaatattctgttggatatctttgcatggacagtagagtgctacttaaataatactgtcaacaaaaagaaaatcacaagtcggttagctctcctcaagaacatacgacttccaagctccaagtgctaacccatattagtattttcttaaagctatttgtacttgcatgtttacatatttcccttcgaacatggtcaaacagggcctgaaatttttgattattttttttaaaaaaattgttgattattaaaaggtgaactaggtagcaccgtaatgtgtatatataaacgattataacgtagtttggtaagtactccctccgtcccacaatataagggattttcagtttttgct

SEQ ID NO: 81116 - DNA, 34860 bp, Oryza sativa
atgggcactggatcctggataaaaggaaagctccaaatgaaccctgctatatgtacgacttctccatccaatcggcgtatgaccgaaacggcagagcaacacactacatgacggcgtgaagcttggtatgacgtatagcatgttgctaacactgcgtacgccgtagtcgtccaaaagtcatcacatccactaaaacatagaacacatcatcatccactaacaataattacatatcaaatctcgtgcaagcatacaacatcatcatctacaatttgttgaattctacaaatcaaaatacaagcatatttaatcatcacccccacatcatttccataatattttaacatatctatttattatttttataatatttagaatatattcatacatatattccgtagcaagacacctcagtatctcacttagtggttgaaaaaaacaaggcaaaatgaataatttaacctcatgtttcccatcatataactaaatctgaaatctcctaaccgctctatatttttttacaacccagagtaatccagcattcaccgttttaccccagaatttccaccaaatgtcatataggactagcaaatccagtaaattttaaagccatccaagccagtgtaatgtaacatatgctcgacagcaattaaaaaaaaactgatacattactcctagcctcctaggatgactaatgcttgctaaaaagactatgaccaagctaaaactttcaagagtgattttgctatgaggtataagaagctaatacatttttataatgcaagatttagtacaacccagcattggtttcttaggtaacactgtaacaggaggtatagggtgtgtttagttcctgaaaaaaattgaaagtttgggaaaagttgggagtttcgaaaaatagttggaagtttatgtgtgtaggaaagtttttgatgtgatatgatgtaatggaaagttagaaattttgggtagttgaggtgaactaaacacggccataaaacaaattgttacctcccaagaatcgtaaaattcataaactgtcaacttgaaataagccgatgaacataattcatattagaacagaacactacatagagctgtagaattcaaccggagatagattacattgcttgaaacaacaaactctgcccaaacccaaagcagagcaacactctagcagtgtgcaggaatggcaactcgatcacacactcagagcaacactctacgacgtgaggtaggggatcatgtacgccgacgacgccaatgtcccgatcaccttcgcctccgtgtccgggaagaactcggcgcccgggagcgccgtcacggcgccgccgtccttctcgacggcgaccgggtaggtgagcaggtgtccggggaggtcgccgtggagctcctcgccggcgtacagctgccagtgcctgtcggccatcgcgttcactctccggacacactccaggctccccgggtgcacgaagtcgtcgtgcagcatccccaggtgctcgtaccacagcgacatccggaagccatggatctggcctctcgcagcctgcccattgacgttcaggtggtgtggctggaacgctcccatggcgatctccgagtcccgcccgccgtccatcgaccgctggttgatgttggccgacccgacgatgatgtactcatcatcaactgataaaagaaaaacattgaattcggtgtgaaatttagagcgagtttaaccgtagtggttgaaatttgcaactagtagttgttgttacctatcatcatcttggagtggacatagatcatgaagcggcgcgcgttctgcgccttggcgtagtctgtgtcttgatccgggcgatgtgcaggcacgtactcgccatggctcttggcctccctgttccccaagcagaagaaggtgaggtaatccctcgggtcggcgtcgctgtgattggccttgagcgcgacggcgatgtcgtagtacatcatctccatcgtcctcctctgccagtcgaggatggcctgcatggcctcgttgccagggtggccctcgggccacatcggcaccacgacgtagacggcgaaccgctcgccggcggcgatcttgctcacgatcttgagggagagctccctcgggatcaggttcaccgcctcgacgtcctccggcctgacgccgccgccgggcctccacccgtaggagctcccgatgaagtactggttctcgatgtagatgaagtccctggcgcggcggatggcgtggatgtacgcgtcctggatgctccgctcgatcacgttgttcttcccgctcacgaggtcgaggcgcgccgccgcctccgggctgctcgggaagccgtcgcacgcgccgccgtcgatggagcggaagagctgcacgttccatgcgtcgtcgtggtggtcgtcgttgttggtgccggggagcttcaccggggacggcggcgtgatgaggtgctcgagggcggtgaggttgacgaggaggtcggcgtggccgctctgcttccgccaccgctgctcgaagttgtagaggacgtcccaggcgatggggccctcgagcttggagtggatgtcgtgccatggctccctcggcccgcccttggcgagctcggcgtcgtcgatgctcggctggtggaagtccttgtggtgcgcggcgtcgagcgtccggaagagggagtgggactgcgtgtcgtagcggccgtcgcagaggtcgaggccgccgacgaagctgacgatgcagcggatgtcggagccgccgccgccggtgccggccggcatgtcgtggtcgacgatgacggtcttctggtggtgggtggccaagagtgagaccttcgtgcccatgatgaagctgctgccggcggcggcgtcggcttgccgcgggcagaggacgcagtgcacgtcggagtcctcgaagtaggcgagcgtgtcctcgtcgtgcgtctgcgcgacgctgagcttgatgccgatggcgtggagcgcctggatggaggagacgtcgttccagaccagcatgagcacgcggacgccctcgctggccttgcgcttgaggagctcgccgatggtggcgtcgccgccggggcgctgccgggacgggtcgcggatgagcgtgatgtcggtgaacaccgaccagccggtgatgtatatgaggtgcttggcgttgctgatggcgtcgaacacgtcctcccagcaccgcccctgctggtagtgcgcgccgccggcgagcgggatcctcggcgcgaacgtgtccggcgcgtgcgcgtcctggtacagggtgaccctgcacccggcgtgctgcttgaagtaggtgcacggcacgccggggtacgccgcgtcgccgacgccgccgccccaccacttcccgccgccgtcggcggccacgtccttgaactgcagccggacgtggatggtcggaccgtgggggagcttcttcttgtcgtcgccgaggatgtcgagcttgcgctcgacggcctcgccggacaggaggtccctgacggggaggtaggcgcggccgatgagcttggcatcgacggacagcgcgaccttgacggagaagacgacgttctcggcgaagtgggcgcagtagaagtggaagcgctcgtcccaccgcgggctcaccggctcgtcgtcgatcacccgcgtccggccgagccgcgccctgccgaggtccaccgtcgcgtacagcctcgtcccgccggggccaagcccggtcgtcttctccaacccgttctccagcccttcccaccactgcaaacaccaacaccaaccaagcacaaagattcagaaacacagcaagaatcagggaaaaaatgtcggcgaggtggatgatcgctatggatggcatcgacgagtgaccttgcggaagccctcgggggcgttgccggtgaggcgggtggggttggtgaggttggtggcctcgaagatggtggcgtcgagcgtgccgtgcatcagcaggtgagccattgctgctgctccttcagtttcagtgtgtggctgtgtgcacttgacaaggctgggaagaagctcgcaaaacaatggtgtggcatgaggcttgacgggctgccaatttataggcaggcgctgctgcacatcgcggagctgaccgcgtacgtgctagattcagaatttcagaggatcaatcacaacagttactaaaacacacacacacacaaaagatcaacggcaacagcacacaagctcgtgaagcacgttcgatcgtactaggaaaatatagtaaattggtggggtcaatgcccaatgagatgttctgtagtttgttcactacagacttgcaggcttcgaagttcaaagtgtatatgtctctgacatctcagttttctcggtgtatagttttcttctgcctcttgacccgtcttccccctccgatttcggtggttcgccaccggcgagggtcggaggacgggtccaaccgtcatcgtcgggtcccttaatagtatagtgtagttaggttggttctttctcgtcgggtcttttatgtaagttgggttcttctcgagttgggaatctgctggtgagattccatggttgttagagtggatggcagcggcggttggtggcggtggagatgtgggaatatactatctgtggaggaatcaggcggtagaggcatcacctctaggcggcggtggcttctcatggcgccggcttgatgtcttctcggctagtagttcaggcctctgtcctagaagttctggtggtggcggtcaaaggcacctactatgcggccccttagcctgatcgtagtccaggatctcctgacccgtggggttggcaattggggcgtcttcggttacatcgcccgaaggttttggcggtggcggttggcggcgcctgctgtggctaccgttctacttggttagaggttgggatctcctgaccggtgaggttggtggcttagaatgacctcgactgttgcagctacttatggtggccagcgacttactaatggagagtacaatggtgacggtggatgggaacttccactggctaggttctagccgtcgggatatgcaggtttcctcatttccaacctcatgtgtcggcctaagtagacaacagttcattcgccatcattcgagttcttcggtgtttatgggtggctggatttggattcttcctctttgtttcctagcagtagtatccatgtagggtttgttgttcaggttgagctcaagctcctcaaatttaatggcgaactccatggagaattcctgctaagctcggcgaagcccataccaaaatctatggctcagcaacaagcctccaattttatgttgtttctgtggaggcaaccaaacggaatcactggttcgtcaagcggtgtgcacgtcaaaggagacccaagatgcaatcatcgcagcaatgtcgcatctcactgtcaatttgcacctctgctactgcttagattcaataggaagtttgttacattaggctgtgttcttttctcctctttcccaactcacttccctcgtttttcatgcgcacgctttttaaactgttcaacggtgtattttttttgcaaaatttatatatataaaagttactttaaacaatcatataaatccattttcaagttttttaggctaatatttaattaatctcactataatcacgtgttttgttttccgtgctgggaggcaagcttgagaacctaccctcccgaacacagccttagtgcagtttcttgtcatttggaaatagatggttcgatgctttttagctaatcggtttggtgatgtgctagagcttgttcccctgaactttatcgttattaatgaatgtttatgttttaaaaaggaaactgaggaattttagagaatttaatgataataaactaatttctatgaaaatcctgtaaaatttatacgttctaaataagcatagattgcacatagtcgagaccaaaggtgaggtaatgcataccacaaaccaaaactagtttgcttgaaccttgtatctcaatgggaatgggcgagataggtgtgctttgtgctatgactagaggcattatctaccgaaattgacacacgctagactgatttgccggtggaatcagccgaactaaaagaaaacaaacattacaaagcacatatgaccacgatttgttgatagggaattcgacgataggaatactttcatgggagtcaaatcagacaactccatcctctaagaattcatttctattctcaatcattcaaaaatgcataaggattagcaacatattctatgctgagtggtttatagatctcgactcgacctcaagtccttatcgactcaaacatgagccactaccgcaatgacttacatcatccacaagaccacaaagtgtaacctataaatattccatatctcttcattcatcatccatagggaatcatgcgtgctaatatctactatctccgtcttaaaatatactcgctctatttcatattgcaataagttgctttgattttttaaaactatttaaatttgatcaagttcataaacaaatttaataacatctaaaacactaaattagtttcgttaaatctaatattgaataaattttaataatatatttgttttgtgctgaaaatactactatgttttttataaacctatagttaaacttaaaagagtttgacttaatataaaacgaaaaaaataataacctgatactgaaccaactttataacttttttagtcatattgccataagatttctccggatatacttttatatactcttgcataaattgttatggaactttggatgcgcccctaaaacaactgaaagttgcattgcacgggaatgatcacatcacatggacgcggaaactgccgggcagcatagaaatattataacacgttgatctagaattctagatccaagcttgccgctcgtgtaaagcgtggggggtggcctggatcgagtaacagcaacgacctgcatgcagattggaatattggatttggatatgataaaaatgcagatagcagcatttgacgaggtgcccacttggacactcgcaacgctttctctattggcggagaggaatattgtaataagcgctgcattggcattttgtttgtttattggattgatgatgcattggcatttggcagttttggtatggttctctgcagctgcgcttcgcctattggtgccaatcctatgcaagttggcacttggcacagtggaagtccagtgccttttttttttttttggagaactcagtccaatgcaagtagactgcaagatccccccctatcctcgcccaattgggcccatgaaaacaaacactatgttggaaatggagaaaggtgatgcatggttgaacgtgattatattattgattggatgaagagaggtttagtactagtatataataacagatacaatagcagactataagctagctctaaacacatattgagaagatgaaagaatatagagatgagcgacgggctacacatttgtagccatctgcagcatgaactctaagatgtaatgtctgtatgataggtatgaccagataatatataatagtatatatatttataggtaactattgtatgaattggctattaaattgactatatatgacttagagttagtagttggctacttggctatactattaaacatgctttaaatacctaacggtgactattaaaactttcacatgctaactactgaatttggagtatatattactagatgtcagtcttatttttttccccctttccttttcctagcaataagtcaaatttcatttcctgttatttcaaatagtgcacagctcaaatagacacatcaaacatgtgtagtataggaatggcactttgtacaatgtaatcatggaaaatgatcacgcaacaccacacatatacgcacacccgggattgtattttcgtgttttcttaacacaagctcaaactgacggagacagagagcagagataaaatccattaatttcgcttagaaaatccctaataaaaatatacatacatatatataatctaaacataattaatggtcattcctaatgtaataaaacatatatagctgaccagtaaaataacatatccatatgtctcaaaagataataaaatagacactgatagttgttttgtttcccgtatggcagaatggcacacgttttatgattttaagttaaaaaatggttatgaactacaattatttgtacatgttaattgaccttttatttcaaagtagacgccatgcacctacccacccacgagcaccaccacctctgcctcagcaggaccgtggcgggtagggttgtaagcgggccaacccacaaatttatttataggtcaaatagatgataacgaatggatttttgtgtcgtgattcgatttgcgtatttagagagatgcaagtggatcaatctataaactcatttatatgtcaaattaataggtaacccgcgagtcaaatccgtggattacctactaattttatctataagcgggttcgcagccaagcccgcttactcgctagcggcaggcaaacggcagcaccgttttgatatcgcttgccgccatggagccgcggcaagcagaacactcttgttttggctgcaaattaaacactgcatttaaactgacgttctttgctaacaacatatacttctcaattcttttttgattgctcctctggtctgatctgactatatatgtatttcactttagtgaaaattatctttgaagagtttgtaattgagcaacatgcatgcccaagaacccaagtgctccactgctcatactaccacaacgacatctgaaagcagttggcatgccctcttgcaactgtattcaggtggtacggctgttgttcatccactgtttgttgatgctggcagatggccagatccaacgatgatgtgctcgtcgtcggctgaaataagccgagcagtgaattcgatgaaaattcagagggaatttgatagattgaagcattgaaatttgttgtgctggaatattgagcaaacctacgtctgggtcctctgggagtgaacaacatacaccatgagctggcacatcttttgttttttgtttttttgtctgacgaggagttagcaatttcttaccaaagttttgcatgtttaaatttccggttaccttattcagaaatccataaccaccgtttaattagctttgaaagggagtgtcctatgggaaacaaaaatatggctaccaccttaagggtgtgttcggatgcctcttttcccaaccatttctctcgttttacgcgcgcacgctttttaaacggctaaacggtgcgttttttataaaaagtttctatatgaaaattgcttaaaaaatcaaactaatccattttttttaaaaaaaattagctaatacttaattaatcacgtgttaatcgatcgttccattttccgtgctcagtatgctggaggggaatgagaaccagctaacacaccctaacggtggtcaaatacgaaaccctcattttttaataaatggttacagttgactttttaacaaatatttaaccattcgccttattcaatttattttgcaaataaaaaaaatttaaatcatacttagagaacatttgatgatgaatcaagtcacaataaaataaataacatttgatgatgaatcattatatttaccaattgcaaattatctgccaagtttctttttttttttgattgggggggggggggcacaagctcaagttgtgtcacacgaggctctgtccttgacttaattctaatgtataggatctttaatatttttaggttcgtcattgtgtgatagtgtagtgtgtgatacacacacgatagatgtgtctatttgagctgtactatttcaaagacgaggaaatcaaatttgacttgaagctatatcaaaaacaaaaacctaaaaaggaaaagacggacagctcatagtttagtcgcatgtgacagtatttttacccctagtcaccgttagattagaaacctaactctctcaagtcttatccattattaaattagttcaaccacagttggacctcatcttttcgcttatacttatacttattagctaaaatttaaattttcaatcttaaatttaaagttgattttgggtttttcatcgaagtttattttccagtctttacttctagatcgctaagagcaagtttaatagtatagccaactactagctccaaatcatctagggtgtagctatatttatggcgccatatttttcatcaaaaaatagtcggcatgtatttacattggaagttcctaaattacatatgtaattttagtgtatttacaatgtaaatctcaagagtacatatgtaagtcttaaaattacatatgtaaattcaaaaattacatactaattacatatgtaagtggggtataaatgagttgtaactactctctaagtggcttaaaaaaatgactgtagcatatgtcgccacaattatagccaatccgatcatctatagccagtttatatagtatttttctctgtactattaatacatgatcccacatgtcatacacacattacgtcttggagtccgtgctgcagctagctatagatttgtagcctgctactcttctctcttatcttttatctctttaaaatatatttatagctggctaatagtgtgctattgtacctgctaacacgtatataaaagttttattcaaaaattacttttcgtttgcaaatatatcgtttgacttattacacgaataaatgaaacgatgggctaagttcaaaagtgtcgcaattaacaagcatatactccctgtgtactactccctccgtttaaaaaagggcaacctaggaggggttacatgctcctagtatctgtccagattcgttgttactaggaggggatagttgtctttttatgggatggtcacatcgttattttttttatggggagtacgttccaacttccaacttccaaggttagtgtactgtgttttgttttttttttcacgtgccaattggcaattttcctttcgtacgtgtgggctctcgtctccgccaataagaaagcgttgcaaatgtcccaagttggcaattttccttgcgtacgtgtgggctctcgtcttcgtcaatgctgctcaagtgctcatcatttgttggattaggcggtgcttggatctagggacttaactttagtctctatgtttagacactaatttagagtattaaatatagactacttacaaaactaattacatcaatgaaaactaattcgcgagacaaattttttaagcctaattcatcttgcgaattagtccaagattatagatgggttttattaataatctacgtttaatatttataattaatgtcaaacatcagatgtgatagggataaaattgtagtcgtatctaaacagcgtcgtactctactccactctaccccaaggtcccccacgctttacacgggcgccaggctttggatctcgatccacgggctgctgatcaaaagcacgtggtgccggtttctgcgtccgtgtggtcaccgatcagctccatgctggttcctgtataattttggcccctggctaacaagccaatttggagatggtgagagtgatactccctccgtttctgattgatcacctaactaaaaataaaatcagaatttatagattgattgttactccgtacataaccttgtcttcttcgtgtgccgtgcaaaattgtgtatataacctctccggcaaaaagaaaaagaattgtgttggcttattagcgcatgattaattaagtacccgtccgttccaaaatataaatatttttggacttcgacacattcttcgagatactactttgaccaacaatatctataagataaatatgttttaaataaaaaattgcatattatgatagtttgtttaatgataaaaaattgcaggaattcaaccatgcggatacagtcactactacttacgcgccttcgacatgtacttaagaaataaaaacactgaaattaaagtcatccggccccaccctcaccctctctagctgatgattagtcgattactgttttcctatagccatcgttatacacgagtttctgtggtgttagcgttgatcttttgctaatctctgaatctagcacgcggtcggctgcctataaatttggttgctcgtcaagcctctcatgccaccattaattgcgagctgcttcttcttcccgttcttgtcaagactgaaactcactggatcatcgaggagtggcaatggcggagcagcagctgatgcatggcaccctcgacgccaccatcttcgaggccaccaacctcaccaaccccacccgcctcaccggcagcgcccccgagggcatccgcaaggtcagcgaccgattccatggagctagatcgatcgaacctcgccaatgtttttctacttcttggttgccttctcatggtgtttgtgtttatgcgtgcagtggtgggaaggggtggagaagacgaccggggttgggcagggcgggacgcggctgtacgcgacggtggatctcggcaaggcgcggctcggccggacgcgggtcatcgacgacgagccggtgaacccgcggtgggacgagcgcttccacctctactgcgcccacttcgccgacaacgtcgtcttctccgtcaaggtctcgctgcccatcgacgccgcgctcatcggccgcgcctacctccccgtcggggacctcctgtccggcgaggtcgtcgagcgcaagctcgacatcctcgacgagcacaagaataagctcccccacgggccgaccatccacgtccgtctgcagttcaaggacgtcgccgtcgacggcgacgggaagtggtggggcgccggcgtcggcaacgccgggtacgccggcgtgccgtgcacctacttcaagcagcacaccgggtgcggggtcaccctgtaccaggacgcgcacgtgccggacacgttcgcgccgacgatcccgctcgccggcggcgcgcactaccagcaggggcggtgctgggaggacgtgttcgacgccatcagcaacgccaagcacctcatatacatcaccggctggtcggtgttcaccgacatcacgctcatccgcgacccgtcccggcagcgccccggcggcgacgccaccatcggcgagctcctcaagcgcaaggccagcgagggcgtccgcgtgctcatgctggtctggaacgacgtcacgtcgctgcagatcctccagtcgctcggcatcaagtggggcttcagccagacgcacgacgccgagacgttccagtacttcgaggacaccgacgtccactgcgtcgtctgcgcgcgccaccccgacgccggcggcagcatcgtcatgggcgtcaaggtgcccttcgcttccacccaccaccagaagaccgtcatcgtcgaccacgacatgccggccggcgccggctccggcctccgcagcatcgtcagcttcgtcggcggcctcgacctctgcgacggccgctacgacacgcagtcccactccctcttccggacgctcgacgccgcgcaccacaaggacttccaccagccgagcatcgacgacgccgagctcgccaagggcgggccgagggagccatggcacgacatccactccaggctcgagggccccgtcgcctgggacgtcctctacaacttcgagcagcggtggcggaagcagagcggccacggcgacctcctcgtcaacctcaccgccctcgagcacctcattgcgccgcagtccgcgatgaagctccccgtcatcggcaacgacgaccacgaggcgtggaacgtgcaggtcttccgctccatcgacggcggcgcgtgcgacggcttcccgagcagcccggatgcggcggcgcggctcgacctcgtgagcgggaagaacaacgtgatcgagcggagcatccaggacgcgtacatccacgccatccgccgcgccagggacttcatctacatcgagaaccagtacttcatcgggagctcctacgggtggaggcccgacgacggcgtcaggccggaggacgtcgaggcggtgaacctgatcccgagggagctctccctcaagatcatgagcaagatcgccgccggcgagcggttcaccgtctacgtcgtggtgccgatgtggccggagggccaccctgacagccaggccatgcaggccatcctcgattggcagaggaggacgatggagatgatgtacgccgacatcgccggcgcgctcaaggcgaagaggatggacgccgacccgagggattacctcaccttcttctgcttgggaaacagagaggtgaagaggagtggtgagtatgtgcccggacatcacccaagagatggcacgccatatgccaaggcacaaaagacgcgccggttcatgatctatgtccactccaagatgatgataggtatgctcaaatctagccccgcaaatttcaacccttcaatctagtagtaaatcctttccaaattcacatcaaattctagctgatataggataaactaactgggtggtccacgcaattgcgcggctagcacccatataaaattatatatttttaatatgattttacttaaaatttattaaataattatctcattgtcttaaaattttgaaaaagaccaaacattatcatcccttgctacccttacttctgtcatatcattttttttattaccttgctcgatctaccactgtttctattcattcttcttggaacctttaaaaattagatataaaaacttatagttttagagtttattgttctgttggccttcttttttataatttctaaaagtcacatatactcctctacaaccatccactgcatcttctctttattgtcattgctattttaaaattcgaacataattattgtttaggttcgtttttttactttctaaaagttccactaaaagtcagggactttgtcactatactcctctacgactcgcccgctgccgtccttcttttttgtcattgagattttaaaatcaagcatgattaccattgggatttatttttttactttttaaaagcccgaaccttttaaaaattgaatcttataggttttagagttttattgtctcgttgggtttcatgttttttataatttttagaaatcccgtcaaacactgccactatactcctctacaacccgtccgctgcataatctttattgtcattgggattgtaaaaatcgaacataactaccgttggaattcattttttactttctagaagacccaccaaccatcgtcagctctaccattgtactcctatacgacccgctgcctctcatttttattgtaattgagattttaaaaatcaaatatgattattattggggtttattattttactttctagaagtccctcgccaaccgctttgactgattgcttcacaacctgcccgtcgtccttctttttaatcgtcattaggattctatttggtgttttattaatattttttagatgtctcatcaaccgccaccactctacttctctgtaggcttgttacttaattaatcttgtcatggtcttttctttcaatagtctaatttttattaccaattttagctatttataaattgtattcctaattaaattctttttttctttttctaatttcagaatttattttatttattattatgttcttttgatatttttattttttattttcaattttagttgtttcaaatttgtattcatactttaactctctctttaatttgcctaatttcggattttattttattctttattccgaattttaattaatctaccatttagttcttatatgtactcttatttcaatattgcttatatttaattccgaatttaagttaattttaaattgtattcctacttgaacttttattttcttttcttttttctaattttatttttttattctgaattgtaattaatctcgtattggattcttgtatggactcttctttcaatattccttatttttaattcggaattttagttatttataaattgtattcctagtcgaactcttcttttttctttttctaattttgaaatttatttttttattattccgaattttaattaatcacgtattgggttactatatggactcctctttccatattgcatatttttaattccgaattttagctatttttaaattgtatttctaattggactcttcttttctttttcttttgattaatgtgagaatttctaacctccacagcgaacgtggtgtcttctttcaaggctgttttaataatataatagatagatagatagatagatgttctaatgtgcttatcatgtcatttggtacctgtacttttcaaaaagtttttaaaaattgttcgtttgtttcagtcgatgacgagtacatcatcgtgggatcggccaacatcaaccagaggtcgatggacggcggccgagactcggagatcgccatgggagcattccagccacaccacctgaacatcggtggccagcttgcaagaggtcaaatccatggcttccggatgtcactatggtatgagcacctaggaggcgaaccgcacgacgacttcctgcacccggggagcctggagtgtgtccggagagtgaacgagatggctaacaagcactgggagctctacgccagcgaggagctccatgaagacctcccggggcatctgctaacctacccgatcgccgtggctaaggacggcacggtggcggcgctcccgggggcgaagttcttcccggacaccgaggcgccggtgctggggaagaaggcgatcaatccgttgatgacccccgatatcacctcgtagatcaggtgaaagtttgtgctggtggtgcatgcggagcaaaagtttgctagtcctacactggagtgatgctgcttccatcagaatgtgtttgtttttcaacggtgtaagttgtcctagaatgtcaccctctatgtaatgttgaatcttaattccattgtctaaaataaccaaatttgtaatgttactggaacaaattttgtaatgatgagtatgcacctgcaaatcgatcacccagaggaggccaaccaaataaaacatgccctggagactattggagctgaagttgcaaggctggccataaaaatgtttagggattaggactcatttggataatgggtaggaatgggattgggatagggaaatgagtgaagggctaggatgagataggaagaatggagggctaggattaaaagtaacctttgaaaggtacgaacaaaattcccaatccttctgaaacgggccctcataagtacattcttctgctagctttggtggaaaggaacaagtccattttgactccctcaaatattgcttcaatctaatttatatcactgaaccgcaataccggatatcttcacccaaaaaaaactattaaaaccggtgtagtttgactccctcagcggttttagaaggcggtttcgctaacgtggtgctttgacttggtccaacctattgagtcatcgtgtggggcccacctgtcaatgacccttatatctcttatcttcctttcctttcccctccatcggatctacgccacgccgccgcccctcttcccccttccactccactccgccccttagggagtcactgacatgtggttctcacatactgacgcatctggttggaccaagtcaacgtgccacgttagcgaaaaccactctcaaaaccgctaagagagtcaaattgcaccggttttaatagttgataggtcaagatatccggtattgcggttgagggatacaaatcaattgaacctatattgagggagtcaaagtgatcttattccttgttggaaatgcaaggaaaaagaagatagcaacccaggtcaattttagcccaacaggtgcggggtaatttgggccaacaaatgggttattttgatagaacaggcctccagctatacgcaacgaggaacatatcagtttcttttctgaaggaagggggaaaatagctctagctgaagtatatcctcgaataaaatttagaaatatacattatatacatgttttgaaagattcatgaaaatatacgcgtaccgcagttcagaaatacgcgaccggttgttttcctcggcatggagccgcgagaccgacggctgaaacatgcggcatactggccggtgccgcacagccgatctgcgtgaccgtgcggtgccgcgttgctggcgggatcgacgcagtaccgcgcgctcgtgtgtcgcgggattgttccggccatcggtctctataccgcgaaaaaaaatcggtcacgcattttcaaaccgcggtacaagtatagtttcacaaatctttcaaaatcttgtatataatcataaaaacgtaaaaaaataatgtacattttcaaattttattcgtgtatcctccagtaaaaaaaataccaatcgtttcggaaatattttattgggtgtagataaagatagtgtgtgtcgaattagcataataatttttttgtgtttaacacaaaaaatagcgatcaagtcaatagattagggtattcatatgtgaactactacatcatacagttaaccgtaacatgaatgtctacagggcccagctgttcttatctttgatagttcaacagctagcgttactaggcaggcagcccatgcgaagtattgaatcagggcaggacgttgctgttccatctcttcccatcattgaggtcgtatgtgatttcctttttattttaatgtttcataacgcattcatttgcttgcactataaaagcaagaggccatcaaacaagaaactgttcatcgcagcctttgccattgcctaaagcaaacgtgctgtagaataaatgagaactgttcactcgagcagtcgagcttaacttgtggcagaagcccagaaagataccagagacaattgctacaccagtttgcatttagtggtcactgtttcctggctgaagacagaatttttggaacgcatgaattttaatttgatttcgactcataaactacttcaagaaagaaattgtatttcagacgagcctactattggcgtgagcaataaaatgcatatatttttccagcttttttttaagaacatatttttccagctttaaattcgagatgacagacacaggatttcaagggtaagtagtcacgcaacaattgcagataaaattcaccggaagaatacgagataatatcaggagtggatttgttgagggaaaaaatgggttgagaatgaagtattaggccaagtttagaatatgctaggtataatatagctacgtatactattttttttttaagaaattgttgcgtattcacgtgaacaccaagaactccctaggtccatccctgagaaacttgtatagattaaggtcccgttcgaataaactaaaaaaagtggacaaacttttgataaaagtggcacgtttttcaaactgctaaacggtgtgttttgtgcaaaaactttctatatgaaagttgttcaaaaatatcaaattaatccatttttcaagtttgtaataattaaaacacaattaatcacacgctattaacacctcgtcttgcgtaaaacacttaatcttttatcttcatctccaggagattcaaacaccacttaatttgattcatagatatattttttttgccatagttgagtaaacatgagcttttacgcacaagaggtactcgacagtcagcggaacaacagtagatactagtactagattagataaaaaaagagtaaagtgcacacgcggtccctagacttgtgtggtgtgtcaactagctaggtctctgaactctcaaaatgaattttttggatctctcaacttgtctcaagtgtcatataggtctaaatgggttccaacccgctccatgtgctgatgtggcaggccatggtggcgcctacgtgttagtaaaaccgatatgtctgccacatatagaaaaaaaataacatatttttttctcctctcttttttcatttattttttcaaaattaaaaacatcattttctcctctctttttaaattttattttttctacatgattgacatgtggatcccactaacacataagcatcaccgtggcatgccatgtcatctcacggagcgggttgaaacccgtttggatttctatatgacacacatgacaagtttggggacccaaaatgtattttaaaagtttagggacctagataatacatatatatacaagtttaaggactgcccgtgcacttcactctgaaaaaaaaactaagaatctagctccagcttctagcacctatcatccaggaaagaactcgacttgcctgttcaaacagcctactccagctcaaaagtatcagcttaagccaaataaacgacaccaatcaagggttagccaaacatcaaccacatcaggttgaatatttaggttgattttctaaccagaaaagctggagctggagccatgtgaaacactccataacaatagcaggaccagggcgtgcaccgttcatcatgcaaggaatatacaatttttcttaaggagggcttagaggacccagcacagcaatggaggagagaagtccacattgtctccatcttaaatcttggcatgtttctgggggaggaggagatggaacttgacaaaattatcaccactcattcactcacaaaaagtcactataaggatctcaggctgtgtttagatccaaagtttggatccaaacttcagtccttttccatcacatcagcctgtcatacacacacaacttttcagtcacatcatctccaatttcaaccaaaatccaaactttggatccaactaaacacagcctcaagctttcaacacggtagctctatgtaatagtgtgcacgcatgcctgccgtttgtagccgcacatgggcgctatctatgtgcagacgtgcagttaacctgggaccaaaaggaccggacggaacaactcagccggagtagcccggcagcgagagtggacgttgccacacggcagaaaggctttacacggtaccaagattccaagacccctcaatgcatcaaatcatttctatcgatccacacgtctacatagatcaaaacaatgaaaaatacaaagtacatcgagtagtaagaatgagagaagatatatctgattgcggggtgtgcatgttgaggctggtttgttcagagagaacctcagatcctgggagaaagtcaggtcaggatgcagctaaagctaacactaaacaaggcaacaactactggtctactgctgctacaacagtggtgctaccacctggatgcactataatatatgcatcgtcatctgcatgtaatgtaactacccgtcgacagcctcataattatgcccggccaactctcctggcccttctcccctaacgttttcccaagtttccatgccaacgcttccggtgtccccccaagcaatattggtgatcatggccaggcacgtactgacgtacgtattcacacatatagattgttaattaccacgacttgacaaagcaaattaaggctagctacagcacagcacagaactatgacccattcttaaatggatcaaactatggacaacagtggctagctacgctaaagcacaagcaagcaaaacgtgtgcgcctgattggccaatcgatcctcacaatttacccattgaaaggaacgacgttattagaaattacagaaaaatgaagatccagccgtgttcatcgattgtccacgaaacctcgaacatttgcagcccaaaaatatcctgtacaatgcagcgagagagcaattaatcaaggggtcattttcgatgaggcataaggcgcgtatactgatgctgacctgccgctcgctcgcgcactcgataatcgtcaagaaattggccacgtcaatcacggccacgctatcacacgccagcgaccgacgcagtcgggcactatgtgtgtacacagggttggtggatccgtgtgcatatatgcgaggatcatatcaatgcccggtccagtgatcagctcactcactcactcactccaggccagctgatttgctgattaattcccatcggttgatgcagcatggctagtgagtaacgagccatcaccttccttagacgtttgtacgtacgttgctaccttcaactgctacatctgcatgcatatatcgatactacctctgttttagattataagactttctagcattgcccatattaatataaatgttaataaatatatatatgtatctagattcattaacatatatatgaatgtgggcaatgctagaaagtcttataacttaaaatggaggaaatacatatacagcgacagctctagtaaggccggtgcaagaacagaaactacatattttctacaactaggtattcatgcacgtatatttatgtagtcatataaagttctgtgaagatttccaacaagacaaagtacagagccaactcaagatcaaatgatcaatcgatcgagccctagctagcttagttttcgtgtgaccaaggtggcatgctggcattgtaccagcagtacagcgtacgttctggtagaagcgagtggcgtttggtgctgacccaacccaaagcacgagaaagccccccatcgtagttaattcgcactgcttaaaaagttcagtaaatttaaccaccactaccaggactaactttattgcgctgctgtcctagctaaacctgcccctcatccctgggatacttcaggtttcagtgaaataacccaagttagagctacccatgcattcataggatttgagtacttagtagttagtagctagtgtggcagtggagatccaattaatctaccacaattcgagcacatgtaatgtactacccgcaaggcagagctagctagctactcttctcctctcaccgaaccggatgcatttgccccgttgagtgcttggcaagggagtgatcactaaccactggccagacagtgccttctagttgcacgggaacaggattagcaaggggattaactcctagatgcaggttttgggcaagtccccaacaactcaaagcagtatgtgtaattgtgtatgcatgatataatgcagcttgttgaagcaaaggatgcggtgtagaacactgtacctcttgtggactttgtttctgacagaggtgtggcaggtctgatcatcgtcatccgtttcctgtaaccaaagccgcccaactcggacttgcccccaccgtttacctgcaaaaatgtgaaacctgcagaaaatgagatttaatcatcatcatcatcaataactgtagtgtcagtataaatgctgagagtatacagatcagaaatttatatataggggattatctgcaggtgtatatgttgtgtatgttgtgtacgggcgtgctaccttgcagtctgccaggctgacaaagagcaagcagccctgaaagaataaatgacaaagaattcataagaagatggggtgcctcttcctttgaaacattaatcaatacatttaaacctaagtcatcaacaaataataataactagcatgatggcccgcgcagattgcgcggctagcatcattatattttctctcatataatagcatatatgttttctcattatattattcaaatatattaaaatgacaacataattttaaattttgcaataactttacaaaactactaatgtgtaatattcatattgcattttatatacgtgttagttattaattatttttaagataaaattttagttatttgtaaattatatatattcatatatggactctagactcgtcttttaatatttcttttttctgtaaattgtatttctatatagactatatgttcttcttctaatattatttatttttatttctgaaattttattatttctaattgtatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatggactctatactctacttctaatattccttatttttaattccgaatttcagttatttcctaattgtatttctacatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcctttttctattcctttaattatataatagataataataatttagatctccatcctattcttgaagtgtggcagtagatgatgaggttgttgattataactagtaattatcatacctgtcacataattgtgaaggtttgagctagagggacccttaagattttcttccttgaatcgctagtcctagcatttgtactgacaatgtatatatgatcagtgtggtgtactagcgtttatagtgctcacctgtcaacggtttttactggacgacaggtcctgacagtccttggcaaccaccacaaacctgcctgcacttttccatgtaaaaaaaggagtgcgtgcatgtgtacgacgagcagcagcagaagaagcttccatccctgcaggaactcactgacacacgtatctgtgtggagccgatggaactgtaaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgtacttttgtggctttgctttttctttcagactacttgctggattttcatcaaaagaagatgaggaatatgatgaaggtgatatttgtgaataagacatgtttcctaaatggttttaaaagaaaaaaagacatgctttataggataatactcctacaatcatatctatgaactgttcatcttatccaaagatagtagtactccaagattggaaaattatggatgattgtcatattaaagacaaacaagcaggagaaatatttttcttcctgcatcactccaattctccaaccacatgagtccactcaaagggttaattgatcaaatgattaatgcaatggaaagaatttggtaagatagacatggtgcaaaacatagtttactggaaaaaagccgtaatttccgttactacaattcagtaaaataaatccatactccaatgttctggttctgttctgtcttctcactttcatcaagggaaccacctagtttattaataggaaatacaccaattcctgcaggaaaaaggtgttccaaaggaggccttagcatagtaaaaactataatgttttagagcagtcgttgccaccagaaaaagattcacttgtgtccacttaggggggatttgctgatagttaaaagcaataattatgcaataaacagatggccataactcacaaggcatcaactaaattgcgacagtgcaccagactacatgcattatgtcagtgtgtttattcacaccaaatatatagcagcacaccacacagtacaagcagtggtgtttctaactgtgatgccaaccctccgaaagtaaaaatggtgacaccaatccagcacaaacaacttaaagaacttcaagataacatcatacgtggcatatcaaatgaaaaagaatgaaagcactgaaatggatggcaaagatcatggtccccatattatttccccttcctaatttcacaacatacaaataggagcaatgaagcgcgaatcagctccacagttggttctataggttggtaatgcatgaagtcaatgcgaaagggcccagtcagttagttggtcagtcataaagtacgatcatgtcaaaaaaagaagaaaagaaaattaacaatatgagaggatacactattctaaggtcttggatgttgatgaaaacaacaaaggcactacatttagtagtacacgaaatgacaaaatggcatatgattaagaccttagtgaaattcaacgatggccagaaccaaaagctatgcttacatagtgagccaacatttaagttttgatgcttaaaataaacaaattggttttcctttatcatcatgtcctttcagcagaaaagtgctcaccaatttgtgtctcaatccatcaaaacctaataaatgggtttcttgcataaaaaccatcaaactcaaatatgacaaataattctcctaatatgtgctgcagaacaaattgttaggtgtatgatgttcgcctcataatttagagatttgatactcatgctactgctcctaaattttggaaaagtaacagctcacaactagtttcgccttgataccttgtggtgccacagtagctggttaaggacctcccatgttgcaaaagcatgcattgaatatgtccagtaggatagctgtatcggtccccacaacattaactctgccctttgcttcaatctcattcgaatcaatctggtgatgtcatcttaattaagattgtaaagcatatagcaccaagttacgctgcgctcttgacactgtcatccgccagatctacctaaaatagatcaacacatggtccatgtacatgccaattaatccattaatgtcattgtcaagtggctgtggacgacagaagtgtagcaaattagcaatgagccaaaaagaaaaggaaaactggcttgtttcaacttctgactaatgagaaagacactcaagtacacaaacatgcgctgaaaacaacatatcataacttgtatcagtaataaataagcatttcaaatgagcaacattccaattccagggggctttccgttctttaaaatctagtaaagaagttaccatctggtgagcttttgtaattattcttcaaagcatgggtagattagttggttaagatatctatttagtgaagaaactacaattctactaaaaaatatgtaaaagagatacagcatgaaagaattacccactagtctatcaaaatctgggaagatgtcaatgaaatatggattcacaatgtacagaacaggtggcctgcttggcttccatgtgtaaatatactctctagactctagactttatccagtcaatcttgtagcaaaagatttaggaatcaagtctgacacaacaatttctgtaaacaactaccccttttttggcctctgtaaacaactagcagtagaccagccagtgaccctaaatgcaaagcgttggcaagtataactgctactgcatgacaaacccttgcccctctgagggcatagtaccatggcctggtggtcctagttagttgttacattttgatgtacttacgtccattcaaaatgattacatgcttggcatgtcattatcttggttcatttagcaaccaaatctgtaaaaagtctaatttttaacaatcagttacataaaagtcaaagatatgcatagtcgtcttttacaatttacactaccttattaatccccacttttatattgtggggtatatgtgcagacaaactttagtaactttgactgatatactggattgaacacatggaagtgataccggtgggtaaattgccaatgataacattatacttttgccagattttgatcgtaaagtatataatatattaatgactaagtttaaaactcaagggctgaacatcaaacagaaaaaattgtaaaaataataaaatgtataaaactatacaagtctagtttgctttcactttttcaagtcaagcattacaaaccagcaacagcaacaaaaaaaaaaaaaaagaaaggccaagtcagcttgtttccaaaaattgtttacttggatagctgcagttttgagtttcatcacttcaactcctcaaaactatgaagaccaaccatttggagacatatttagtatattgctacccaagtcattgcagagaagcgagtttctcaatataaatgaccctgtggccaagaagtagtctaaatcatttcatttgcatgttgttaaccccaatgtagttgtcagtcacccgatgcatgtgtttcagaagcatggtaattgagtaaagcgatacaatgaccagctggtcaatttaactaacagatttaactgtgtaaactcatatgaacaatcagtgactgcaaggttcaactattgacagacaagaacacaggtgtgcagcaggcactatgatgtatcacatagaccagaggcaatgctgatatgcatttcctttcagatttttattgttgaagtaatgaacaaatggcaaagtaatagaagtgcatattgtctgtcaaccacagtttaaatgtagcccaattagttctcaagtaaattcaatttatccaaataaacaattcctataaaaaaaatttaaccacccaatgatcaaatttaaccaagctacaccacatctttcgttgttttgttctgtacatatccaagaacatccaaacaacaagtttgaatgtttaacccatataattaaatttgcaaaagtgaaaataaaactatattattgcaattcagtgaagggaagtaaaggagaaatctagccagactggtggaaacaagataattattgctgttcccggcaaagactcaaatagtaatagcttagaacaggttggcaagtggcaatataattaatttcctatattctggaaaaaaacaaaaagtagcacaaagtattgtaaaatgcaaatagagataataaagtaaggaagataagctattccatgccacacaggaaaagagcaatttccagggcaaaagagttgatttatgcgcaactattatataagcgagataggagggcgtatagtcttttaaggaggaaataaacacccaaatttcgagctaaagaggtcccaaacctgggttggggggggggggggggggtaggccgttgcctccacacctcataggctcccaccgagtgagctagtcccggttccatttgcaacagaacattggcaaccaatatccatgtcattttgtttaaaaagagtgtagagccacttcgaaatatggtaacatatcattcaaaattatttgcatgaagcaagcacagaaccaacagagctaaagctatatggcacaactctaatagatttcatataaattgaacaatggagtgaaggaaaatgaaaatcataccgtttttatttgactcatgtagacacaagaaatatgcgccagatagtttatacttttcatataaaaatatgctataaaagttgcatgtggaattgtggatcctgcaggctttcaaaacctgaacaagctctctctgaaaaagcttccagtcttcatttcatcataaagaaaattggcatatcctaatcacctattcaaggtactcttgcaatttgctgaagatattcactggtagaattcaaccagttaaaaaaagacccaccatacttttaagattcatgatctggtagaaacagttgaaagtatctcctctattggcactttcaaactgtcctcttgccatggacggaagcaacttttcaacatagtagcacggatttgcttcaagtttatctgctttagaaacactaattaaatatgaggaagaagttcttattctagaatccacaaacatgactgctaggagtgctattataacatatgtttcttcgagaactccagagtggtgaccagcttactgcatatataacttgtttgttcggtctagggattcccacaggtatatattgtagtactactgaaaatttgtcaacaggctaagaaagataaatgagctgaatgctgaatatcaaaaaactaggacagagaaatggcttgaatgtgttgtgttgcatggcctggcactcaactaaatccccttggccatcagcaatctacaatcagcaccatcaaaaactgatgcagaatgtcgttaggtttcacattgtaagatcagtcagtttactgtgactctgtgtgtgagagaacacatgtttctaatcctgtagttctcctgactcctgagaagaccaagaaaaactgatatagaatgtcgcaaggattcacattggcaagatcagtcagctgacttgtaaatctgtgtcaaagaacacttgtttctaatcctgaagttctcttgactcctgagataaggaactccactgcagttttaaaatgatgaatccttaccaagctgtcaatcactattgaaatatctgtttcgtaagctgatatctagcatcagaagaaacattatcttccattgtatactgccaaatggcttccatgcatactcatgggggaaggcataagatcattgcagaatctcccctgcaagtcatatgtgattgcacttcttgatcttgccagtacatgatatagataataagataaagtgggaaacagctgcctctagaacataagctctcatcaacaattacaatttcagcaacggtttgctcttctactgctagcttccgcttagaagcaatggacgtgagacggatgctcttgaaatcatcatcaatctggccacactttctactgccatcacccaatggaacaccttaggaagggtttctcccagctcaaaatatattggcaggaaagtctttcaggctgcagagtaatagccagattccttaaccagaggcataaaggaggataaggaccctgcatcatgcacattgctttgcaaagttacataaaatcaacagttacagtgccaaaacacaagtaatagatgaaatcatgaaagctgggatagtagcatatagccaactgtactagttcagcattggactgagaaaagttctatataacagattctactcacagcctttagcacaaaagctagccgattctactcacgtggaataaactgtagcaaggatcactgcactgcaattccacacataactctcttcaaacaccatgcaaataattagttgcttgctcaacgcaactctacaattttttggcagaaaagttaacccaacaaatccagcagaaccgactaaaatttgccgttaacaatcacaaaaaacaataacaatcacatttgcacattcgatgcagaaacctcgaaccagtcaactcctgcactccagcccattccgatttccgaaccgcacctccctccattgacgcgatcccgagttcccaccctaccacggttcagagagcagctagctttgcctaaccctgcatcaagctaaatctgcattccgtctcgaagcccgcccccatgcgaatcgatgcgggtcgcggcgttgctagcacaaccagcgcgggcgcccggcgatctaccaggaaaaaacccgagagctcagttgtgcgcgcgcggcggaaacccctctcgtggcgcaagcgtaacccccgacaccgccggcgcagagcaaggccgtgtctagtttcagggttgacgagagaggcgtacctcgcggcgcagcggaggccgccacgcgcgaggcggcgaagctcgttgccggcggcgaggggcggctcgcctgagaggccggccgggccgggagcaccacggggagagaatagaggagaaaattgagatttagccgttgtcaaaacgggtttcactagaatgccgcttccaaaatagtttcattaagatgccacttctaaagtagtttcgttaaaatgccaccatcaaatacgggcaacatgttacaatgccattttatccatttattctcagtttaatgttttttttaatatttttttctcgctgagatgaccaaaatacccttgatcttatctcatctctcatctctgtcttcctcctctccgtttggctcggcggcgcagttggggatagggatgacggcggcgcggctggggacggggacagcggctgcgcacccagggacagggaaggcggcggcgcagctgggtacggggaaggccgcggtgcggacagggacggcggcgacgcggctggggacggggaggtggtgacgtggctggggacggggacggtggcggcgccaacatgattggggcaggtggggatgttctcctacattgatggggtgcag

SEQ ID NO: 81117 - DNA, 97370 bp, Oryza sativa
ccgcagcatcccctggcgcccacgcatggccggtcgttccccgccgccccgagggcggtggtggcaggtgtgtcgtcgcgccccgagcagcctccccgaggagtccctatagctcagcaagcacagcccaaggttagtgactaattttagtctgcgagctttgcaaggaaggggaactagacgagaacttgaagtcttgaacgttctactctctagagctttttaattaaacgctacttgtagatttcggtggcgatttatggtagattttggaacttattacctgttgggcatgctacgtttcatgtgcatgttgaattgcttagtgaacttatatttggtaatagcacaatgctacttctgaggtaaattaggcccatgtgaatggttccgtactggatttagatcttgtaaaagcgaagacacgaattcatgggtttttttattgttattttgattataaatggtgctggtctattttgggtgctgtgttaattaggctattccttattgataaattctggacttaaatattgtgaattttgaagttccttaaattatgcttttctggcatctttcttaggtcattccactaccagctgtaactccatctcctcaagagatcaacaactcaaaagataggtaagaaaactacaaactgtagtgtgttatctttttcttttgaggggatatagttacaaactatagtgttttatcttttggacttagacttcccaactgtcaattttgattgtttatttgtagtgaaaggagcaaggaggactctacaacagtggttattaatgaccgtaaagtaagtttatgtttcttaaacttttttctagaacatttgcgctgtgttaatgcaaatacattggctagatgaggagaatacctgtacctttggatagttggaacatgcccaatcacttttgcccattatcatgaatctttgggataccagttatggctcaccttagacgttttatatgatacaaattctttttctttgctctgattagtgacactatttcagctcctatgataaacatgattttgtttggtttaacatttaccaaagaaatttaaaacgtacggctcttcacaccttattttttctgttcatgcaaatgcaaattgcttctatttcacaattcattttcttaattatccaaatggttttgtagatacttgggctacgaggctgaaattctaatttctaaatataattggcccacatatgaggaacctcacaatataatctataccttgttttatcccgacagatcaagtggacagcacaaactgacatttctttttattgttccaaaggttaacttgatggatagtgagtcaggatccttgtatgcactttgtcgatcatgggtgcgtaatggagttccacatgaaagtcaggttagcatgctcactcgttacaaatgaatgatttgggcacttgccatgtgaaaatttctctatagttatgttaaactagatcctaacaggttcttacacgcctcaattgtcattctggtggtcttataatttctagagttactctaaagtgtatttcttctcagttataatttataaatgcaattctaggactacaacttgattgattatgttgtatgcctgaattttcctcttactactttgaacggacacacatttgctctctgttatttaaagtttggtttaacatcaacaagcttcaaacttgtgagaattttgccaggtgcactttgtatggattgaattgtcctataaaatgtaattgcctagtggagcgatgtctcctgtagagacaatgtgagttgttttgcactgcatgctttcttctttcctttgtactaatagacaggcaaggctcctgtcactttactcccctccaccaccaccacaaggaattccccttttggctcttaatatgtgaatatctgcagttcatagtccatattttgtatgtgcatcatgctatccatgcacttgtcttactagttcttgcagccaagctttggaactggtgcaccaattcttccaagaccactgcctgcttcagtcgtggactctaggatatcagaaaaggacaatgatgctgagaaagagaactcagaggaagagaaggtatcttgtaaaaaactaactttgaagttttgatctttgattcaatgaatctagcattttagttatgctaattcatcgtacagcataacacttagttatattctttccaggcaattctggatcatactggcattttctgatttttggcatgtaagcgtgtatgccttttataactaatattatgactaatacatgcaaaaattgctgtatttcttaggagttgcacataccaactctgaattttacgctttaccctgttatttaaaatgaagtatattgtctatcttatgtcctgcatatcccactcttgcttatttgcagttgtcttggtccattatttgcccatgtgttccatttgctcccaaaatagttagatttgcttcccagttacaaccttcaataatattaggtattaggtgacggtttcatccaacatgtttgagaaatccgggttcatttcaaccttgccatagaaatgtagtatcccaaaaagttcttgagactgaagggataaaggagtccctttttcgtctgtaaattgatattcttggggagagctacttgcttgtgacttctgttactgaccactttgtagctattgttactatttccttctattatcttttctatcaccacaagcatagttttttacatctataatcgcagtgttactatattagctcaaaaaccattggctttgatcttctgtgcagaatgaaaccggtgaatatactgcaagtgacttgctgaagcagcatgtgaagcgtgcaaaaaagatccgtgctgggtatgtatttgttttcatcttccagcccttttacgtatgatttgtgaagtgagcaagtaagttcaaaatatggtgatgcaatagtgatgattggcttttgcttccaatatgtaagtccagcttgattcttcaggtatccaacgaaacaataatgatgcactagcaaaaatggtaagaagatatattatgaaagtgtttcacaagacaaatgaaaatatgtagtgtgatgttgtcatgttgattgttttggtgtagtcagtttatataacatatattaacaccttaatcgcaagctcaatcaaacttatattgctgggtggagatattaagttagctaacttaacgcccttttatgtggtgtagtggagaggttttaggttgtcattttgatagacggcagattgaaaacattagttgaggaatggctgtttgagaatgttatcttcattagacagagttactgagtgttgtgttccactttgacataaatttctttggcagtttgcaaaaggagcggctccgacggattgaaagatacaagcagcgccttgcacttctcttacccccgcctagcgagcttgggaagcatgatggtcattcgtagaagtgtaaaaccgacccaatttgtattcaagtgttgtagtagctcttatgtagccttggtgttgccgttttagttaagaaaagaaaaatctgaagaagctgaaacagcatttcatctgctggcctgtaacttcgttagcatagtcgttcgagcgacatatacttacccaacaacaaactttgacctccatgtaaacgtcttctccggctgtgttcagcgtttgagtttaacatagttttatgcaatgacttgtgctatttatgctgctggatgtttgtactagacaagaaatttgatggctgtatgcacgagtgtttttgcatgttgtgccattgcgccttgaatgcatgattaattatccttttgtgcttaattccgtcgttacttcgtcttagaaagtatctgtcaaaccatttctcttttgatagaagctattcatttttacctttttgcgtagctaattattaattcacgtgtacatttcaatcttcatagaaaagaaataactaaacgaaattaaaacataaaacacatgtgcaatctattatattactaaacaaattgaaaggaggcaccatgttcgctgtgggggctagaaatttccacattaatcggagaaaaagaaaaggagagtccaactagaaattcgaaataactgaaattcggaattaaaaataagtacggttgaaaagagagttcgtataagaacccaatacaagattaattaatattcagaataaaaaataaaataaatccgaaatttgaaaaaacgaaagaagagttcgagtagaaatacaatttaaaaataactatattattaaaaacagctttaaaaggaggtatcgcgtttgctatggaggctagaaattctaacattaatcgaaaaaaaagaaaaggagagtccaactagaaatacaatttaaaaataactgaaattcggaattaaaaataagtactattgaaaaaaagagtccatataataatccaatacgagattaattaatattcataataaaaaaatgaaatccaaaattagaaaaaaaaagaaagaagagtttgagtagaaatataatttaaaaataactaaaatttagaattaaaattaagcaatattggaagaagagtccatataaaaacccaatacgagattaattaaaattcagaaaaaaaataaaaaaatcaaaactagaaaaaaaaagaagagttcaactaggaatacaatttaaaattaactaaaatttagaattagatatatgaaatattgaaataagagtacatataagaacccaatacgagattaattaaaattcggaatgaaaaataaaataaaatctgaaactagacaaattaaaaatataattcaagtatgaatacaattttaaaagtaaattggaatcatgccattataattttgcaaagtttgagatatgtcatcggtatctcaatgacatataggacccatatgagtcaatgacatgtgggtcatgatggcatatctcaaattttacaaaattataatggcatggttccaattttccattttaagaagactgaaataaatattaaaagaacacaatacaatattagttaaaattcgaaataaaaaataaaaataaattatgaaattagaaaaagaaaaataagatttaactaggaatacaatttataaataactaaaattggtgataaaaaataaagactattgaaagacaaagatcatctaaaacatatgacgagattatttaagtaataggcctataaaggagtagagtgatggtggttgatgggacatctaaaaactattaacaaaaggaaggatgacgggcaggccgtgaagcaaccggttaaggtggttggcgggacttctataaagtaaaaaaaaaaccaatgataatcatatttgattttttaaatctcaatgataataaaatgaagaggcagtggacgggttgtacaggagtacaatggcaaagccgcggatggttggtgtgacttctagaaattaaaaaatgaattccaatgatagttatgtccggtttttagaatcccaatgaatataaagagtaagcggcggacgggtcgtacaggaatatagtggcatcgtttgacgtgatttcaaaaaattataaaaaatgaattctaacgagacaataaattataaaaactataaggtccaactttaaaagttcggtcttctaaaaagtaaaaaaaaacttcaatgatattcatgtttgattttaaaatctcaatgacaataaagaaggaaggcaacgggcgagccatagaggagcacattgacaaagctgctgacgttttggcggaacttcttagaaagtaaaaaatgaacccaagcgataattatgttctattttgaaaataacaacgacaataaaaaagaagaggtagtggatgagccgtataggagtataatggtagcgtttgacgggacttctaaaaattataaaatcgaaacccaacgggacaataaactctaaaaaccataagatctaattttgaaaggctccaaatagaatgaatagaaacagtgccagatcggacaagcaaataaagaaggatataacagaagtaacagatagcaactggtgtgacttttaataaaaaatataaaattagaaacatggaaatgataagatttgaaatttcaaagtcttaacaacaatataactatttaataaattttaaataaaatcatattaaagatatataattttgtataggtgctaaccgcgcaattgcgcgggccacccaactggtttcctttcaacaaacaatttcacggagacgctgatcaacctgatgatcagccgcggttgaccaccctgcagttcctcctgatctcccccatgctcccggtgagcgggctgatgttgcccatcttgaccatcgccgtcgcgaagctcctgaagaagtcgtcctggctaccggcgaaccacacgacgatgggcgcggtggtcgaggcggcgccgcccggcgcggagagcatcccctggtcggactggagcaggccgcggttgcgcaggaggttgccgtagtagctattgtcgaacgcgtccggcgtgggcgggtcgaggttgcgcagcgccgcgctttcggggtcgctcgccgggcagctctgccggagctcgttgaggtaggccatgtccagcgtctggtccggctgctccgtgccgctgatgttgtagagccggtcgtggaagaacctgcactgcgccctcccgatggtgtgcgcgccctggagagcgacgaagtcggtgtcgtcgaggttgaattcggagaatttccgtctcaggaggtccagatcgtccgtcggtccggggaggtctctggcgccctcgaagttcgccgccgtgccgtccctcctccccagcatcacgttccagctcggccctcctgactgctcgacaagaaagcgtacgtgtcagcgatccacagatactatatggttcggcgtgattgaatgtttgatggcatgggtgcgtgcatggactgaccagctcgacggagatctcggcggcgagggcgaggatgtcggcgcaggagacgacgccggggcaggcgttctccagggcagccttgatgccgtccaccacgtcgaacccacgcgccgaccctttgttcgggggcgcgttcttctcgctctgcatcgcgccgaagtcgtcgagcagcagcgacccgtcacacccctgcacacacaaacacgttaatcccagctcaaatatgtcacgcaaacgccatgcatggcacgcaacctaggacacactgtacgcacattgacgaagcagtcgtggaagtggaggcggaggaggctggcgggggcgcgcgggtcggtgcagcgcgcctcctggacgacgcgccgcacgatgtcgtacacgcttgggcacgacgcctcgtagtacgacgggctcatcaccggccaagcgctcgcgccccccgccgccgcgaggacgaccagcgcgcacaacaccaccaccgaagccgccgccgccatgcacgccggcgaattaaagtgatctcgctaggaaatttttgctctctgtgctagctatatctatctcgccagctacctcagctcggtgactgtgagattagctaagcttggtgttgcgttgttcgtggagcggacatggcgtcgccgggtgtatttatataccagggctcgaacgaggtttgacatgttccggctacggtagttgcagacgccgctttttcgtgcaatgatgtgtggactccctccaacgccaacgcgtactacttgcctacttgatcgtgtacttgtgtagtggttgagcacttgagctgatctgctgatgtgacagaaggggtctaatttcttgatcgtgaccagatagaggtgattactcgagagagcaactcgtcggccagaaatcgctgaattgttagtttattgtattattattagtacaaacagtaaaccttttagtattatactctgcacacacgcattagataatttcaaaagcgtgcaacatttggcttgtcaggtgttttgccttgcaccttcttcaggcctccaactgctccagtatttaccagttgatgaactggtcttggattcttactgctataagtaattttcgtgacatagaattagtctgatgattagaagggatcttcacgtactttcttatgagtctgtataactgaaaaaatcaactcaaactaagcatctaactagtacaagaacgtttacttcttgaagaaaaaaaaaaggcatttcctaattttttttagtgaccaatcatctacggaactaggtgaaacccggcgcgttgctgcgggatttcagtatgataacaataagtaaaaataatatgtaagatggctaacaacatatacttacataagttgatatggtttatgataatttaaatttaaatagtatatagacgattcaaatgtaaaagtaagatattgaagtattataagagaataaagggagtgagatagtttggaccatagattaatcatttaaggctaaaaataattgatgtgatatgatttaatgggagaagagagaaataacactaactaagtgaggatgtaccatataggtatatatgatattatcataaatgatgaagatatatattgaaatattatgtgaattatttggagtgatgatttaacatgtttacatttttaaactctaaaatttaataaattataaaattatagataagataacatgcttgtatgatgtttaaatgtaataattgttaatggatgatgatgtgatatattgttaatgtattatgatgtgacatctttgcatgttgagctttagaattagtgggttataactttatagtaagataggataagttcattattgtccctcaacttcacgttgagtcagtccgaggtccctaatctcaaataccagaaatcttcacctctcaaatgttcaaagccgtacaaaataggtcccatagcataggtcccatagcattatatatgggtggttttgctgacatggcatccgcctagtcagcaaagaaggaataaaaaaattacagagcccatatgccatttacagagcggtgccgcgccgtggagttgaggaagatcccgaccttggagaggtcggcgccatcccccacaacggagaggtgggaggagatgacggaagcggccaccagatcggaggcggtgagataggtatcttccccggagaagtacgagaaggggtctcggagaccgtgctaggtttgacggcgagggcgtaggtgccgccacgaccgccgccgctgccggcaatggaactaatcgatgggcgctggctgtggcgatgggaaccggcttgcgagaagaggacgcagagctagaggccatagcaacgtaggagaatggcatggccggcggtgaggtagttgcgaggatgaagcaggcgaagccagctggcggagcggtgagcggagcaagccgctcgccgccgcccgctgccgcgctcgcccgcagtcgctctcttctctgccgctggcgcccctgctccgctccacgcgggcgcgttgctctgcctactcgctctagactcttgtggtcttgccgccacccgcttccacatccttctctacggcgaagagaaagaaaagagaagagaaaagagaaaagagaagaaagaagggatgcataccccacatttttattcgtctcccttacatgtgggtctagattgctaactgggatgccatgtcagtgaaaacacccatatatactgatatgagacctattttacacggttttgaacatttaaggggtgaagatttctgatattggagattagggacaccacagactcgacgtaaagttgagggatggtaggggaacttattccatcatcatctacctcggcaagaacttgcccggcccactaactagaggcgcagctgggccaactattccctcggattgtgcggaccatttcggctgcccgtcttacactccacgctcccctcctcttcagaccaaaccctagctcgcaccgtataaatcggcgaacatccagcctcctctccccccgccgccgcagcagcaaggagctagagagacaaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggtacgcacccactacaccctcttcttcttgttgttcctcctccttcatctgtggctttgcggcggtagctcatgggggtttgtgtcggcaggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaagtaagctacaaacttctcaccaaatcatcttactttacttttatccagccatacaacatattcgttcctttcttgatgctatggatagtggtagcatgtttataagcaggctagctagccagcgcgtttctcctgtacttgtgccgtttatcttttgagtatatggaattgcgttcgtcaggaatggagccaaaacctagagacacatttttattcagccttggaataaaaaagataatatttttattgtttcgttacttatttgtggtgcactcttctagctttaaagataagtcacttcggtcaccattaagtggacctgaagctttcttttctgaagagatgcaagataaattatggggacctctggacatgcggcttcttccagtagattctcgcattttctcgtaggtccaacacttatataacattttatcccctactttcagctattttgtgagcatcagagtagcaaaaaacagttatttggctcgatgatgactactcttgctttaaccacaccgaatttgaagaccggaggaagtgtaaaatctcatttctttcattactctttgctcttccttctcggtgattccttatgaaatctcttccttttggtgaagaactactacggaatttattttcgtagtttttgtcctttatcaaaagattgcgattgaaggatgcagcgagatagtggagcatagtgtaaaaggaagtgggaagctatcttctgatggatcttcatgtgtggaaaactttggcctagactgagagccatcaatgtaaatgcccttagatttttgctgtggccatcagttctgggcacattgtcttcatagatactccggaagagtgtaagactctggaagatgcaccatgcacggccaaagaatttccatgttggcatgttctagacagctattatttggtttagtcttttgtgttattttttctgtgttttatgtgtcgagtgtgctacttttctacctggcagtagtgatgaatcaattagatgtgtgaagtgaccttatgaacttaacttttgaggcatacattctgtctgaactgccatatgtacttctcttcatagttgcaaattgcagtgcctatttgctttgttcattcttgttatttttggttattgattatcggtgtgtgaatttggttttctttatttgtttgtatggacagttggtccttttttaattggcaggaatgatgaatcaattagatgtacgaggttaccttatgagctaaaattttgaggcatacaattgtctgacttgccaatctactgttgtatttcagtgtttcgttacatgtctgtggtccatgttctcttattttcaattgcctatgtatgtgcatgcttttatttgacatgctatttgcaacttttcatgctgtacataactcccaaggggtcatgttttatatttctgtatgtatcttggactgtaaaaaaacaaattttaactttgaccgaccttgttatttatctacagatgctatgcgcgcctgcaccctagggctgtcaactgccgcaagaagaagtgtggtcacagcaaccaggtgagcttgatgattgatagtggggcttactattattttacagtagtcatgcaattcagtccatcttctggttaccctttaggaattgttatgatgattggatggaagtagggttttcatatgttctagatttgttatttgtgcctttaagcttgtaaataatggccatggcatttgctagcatgatttcaataacatataccataacatatcaacataccctttttattttggctgtttgatctaacgaaaatttctggtccttccactttcagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtcgtgcgtttcaatattttctagtgttgttttcgatggcaagcggctctgctcccaggctcccaggtcccagctctctgctcgaccttatgtaaggtgtgcaactgtggcaagtcacacctcgtttgcaatgttaagagcatcaccaagatccatccacaaaatttagtttccgtgaatcccaaataaaatttaaggtgcaaaaaataactctcaataataaaatgtgggctactcttaagtcttaactaccacggaaacagaaattgctatgcacatctcttgctataaattgctatgcacatatctttcttcttgccgtaggaagaaaattgagaatgagagcgctttccgactttgtgaagagaatgcattctggtttagagttttttttaaaaaactttgtgaagagagtgctttctgatttatggagaacgagaaaggaggacaaaatgtaaatttttaagacatatttgaagggaatcgttagagcacgtttttcacataagaaatccaaattttaggattaggcttcacaaaggaatacgataggccatgctctaagcatcatccaaacaactcctacatatcgaagcttaaacacagaagaaaaccatctttatttatgttgaatcacaagaacaaaacatcaggccgtgcttacaacaattgtaacgtacacaccgacacactcagaaaaattaaacgagcaaattaaatggcacaaagtgaatgggcgatcaagcaacgaaatcaacatgggctttcaactatttgtcactcttacgaatggtgcttaacgatttaccactagacccatacgtcatagacacatgaggacccacatgttatagacagtgaggggtaaatcgttaattgtcatatcataagagtgacaaatagttaaattgatttacacgggacgtcgatggagaatcatgcatgaagctgaggcagtacgcttataacagagcgaccggcttcatcccctccttgatggccgcaaccaggtgctcgtaggcttcgccccacgcgtttttcatctcggggctccacatgctcgccggaatcccatctttgatcgtctcaagcagcgcgaacctcgccacctgcagtttaatttcgatgcaacaacaccatcagaacacggtcgagttttcacgtcgatcaaacgatccaagcaactcctactacatccgtcttatactcttatttcaagtacaactatcggtttctatatccaacgtttaaccgtccattttatttatttttttattagtttgtttgttattagatgataaattataaataatattttttacgtgatttattttttaaattttttaataaaatttttaaataagacgaacggtaaaatattggatataaaaacatttggctgtaattaaatgggacggagcactacgtatacatacctcgaagtgggtgtcggagacgccgttcttgaagtgcgtggagcccagcctcttgatggtggtgtccctcacggtgaccctcccggttttccgcagctgcgcagccgcctcacacgtctgcatgcgagatccatcgatcggttgatcgcggcaaatgcgcgcacaaaatctgtcagtgtcagctgcaaactctagtacaaaggtcggcgaaactgttttttgtttaccatgacgaagacggccatggcgtgtttcttgagattggggttcttctcgagcggcacatcggagtttcgcaggaacgagaacagatggcgagccgacggcgcgacctcgaagatcctggagtacagatagagtagcagcagcaatcgatcaacaaatgcacttgaaagttgcagaaaacggcagtgaaatgtactcatactacgtacttcaagaagaagcggtggccgatgttggcggaatcgtccttcatgatagcccacgacttgagcaccagcgcctcctgctcctcggtgaacctgaccgccccgttgcttgcgctcgcgaaagccatggccttcctgaatgaatcctgatctaccaagttcctgctttgatttcacaggtgatcgattcgatcgcagctagatcaacccgatcgagctcagtgcaactcaactgctggatcgatgctatgctatctgaatacaaactgcagcagtgcgaggccgatttatactggtcgatcggtccgggaatgggggcggccattggctgtcgatcgtgtcgacgagcgagacgcatggtggtggcactccacgtccactccagctgcacggaaggaagcagaaaaacgacctgaatatggcgaatatccgtccatgcaagccgtgaaaactgtgtgcccgagtgcagctgcgagagcgggaagctgcacgaaggcagcatgcctgcaactctgcattgtctcgcggttgcatgatggattgatgggggcggttttgggcgcgccgcgcgcggaaaccagcggcaggtttgagttaagaatccagtttatccaagtcaaaccatccatggtcccggcccttaatttctttcttgcctgaagactcgaactagaggcgagatggtttgttcgtgctgcccaaaagggcagtggtggatggaacgttccacaaaaatgggagaaggtgacgaccattttttggcctaacttaatacatattgttacaagaaaaaggtccactttatatccctcaattataggttgagttttattcatgtcgcttaaccgcaaaaccagatacggagcatttctcaagtatatgagatataccttatccataacattgataaattttgcgttaaaaaatctacttgttatttactatatatatacactaactgtacaatttaactttaacaaagatctcgtaggcagatgcggggtgctcgaccgcacaagggctcccaaaactaaaggctcttataggttttaattcaatcaaatattgtgttttaataggtttcaggacatccccattccatctttgtaagtttcacatcccctcctccagtgatctcgctggaacgagtatgtttttttttcttttgctttgataagtctttgagggtaattatagtcccctgaaatacacatagctcatgacaactatgtgatcacaccgttctagatattgaagattatttttttttatatttcgtaaataaaacataatcatttcataagggtgcaatgattttcctaagcttaaaaaaaccatcaccggtgaggttagtaagcttcctagcttggctgtccatgtgtttatactgtgttctcctatataaatccagccgttgttagtcgtgcgttgctcttttattgtttagagggagcacattagatgggagtgcattttcatccttgaggagatatccccttgttatctacatgtcacttaaatagttatgaaaaaaattgagaagatgtattaacatgtgatatatcactctacaaacatgcaagtttaaatgcaagttgtacatctcgcaacgaaaaaaacaaattaaactacaactagttaacatatattcacaatcaaatttgtttttttcgttatgaaatgtagaagttgaatttgaacttgcatgtttgtagagcgatatatcacatgttaatacatcttcttaaattttttcaatttttttcataatcatttgagtgacatgcatacaacgaggggatatcccctcgagggatgaaaatagtttttccacattggatttagggacaatacttctgatgtggatagaagatcaccagccacatcgtggctgtggtctgtggctgagcaaagcatagagataatgaatattacaatgaattgtaaattatgtggcattaagtgaaatagtctataacattagtttatttgtaacttcaatttacatgcacagtcaaaagtaaactctactattttacttgctgatatttttaaaatagagggtcttatcgtaggtttagcgccagggcctccaatttataggatgaccgggggaaagtgattttatccctcgagagaatatccccttgttttatacatatgccacctaaatagtcataaaaaatatgaaaaaaaatggcaacgtagattaatatgaaatatatcacttcacaaacatacatgtttaaactcaactactacaagttgtaacaaaagtaacaaatatagttacaaatgtgcaataactattttcagtttaatttgttattttttttgaaacttgtagaagttgaaatttggtcctgcatgtttatagagtgatatatttcatattaatctatatgtttttataattatttagatgatatttaaataacgagggaatgtctcttcgaaggatgaaaatccacatcctaatgatcgaaatgatataagtcggctgagatgtacttgccccaattgtcttctcttttctaaatgttacatatccaagcgcatgcatgacatgtggaacaaaaaaatgtctctttattaatattttgtcacgagtagaaaaacaacagtgcttgcatccaacgtacacacacggacactccattctcggcgaagaatatatatcagacgagcatatatataatggaaaaaaaaacataacaccaatcggcgagcaacgaacgatgtcgagatatatatggaggatcttgattcttgaaggcttgaaggtgcacacgtattacgcagcagccggcttcatcccctgcttgatggctgcaaccaggtggtcgtaagcttcgccccacgcgcccttcatcgcggggctccacatgctcgccggaaccgcctccttgatcgtctcaagcagcgcgaacttcgccacctgtttgttttacaaaaatcagaacacgatcgagttttcgcgtcgatcaaatgatcgatcgaagcggccattaattagctagagatacctcgaagtgggcgtcggagacgccgttcttgaagtgcgtggagcccagcctcttgatggtggtgtccctcacggtgaccctcccggttttccgcagctgcgcagccgcctcgcacgtctgcgacacacgcacacattctccgtcagtgattgcggcaaaatcttactcatcgacggcaataacgaactatatatggagtagttctaataccatgacgaagacggccatggcgtggatcttgagcttggggttcttctcgagcggcacgtcggagtttcgcaggaacgagaacagctggcgcgccgacggcgcgacctcgaagatcctggagtagtacagatatagattagaaccaatcatatgcagacacacacatcaacaaatgtacaagtgaaaatgtattgcttaatgcttgagaaacacatggttggtgcagtaactgattctgccaaaatggcagtaacatttttcttacttaaggaagaagcggtgcccaatgtgggcggagtcgttcttcatgatggcccacgacttgagcaccagcgcctcctgctcctcggtgaacctgactgctcccctcgacacgacgttgcttccgttcgcagccatggcttcctgacaaaattcctgcttcgatgtggttactctgcgtagcaagtgatcgagcaagggacactgctagatcaattcaagctcaactgaactcaaatgttggttgctgcctgaatccaaactagagcgtagtgaggctgatttatacaggtcgatcggtcccaggatggagctggatctgatggtcgtgacgagcaagagaagcatgcttggtggtggcactccactacagctctacgtactggccggaggtagtagcgaatatccatcaatcaaagccgtgaaactgtgtgcccgagagaggccgggaagctgcacgacggcatgcccgcaaggccgcaactctgctgtctgcatgtctcgctcgcgtctgcataataggggcggtttggcgcgccgcgcgcggaaacctgtggcgggtttgagtttagaaaccaagtcaaaatttgttcgtattcgtgccgcccaaaagaccagtagtggatggaacgttccacaaacatgggagaaagccacggcccttttgggccaaattagccagatgttccgatccaggtttggcagccgaagggctacgcacaaatgcctgggcattttacctctagaagattgtcaaaagttaaatctggatgcagcaatatcacgatcggataacaagggagctgttggagcagtgtgtgccgtactatatcaggtgaatttgtggcagccagtactatggtctgggaagggttctctgactcagccatttagagacacttgggtgcaatgaagggttagcaacttagcaatagctatggactgcaacatgtcaaaggtctatgtagtctcagactgccttgaggttattagaagcatctcagagaagccaagacaccaatatttagtagtccttaatgatattgaggcaataaagaagcattctgtgaaagtagaatttcgtcatgaaagtcagccttgtaattttgatgctgacaacttagtttgtaagtttgcttctactttataggaagggcgtcatctttggttttcaaatcctccctgtgatatgaataggaatgtaaacgtggatgataatgaataaactgtccgcttttactctaaagaaatgtccatgcttttctctttcaccacattgtgggcagtggcaatggaagtacagtgagacgatgatgcttcgctagagttgtggagatggagggtggtaggcggtaataacaatagaagaatcttggtaaggtagttaggtggtggggatggtagatctagtggtgggagttgctggagacggaggaggtggggtaggacaggggcacctcatcgaagtagttaggtggcaatggagagtggtgatggttttaaaggctctaacgccagaggcaatggaggaaggcagggtgcgggcacctctctgaactccgaagtgatttaattacaacacatatattttttttatattagaatagtactcactccgtcctataatataagggactttggctataattgtatatccaaaatgccttatattatgggacggaggtagtatcatttaaaattttgttatgaagatttaattataatgatataatcagattgttgatcgaataagtaatttaaaaggaaaaattatctaaaacttagctattagtatctttttcttactattgcatgtttggatactcctcacataggaaagagatgcatggtactttttatcatttattcatgcaaagatagagtcgtacaattgacattgcgcgactaagatttaggccctgtttgaataagtggaaaacaatatatagaaaatgaaatattgatgaagggtgtttgtaagacatgattttttattatatattaatcttattttcttagtactaaatccttttcatttaggctctactgacatgttattgaaatcttatccatccttttatctagtctacttgcttatcaagtttttgggaaccatgatatactttaaataaaagattaattcaaccttagctaatgcactagctctctcctttgttgtcacttccatgggaaaattgtcattagtcttcactacatcttttttcctttgaatgtaaaggaagattgaatcacagagaacatttccaaaggaattgttggctccattcctccattctaaagactttcaagggtagaaaaaaatactacagtttcaaattgctttgattttttcctttgaaaatccttcataccaaacacagtctaagaggagttagttctttgggcccttggttagaacaccgtaaaatctgtatacaatccagtttcatcttccccatgaagaaaagtccaatataactccctcaactatatatcgaatcttgttcgtatctcttaacttaaagccgggtatatcaactcccgttttgtgattgggaatacgaataaaattcgacctacaattgagggggtcaaattggaccttttcccaatccacagtggaaacacgccttggcccagtcttgaatgggctggatgggttgctctgcctgtctccctccgtgcgaagtctttctatttccctttttggcaaacgtccacaacgtcagaatttgacctgtcgcgagcgagtgccggtcaactcatccattgacggcacgccaaagttctccttttttttcgtttgttcaaaagcgcatgcaagcgtagaaaaccatctttatttatgtcttatcacgagaagaaaacagcaggagcgtgcaccaatcgtacaccacatacacactcctttttttgtgggacacgatgaatatgaaacgagcatttgaaagcaacaaaagctaatcggactcgcgaggcgaggatcatggaggtggagcagctagcatgcctgtcgatcactccgcgggcttcatctcctgcttgatggcagcgaccaggtggtcgtaggcttcgctccacgcgctcttcatcgccgggctccacatgtccgccggaacctcctccttgatcgtgtcaagcagcgcgaacttcaccacctgtttacacgatcgatcgatcgcatgtacgttgttcgacaaagacacgatcagaaaacgatcaagtttcatgtcgatcgaatggagcgcaggcagccattggggatcactgtacctcgaagtgggcgtctccgacgccgtacttgaggtgcgtggcgccgagcctcttgagggtggtgtctctcacggtgaccttcccggctttccgcagctgcgcggcggcctcgcatgtctgcaatatcgattgatcgcgacgcacgcacacattctgtcagtgtctactaccacaacaaatttacttgcctgaaataatgatggtagtattaccatgacgaagacggacatggcgtgggtcttgagcttggggttcttctcgagcggcacgtcggagttgcgcaggaacgagaacatctggctcgccgacggcgcgacctcgaagatcctacaacacaatcagacacacatgtatcagcgaaatgcattgctcaatttaatgcttcacaaacccaatctctgattccgcaaaaagagaaatggtagtaacacgcatgtacatacttcaagaagaagcggagggcaatattggcggaatccttcttcaagatcgcccatgacttgagcaccagcgcctcctgctcctcgctgaagctcaccgctacggcattgttatcctccacgagagccattgcttcctgacagctggttaatttcctgctttgatcaatttctctgtaacaaatgatcgagagctagctgggctctgaaaacaactgctggtttcgatctgaattcaaactgcgcaggtgaggccgatttatataggtcgatctgacccagggtttagcggcctttcgcgctcgcgacgagccaagaagcatggaagcgttggccatcgtgccgtggtggcagttgccgttccactcccaagtctacggcaagatgtacagggggcaaagaattgaagatgattcgagccaaaaaaccgtgtgctgaatgcagctgcgaaagcgggtagttgtgcgaggcagcgtctcggggctgtttagatacccaaaaattttacgccctatcacatagaacatttcaacacctacataaaatattaaacatacgctaaaaataactaattgtatagattgcaactataaatcttttaaacctgattgctccatgatttgacaatgtattgctacagtaaatatacgctaatgatagattaattaggcttaataaatccgtcttgcggtttactgacagatactgtagttagttttttatattagtgtctgaacaccctgcgataacctatataatatttgatgtgagatctaaacacccctcaataacgtgggcgcgtggaaaaccattggcgggtttaagaatccaagtcaaaaacgttccactttctttcttgtccaccaagacggaaatcgtcgtccgttcgtgccatccgagagaccaagcaggtagaacgttccacaaacatgggccaaaagccacggcctcttttcaggcccagataactaactttccaagtttgttgggccgggcccaaaatatcaactttacaaggctctgtacattgggccgtgaaactttacgtggaggataggtgggccgttggcgcgggtgggcccacgagctcccgcgcgagcaggtagcggaaggccgggttgtggggcctccactcgacgccgccgccgccgccgcgcgaccgcgccgcctgctgcgccgccggccggagcggctccgggaggcaggactccaccgcgcggaggaggtcgtgcgcaccgaggccggcgtccctcgagtacggctcgaggagcttcgggaggaggaggagcacccggcgcccgcgcccgcgccgccccccgcggacgccgacgttggcgcggacgaactcgtccctcgccgcctccagctgctggaggaggcgctccggccggtacaaccgcaccaccgggtcggagtggctccccgacgacagcgcgaagtgcaccagcggctccggcctgtcgacggcgaacccctgcaggtcttccttctccttggacttccatttcgggtacaggagtagtctcagccactgcacaaatcatatgcaattcaagatggcaaattttaccaatcactcaagcaggtcaaactgtgactaaattttcagggactttggaaggggaggttgtgagagacgctccagggtcttccggctagcttcttaaggtggtgagctaaccggttcgaagcctcactccttatatttatttgatattaggtcattccctaatattttcgtttttcttttttttttgatggggaggttgtaaaatgcaggaagtaggacaaacctgtgtaggagagtgcactcggcagcataggatatggtactctatcaactccgggtttactctctggccactgatgaggtaagataactgtggcacagaagttgttaccagattatgatttcatacggaatgagatactgctatatcattctatctaagaaaattgcagtttgaggatgttttccaccttagtaagcaatattctcttgctgttactttgcggaatcccgtattctatatgggcctaaaagaaattgtcaacattagactccacaattgaagaaatatagcaagacagaaatgtgggttaagaaactagttacatgcatcatcatggcattgtgcacattgatccagaaagcaattttttcttcatttttcattccgttgagatcagcactttctagcagctgtacaagagacctgcagaataacatcttttactagtctgcaaatagatttatgcatcatttccagcatgtcatgaacaatactcacttgtatttgtgtagcatgtctttaacatcagcagacctctgggcccccttgcaaagagcagacacctcaatcacagaatcatattgttgactgaagtatcttgattcgccagttcctaacgcatcgtcttgccaggcctcaatatagccctctttcctacatcttgggctccatatatccccagtgtatttggaagagagcccgctcgctgatgaaaatgatgagcatggtgaggggaagaagggatgttgcacggcattgaagtccctaatccttatgtatatcgaagcaatgcatttgatcatgtcctcagatattttgttcggtgtttgaggaacatgatctgctatcctggtccctaggatatccgccaggctcacaataccaggatccatgcacttgccctcctggtcatttcaattatgtcagtatcaacaccgttacaagtatatgacaaagatctgatagcaaagtggtttaacaggtcagaaatgaaagagagttttcagacatcgtcctgcacctcgacaaaggatagaggcaaagtatggcatggtttgagagccctagcaagattgtttgctgaaggagatactctggctgaacaaatggaacgctgcaggagcgaggaatggctgcgtccgataccagtcttgtcattgtaatgtgaagttctggtttcgctagtgagagttgtcggtgtagacttgcgtgccatgaccatgccactggactgcaggagttggtgtttccttggggttgagaaatccagttctgaagatcctgtgagtatacctgagaatgaccttgctgactgcttgttgatttccatgtcacaggaagaagacacgctgcaaatttgttgatcaaaggccttccggtagagtgctaggagatgttgctccaagcatatgacctctagctccagcacagcaatctcctttattagttcctcagtaggctgagacaacatgagaagaaagacacagaagctttcagtaagcaacgggaaaacacagccttcaaaaacatttgcgatacaattgaggaaaaaagtggaggaaaattttacctttggaatgcagctctcattggatgaatgaatggcacaaggcttataacctaatgctttctccaaagcacgccgcatagcaaattgatcatttagtcgcttctcaaggtgttggacctgcagagctaactctatgtatcaaaaccaatctgcagttctgcaattctgtagtatcactattaccttacaaattacagtagaaccatttgtttagtcttatgctacacttgggcaggacaaaataaaggataccctgtacttggcactactcaaaattgggatgtctctttaactctagcaatgcaggaatgaatgcctgttacggaactctgtactacgacttcccaactgaatcttaaaatttcacatcattaacacgctttaaagtagtccatgtatcacacaaatatgctacaacatcggaaactttgtgcaatacttgcgatgtctacttcttacctcttgtatcaaagagcatgggagctctgtagtccggggcagcctcttattggtgctattctgatccttcagttcttcggcattcttccgtgaacagaaaaatagaaagaaaagtgagatgttttgggttatggactgaaaaaaagagagattatattccaaagggacatagcaaatgcactagtcaagagttctgtactgatcttgggcagaagaaaatggttcagaaagttaaggggaaaaaggaggggaaattctgctgtgaaattttttaccagcaaaaatgacaccgacccacatgcttggagtcaagagaatgaacaaatgaagcaataagtaacaagccattttatctccaccaccaccaaattacctgtagatgctgaacattgcaccttggggaagacaaatccgtgccatccattctgagcattctaacagagtcgctgccgatgcaaattcgtcaagatcattaggcattagccaagaactgatcctatctaaaacatgtagaatcatagcatctggtcagagatcaatatctgtaacttggtaacaagaagtaaagctacaagctttattttcaacctgcaaccccaaccagggtgctgtaaccaaagctacaagcttctcacctcttggagcggctatgatacattgagcaggttaaggaaggagcctacaagtgaacaactccgctgcaagcctgcactgcacctctgagctcaagaagggctcctcctctctaatctttgcacaggtgagcccatcttagcgaagagttgaactctgtaaccactaaaactacactatcagttagagaactaaaaagagcaaatgatgcagggtagagactgcatggaatggggaagcatctcacctttgcagataaaatcatccaaaggaagtgggagcctgggagttgttgctgtggagttgatcacctaataaagtctttgagcctttgagctcttgacaccttttttcctctctctttttctcgtgtaaaagttgcttcttctaaaggcccctttctttctctgctaggaggatgagggtgatgaacttgatgaggtactacactactactacttgtactagcagtactgtccctactgctgaagctcttatatcagtatcatgccggatcgatcctgtccggctattcagatactttgtttatggtggaagatatatttatgtctgtcctaaaacttaccaacttcctttcttttttatgcaagatagaggtgagagctcaggaaaggcttcactctattccatccagatctggttgattccagttatttatgcccaaaaggaaaatttacttcacccaaagtggctgacatttttaccccagtaatatcagatcagaaggtgaatatataacctaatcttctgccacattataagcctgtcccacctgccacattagcttggaggacctctaaaactagtattcttcagatgtcaacacatgcctttttttttccattttcttacaaaagaaattgtttcaaaaagttgagtaactctcgtttctaaatacgaagaagtctacttttggtctctcaagtatgaccttggtttggttttagtgactcagctaacacttgaaattatccgtatttcattactccacccaacctaggtggttttcgatgacatgacgccatgtaggattaggcagagaaataggaaaagaaagtaaggttgatgttgtcactcctcatccatgtaggcaccgcgacatctttcagagctgctggatcaaaagtaaatggttttagttaagggatctaagattcaaagttggaccaaatacatacagttcagtgacaatgtagtacagatttttctccataaacgatggtaccgtttcactgttttcctgcaaatgttctgtgttccccccctacaatgatgagcagctcatatgcagataaaattgcagcagcagagaaggacagtatcatgcatgtcttttctttgacctgtgactggctctgctccggtaattgatggagctcgtcctatgcgtgtacaagaccacgccagtgaacaccacggacagcggcaagtgtgtgcggagaaggcatggagttacatgggagacccacacaagcagccaaggaaatgtgcagcccacacccagtgctgtctcggtgaatttgtcattttttttcgcctaggaagaggcgctcccttgccctcgtttgcactgccttcctgagtgaactccaaaagaaaatttttggcaggtcatgtgacacggtcacatatcttactgtctaccaccagtgcagcagcgcagtgcacgacagtgctagctagctgctgctgctgctactaccaagtactcgcgagtcacaagatcgtcacagccaccgtcctgcactgcggctatagttgctaccatcctgttcggatcaatcataatcattaaccagttaccgattgttaagcaacaatgtgaatcaattgctcttggcttgttaactgtgatgcattccagttactgtcaatgccacagtttttacacacagctgtgttgcctgtttgtttctgtgcgaaacatgacagaggaatcggcacgttagacaggcaacggcacacatggtttgattgtgccaattcatcccacaaagtgctttgttcgtggcaagtagcactgtgagcatacatgacaaacgctacatgaaaaatggtacatcggtttgtatcggtagatgcctcattgccccaaaggccaacactacacccctaatgtggcaccccatccaggtcccagacggagcgtagttgcttgtcacagaatctttgggtgacctaaaatcccagtgcagttgagctatggctttggcctcacttggcctgcgtccactgttctggaaacaggatgcagaagcagcaccacaacagcacatgtggtgcacgtatggatttgtaataaccttttcaatataaattatttaaaaaggatcctcttgaacttattttaacctaaactttttggtagctgtaaaattttacggcaagtttctcttgtaaactcggttgactctcttcttctacagtgaattacaataactttgcccttttcaaaggttcttttagagtgttcgttttaaaattttaataaaaaaggttttacaaaattgtatgtattgttaggccttgccttggaacttctttgtgtttgtgcgtgtgaatcatccatgctataaaaccgtcgtaaatgaaatagtaggaatccttacctgcttgtaagagtacaatgtgagtactgtaccatttgtatttatcacatctggactctggagtgaaggctaccggacaaccaaaattggcccttgtttattccattattatttgtgaacgtgtgagccatcgagtagacagctcctgcaacctagccacttgttaaggcatctctcatgcaatagaagagaggaggaggcaggtcaggagaaggcacgctcggtgttgtgctcttttccccggcccagctcacagatgcatgcataagtttacaatgattgttatctcgaccactatgatacaatgatgctgccaatgacgactagggaagccgtgcaggtaaatgatgacaaaagtgaaccttgagaaagcttaatttccatccctaatcaaatctcagtggggtgattagctgattaaagaaacatccggcgacagacatgctcgaggtttcatgtgctcttggaccctcctctaatttgatacaattccaatactatgtccatctactagaggtaaataattgttagtagaaagagcaggtgaggtgagatagcaataggaaactacatatactgtgattgcaattggcaatgctaccaatgaacataggaaaccagctccagttcatttgattatgcaagctagtagagtccgagatccagaaagattcttcccatcggttttccaagctgtcagagaaagatttaacttaaccaaaccacagcagtagcagagcaagtactactatgacggcaatggtgtcttattgacaaagtcaatgagctgcagagctagtaatattgctgggtagtagagtctagcaagtagcaagtgacctcttgagaagaatggaccaacacgagacaggagaggacaacatagagtgttctttcacgcacaagattcccataagtccagcgcgctgtacgagtgcatcgccgtcgattccgatgggtcaccgtatgcttgtcctttgcatgggttctagaaagaaaaggcaagctagatgccccgttttatcaacgcataatccaacgattgacttgagagtttatgtgattcttagctagtactccctccgtcccatattatatgggattagaggttaaaaacgtgtctcaaaatataagggattgggtaggtggagtactaatgcaaacagacatcgggcagggagagtactaatgcggacagagagctgtcggtggaatttgtccctaccttatcctctcaccgagtcgcccatcgaccaccgctcgttcccctcccgattttcttcgctttttctccgtcccctccatcagcgcctccctcccacccgcatcttcttctacctcctcccatccatccgagctccttcccttccacctcccatccgttgacgccaacgccggcggtgcggcagccaatggcggcggccaacctggcccatgcgccaccgccaccggtgcccaacctggcccgtgcggtgggggcaccaccggagaagcgaatcgaggtggtgtgggagcgggagaacacgctgctctcgttcggccgggccgccgcgcacgccgccgtcgccttcgtcaagttcaacgtccaggtatatatatacagcgcagccgagttcgatgtgcgtgcttccgtttccacgttgttggtagtacctgtgtttgttttggatcttgcattggatgtcagtttacgctttggattgtttgattttgacaccgcagcatcgcaatgcaagatttggaagctagcgtgggtatgacttggatgtagccattgattggtgtggtactggacatgaaatttgcagcaacgttctagccagtgaactatatgggacaagcctcacaagtaggagtatcaatttaatcgcatttaaccaggatctagatgccaccatgctaaattggtcaagaatgaagaatggagcgattttaggtggatgttttgcagggatgtagttatccattaggcaaagtgctaggatttgaagttgcagttcttatttagagctgaagaggttcttaatacattgccaactactcttagatcatacggagtactaggaaattaacggtgttaaaaaaactaaagtgtcaattttattaatcttagacgctgttaggcacatcatatcttagattcatgttagatttaaagtttatatgtttcattttgatagtttaaaattaaaaaatttatttaaaataggaatataatgatttaacatgtcgccggcagcggtttacgggctggcggcagaatgcggcccagcggcagggttcgcgggacgtggtggttgctaggcaaagagccgcgtccagtggcggaaggcgtttgttttgacgacttgatgtttgtccctgacttggatgatgaaggggctggcaatgagttcaactcacaaggttgtgatgacgaatttgtgcctgaaacacaacaagatgttccaatcgaggagattggcatagggttcctctcttatttatttaattattagtcctttccattcaattttgttaaattatgtgctttttgatgttccatttatttctccttacggtgcaaccatccagtgacaagcaaatcaggagggccgcgccagctcggagtgcgtcctcgcttggggtatgtgattcacactagattgtcgatttgggatggttatgcatttgtagcatgcaaattgagtcacatcttgatttatattgatttgtcttatcttctttacagtacaatgttgcacaattggcttcgggctatttcagagtatgagaagccaagcatcgacatggaaaccatcgagaaggcatgggctgatgagaaaaaggcaatcgctgatgtggactatgagggaaatccaaggaaggtgaacacaagctccgagaagaaggcatgcgtcgacgaggggaagtcaatctccgatgcagaaactgatgatgagggcgtcggtgtgcctgagaagaaggcatgcatcgccgagagaaagtcaatctccgacgcagagactgatgatgagggtgtcggtgtgcctcggaatttacatatgaaagatttgcacgatatcatgtttcctacctatacccaggtatgcaagcgtagaagaatttaggactaccaaactgttgaatgtgattttgttgtggtattttgttgtggaaatgcacaatggacgtaggagtacttagtgcaatatggatgtaggactaccatgtttataagtgtacaaattaccgtagtgttccatatggttgccagactagtacggagtattttgttatggaaatgccctagttatagtcatatactcctataatatattgttctaatgattgtagtattgttccaaagttagtgctgaaattaactatgcaatgacatgttctgaaatgggttcaattaagtattcattgttatgaaattagtgctgaattaaatatagaatcacatattgctgattgctaaaactagttatgctgaattacctatatataacaaaagtctgaaatcatatttacaaactccatcggagtacgaaaaacaaaagtatggctaggctggactagttgttcaacatggtctgcatcaccacatacttacaaactccatcggagtacaaaagacaaaagtatggctaggctgggctagtttaacaaggtgtgcattaccacatacttacaaactccatcggagtaaaaaaaaaacaaaagtatggccaggctggactagttcaacaaggtctgcataaccttgttgtaaagtgcaatatcacaagtcagactagtagggagcatgtcaagcctctccaatcgatccttgttcatatggggtatcttgtagccattgcctccatcggctttcatcacttctatgaagcaagcttgtaggtttaggaaaaccctactcaccaagttagaattatactcattgtactcttcgtccacattgctgattaattcatccatgttactacaatttttgaggtatgtcttcgattgaagagaagcaaagaaacccagatcaagcacattcatgtctggtgaattagggggctggttcatgatgcgtatgtctaggcctacttgggccaccgcgagggcaaatgcttcgtcgtttggcagaatatgtgtcagtgcattgtcttgctgaatccaaatggtcttccctacatcttctctaggccaacaagaggcaatagctggaataacctttgtaatcaagaaagccctacttgtttctctcgacaccataatagattttgtgaccaatgtacccttcggcctgttgcgactactcctttgtgctggttcctaacatatagagcaaagaacaagttagctacaaagtgacttgaaagcaataaaaacagattgaatcaagttgagacttcaccttcctaacaaagggccatattcctattttgccatcgaagtagcaatttccttcctcatcatacctaggctttgcaagagttgataaaaacataactttatctatggcatttttattttgcacacatctcacaggttcatcttcattgaatacaaggtagaaggtcttgtttttcatagtggcgttgaaccatttttcatcaatatgcacaatgttttgcatgtctataaatcttggttcagcattcaaagtagcagcatctagcatggatacacagaactcgagcctttgttttttattagcttccttcaagtaaggtttaatgctatttgagtgacggcgaagggctccttctttgactaacctatgcacctggcttttgctagcattcaatgcactagcaagagatctgatgctacaccttgagttcaaaggaagtgctaaaacctgatccaaatcaatgtcacttcttttttggccacaattaccaggcttctttgatttaaagtcaacttcaacacctgctgctaaacatttcttcgcctttgtccaaatgtcttgtacaactctccttgtcacatcaaacatagctgcaataatttctgtagtatctctatcagcaagtttcccattgatagtacttgcaagtaaagctccataaatagctttcttctcagcttctggtaaatatttccttctctttatattgtcttgttgagtatctgcacaaagaaaatatttatatatatgcatatcagttggcaatatattttatacttgcagtacactaatgaatgtcatttgcatgtcataccttcctcatcacttgatgtatggagatcttcatcaaagacaacatccatataaggagaataaacatcaaaatcctcctcgtctgcatggacagaaaaggtgagacatgagctactcatatgatatccccatctgcatcactgctgattacatatgagcaaaaaataatgtatgtacctgcataatttgattgatcttggagaacatagaattcgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatacagaaaagtgcattataaattaagtaaccattcttgaccacaaaagttttttttttgcattaggtcatctaccacaaaaaaaacacatgttcccatacctatatgggtcatcctgcagtggtgttatatataaagttcatactattcattttttgggttgttttagtagtttctgatattaaaaccagctttatgaaataaaactttaactatgctgattccaactatttagaacacatgatgtacgcttataaactttggaggttgttgggctaatggctggttatcataatgagcaaataaaattcatagagccatttatgatcatcatttttgcatagtaccacataagagtatatatatgactgatggctgaagtttacaactcctgactaaaagcaacaactgattgacactaatagcaaagctgcaaagctctgtgttatgcaaagaagtaatattgggcttgttagtttatgaatttggtcataaattttgatcatacaaactttgctactttcaacatttatgtttctgttatttcagcagaagggaggatgggaaatgtgaataagcccataacttgctttgcattaagattttgattccatacctggctccatgtttagatgacaaatttcttgtgcactccggccattggagagttcaactgcttgcatggcagggcctggatgttcatcttcatgagcaccaaaacattggttgtcaggaagctcttcatcttcatattggaaggcatcttctccttgcacagcaggaaccaggttaaggtcagggatcccatcaccttcatcttgcagcacttcttgcacaccaggatcaaggttgagatcaggaatctcatattcctcttcttccatggattagttgagggtctctcttggtgtaatgatggagtaggttgctaatatgagtgtaatatgagagctttggtttttagacctgtgagtgagagcaagggagtgaaaatggcgggctggttctgagcatcaagtttaaattttgaacagctaatgcatgtgtatttgtggcgctaatgtgtagtgcgtgtgaattttgggcagcaaagaggtgagtgggatttaattgactcttgtcaacatgtgcattaatgtcattgtgtactgaggaatgcttactctttctttgtgccaatcatttgctggcaagcttgtaaacccaaatattctcactgctagtgcccagtactaagtaaatgaggggtacatgcgtcttttgctaacctccttattttggatgaacagtgcccagtcccatataatgtgggacggagggagtacaagttgtgacaaataatccaaaggctctaggatgaaacaagagaagaaaaccagaaatcctgtcctgaacagggaccaagatttgcatcttgcacttcagcagatgggaatcggaattcagacattcccagaatcccagcaatgaatgcttggatatatgtcaaccaaaactgacctagagatcagctgccttctggccacaaaataggtttgacggataagatgagcccataagctcggccaagaatatgtcgcgactcaattagtttgtttctattaatttccaggtgctacgcatccgcaggcacttccaatatgcttcatacattaccttgcatgtttgcaaaaggacatttcaaaattttatcttccaaaatgccatcgtcttgcccgaggggtagatttagcattataagagctatgcaacgtgcacattgcacattgccaccaattcttgtcatgatttacaagagaataagtgaacgctaccctattgttggtattatagccccccgtttaaacttgccatgtcgacactctaacgcaacaaaaaagagcagagttttcctttatgtagctgaagaagcccgggtcagctgtacacttgcaacggaatgtgctgtaagttatttaagtttcatatcttgtctgccacttcagctggcacattgaggtcaaaaagggcagccccaccatgggcatcatttctttctcgcttgtgaggccgcccattgttattagaacttgagccaagttgccgctttccaaaaatagatgaacctacagggcatgttgaaatatgcatcagctatcagaaacatataaattgaagctgcaatagaaatgaaaggtgtcaatataagtaccagataaaccaggctgactcttgtgttcatcttgactgtatttaattggttgcaaaccttgttcagaagaatcccaacaaacattgagctctgaggccctgtcaaggcccttggatttgtatggagcaatattatgaggcgtacgcagtggatacaacaaatcattctcaatgcactgatacctgcaaggtaatatagttagaacagtaatttacagacactaccaaacttttgttgagctcttacatttgcttgcagagtctatcaaccacattggaaagattgatgacatgcttcattgtatccataacctcatcatcactaaaattttgaaaatccctctcaaggaaaccagatagtctttcaacgttgaattctaattgttgttgttggtcctcaaataggttttgctttagttctctttcatcagaagtcatctcatccttgaaaatctcatcaccaaacatgtagaatgcaaaaggataagaatatgaaagaacccgccttgacctgaaaagtctgtttaatccatttatcacccaagagtaatcttttatcttggaatccttgttttcagaaatggaaatcttcccctggatgtcgcccttaagctttgcttcctgcttaagagaatcagtgtgagctttgtatctgttgtggtagtgcatgtaccgataaaggtttctcctagcttgctctgtcttctttgactgatcttcagtgaatcgaccacaactgtggccactaatacttgaccatgtgtgatctctgccagtagcaccaccgcataaccagctacattcaaaagcatcaaatcagaataaatttaaactaaattttcagtgaaaatgaaatttctgtcaaaacacattcaccacatgatacttcaaaattgttgttttgggttttgacaatcatctaacaccatgtccttcactgatgcaagttgcaaacacgttaaaatagtttgaattttacaagctcttggtgtgatgacttgtgttactgaaggagaagaagctactagagagatgtcaatgtaacaccagttcaagtaatcaagtgagtgaactgcctaaataggttcaagcttatacaaaaacatcaaccatcccatataatcaaggttaaactgtttaagtcatagaatttcagaaactaccattagcctgtcaaccatatcatattgcaatactgaagaaagtatcatattgaataagctctctagttcaggaatgcattcaacttatcagctagccaggtggtggaacctgtgagttcattaatgaaaaaaatcatgttggatggtacactgaagcttactcaaagcaggaagtttaagaaaaaaaaggttgaaatgctttgagtttgtttgtatgaacaaatatatatctactagaaaaaggcatggatatatgctaatagtagtatatcattatctaccagcaaatgggaaccagtaaacatgcaaaaatgtagaagttgaagcagcataataaccattaccagaatgcttgcccacatatacatgcaaccagattgcagccaccgttcttctcaacaggtttgtggcacttgggacagggcttagtatttactgttatccaattcacggtctctgactcgtcacggcatttcttgatccagagctcccacatcacacaggaacatggtgaatgtgcttctgaggagcaattaaaacaaaactggcgtccacatgtacattccacctcacagtgaatatcacctttgacgcgtatagcatttccacaatgcggtgtgcttgggcaccacttgactgtatcattgtcctcaatataagattccaacaagaacctttcaaagcgctctgcaatatctggccgctttgcatttactagcttacgaactattgcttcgtcacagatagtattgcacttcagagccatgcacttgatacggcggctttgtccctcatttatcttcacaatgaaatatcctgtccagcctggaagggggcaggaatacacaaattagtagctagctacccaggaaataaatcatcatacagcaaaaggattaatccacaaaatgtcatatactcttctatggcaacacctataaactgaggtcaagacagttagtcgacatagaattaagataggtgcaaagactaaggataagttgaagcatgtgatagttttataagcataaatgactattcatacaattataaagtgataaggcaccatcctatcccagaaaataaagaacacaccattcccatagtttagtttcatgcatttagtagacaaaaggtgcttgctaaaagaagctgttatgtcacatcatttcctttgtagcatgagggtagtaagacgttagccaatacgacaacttccacatacctaacagattagtaactactagtggatgaatttcagactgttgtttagcattgaggtcaaaaggtggggcattgacccaatggctttgctacggaaagtgcatttgcatttacatgatcaatctaccagcatatccaagcaaataactagcacatacgcaaaggtgaaaacttcatagtatttccttttccccaaacggttgttgcttacattcattgcagtagttgtggccgcagtccatcttggaggcgtccgagaggggcacatcgtcatagcaaacattgcaggttacctccgttgaggagggcgagccgggattattagcaggttggagagggataccagcctccgagaagagcctgtccctccccttctgatcaagcagctcgaaaatcctttcgacatcccacctgtagtggatgagcagcgtccgcgcgtggtgctctctcaaccctagcaactccatcaccttcctaagatcctccctctgcaaaatcccaaacaaaccaaacaaaattttaccaaggcaaggaaagggaaaaggcttcaatctcaggaaaatcgcgtccaccccccggaaatcgaatgcgaagagatcctctctagtcgcggaatcacctgcgccgccaagagggattccttggtgatcacctgcaatcgaaggaacccatcaacaaccgaagcgattgggactcggacaacaaatacgacgaggataaaacgatggatagtgggggggcatacggaggtggaggaccaatggcaatcctcgtcgcgttcgtcctccagcacctggaggacggactcctccaaggcgtcgtcctcctgatcgctcaggtagcagtcatcgtcatcgtcctcctgctccaattccgacgaggacgccgtcggggagacctcctcggcgtcggtcaccatctaggggggggcgatcggatcagccccaaatcaaacccccaccggcgacgcagctcgcggcaaaccggggcttccccgggtcgggggaatcggcggcgcctgcgggaggggcaccgggaggggcaatcgcggcgcggggcggcgggcgattgggggcggcggcggcggcggagaagctcgcagtcgcggaaggggaagtgagggaggggaaacggaggggaggcggtggtggtgcggccggaaagagggactggtttgcggtgctttgctgaggaggaggggcgtaaatagaaaattgccgcgatgttgtgtgacctgctagattccgttggattttcgcttgcgtttttgcatcgtaaaagcactcttcacccttccgattccgatgtgctaaacatccgccatcacgaagtacgaacgaaaattggaacctctgtgcaaatgtgtgaagcattgagatacgactccctcacatttttttttctcgagtttgcgctgaatacacaagtgatgatggtaagcaattgtgtacaacatatttgtttaagctggactaacaacattttcttagagaagtagttgtgttatttccataccctatatctcattgaaattgggatgttggggcgagtggaggatgcaaaatcaaagatgtcgacggagatgacatgtggtatggtgttgagtgttgtagcggcatcagccatatatccatgactataccgtctctatgcaagggatctctccttcccttccaacatccacatcgatgatgttctctaccgacaacgccagatcttgcatgaccacattcttcttccctccaaccccaaggagtccttgttgccatcggaagcaacagtcatcccaaggaacaatctgtccctaccaaaccctagcagaagcaaaaatccacctccacaaccacagatttccattgtcattaataaactcttggtcacccaacctccaccctcctactaataggcccatcaaagccttctgcaaacagaatcaaccctcccccccaactaaaagcctgagaaatcctctcgccccaccaagaaaaacagaaaaacagggacaaggccaaggtcaagaagcatcgttgctccgagcacattgatcttgactgggagacgtgcaccaaaaccgaggttgccatcattcgacactagcaccgatagatagaatgttgtcaagctactcctctgtggaggcgatgtctagatgatcgacgacaagaaagtctcatgagattttgaatatgtgaattccaccaaggttaagaagagggccagattagtcacaaagatccgaagggacagagagaagtagaaggataacgggaaagaagcaacctcatcagcgagagtactcttcatgctctatagttcatcttcttattgcttaatctgccagaccttggatcatgaaaacccactcacctatttgcttttacttgtagaaagttcatttttatatagaaatgtagtatagcacgcctctagtgatattgagctcaaaaaaagaagaacgttggtgacaactcccttcatcatatgtagatggtagcaaaataaaaaggcaaagttgaggtttttaatcttttccttctagagaatggacatgagttaacatcactataaattataaattagagaacttacttcaaaactatagtataaatcccctagaatatggaacaatatgaaacaacgatgtatgtatggaccgacataaaagtagaggtcaagttcacatggtatacacaatgcactagccaaaagaacaatattataatcattggatacattttaactacagcgatttcacgtagaatgttggatattgaaatataatttgttgcttgtgtattcctagcattttctctaattatgtgtatgatgtatgtttattgcagtggaaacgttgatgctagtattagatatggggtgaaagaattagattgtaccattcaaactctgaaaaggtaaaaatgtgataattaatcaataactatgcttagatgataaatatattttctttaacataaactttgcagatctagattaattgagtaagaatcaaaaaacaaagatacaatgtattttcattgaaataccacaaatagagtactagaagagtggattaggataggattccctaacggtgactttagaatggattgaagccaataatcacatgttggcgatattgtcattgatctgaaattaaagcaatccgattcatcttatcttgtacatctatcatgttttggctaatgcccgctagatattcagactattgatatcttgcctttctagagttataagcattgtgtttgaaaatgacaacttgctaggtcatttaaaagttttttctgtagatgggtattgcatgattgatttaatttgtttgccctgtcatgtactaaaattcatatgggtagtttgcataattttagctgtcaccgttggcatttggaagaccgtttcccataagaattaataatggactgaatggtaaaggatgtctttgtgagctcatttcgaccatttttgtaggtaccttgatggagtatttctcatacaggatgaacaatatgatgcttgtcattcaattttgctttttttgttgatctatagggttgtgattgcaaatttacacgtgaaatgtagtttgaattaaaaataattcattcgtcgcgaataaatgagatgatgttttagggtccaattaatatatctaatttattacatagctaaacattattatatccttaaaaagaaggataagaaaagtggtctaaatatggttgaataaaatatctcctaataaatgctaagagccgacgttgagccattgttatacttagcaactatatttttctttcctctcatctctttcttccacgacactaaatttaaatttacttgcacggtaataaagagagtccactaataaagaacgttgtacatgttcttaggccttagctctctgctttagatttttgagggccaacttgatgtcaatatgggccatatatgttaaaaatgccctaccaagagaaagcgataaacattaagagaatagtgatccaataatatgttaggaaatatattgatagagccctttttttgaactttcagcgagtatttccctacgctctatgggccgggacgggtgagaagtgagaatgagcgtaataggatgggaatattattggagccatggagagtatttcctaccgtggtcatgacagagagaatttgagctgcatcgcactgcggtgggttgctgtcgtctggtggtctatactccatgaatgaagtactgtaaatcccatgatgaaggttctaggtgttagggcatgtacaacggtctttattagtagtctctctctattgccatgcaagtaaatttgatgacatggaagaaagagaaaggagtatggttgttagggcatgtacaatggtctttattagcggtctctcttcgttgtcatgcaagcatatttgatgacatggaagagagaggaagaaggaaagagaaagatggttgctacgcatgacaacggcatagagtcgactcttagcatttattaggaaatttttcgttgcatcgagtctaacaaaggaaagatgactagtaaaaaagtattttggtacattaatgattagagatcatattgttttaactattgtaatatggtagcctctaattgacgtagagaccataccggtctctacctttgtacttgcccttatgtaggacaacggctcagagtcgactcttagcatttattagagcaaatttttttgcatggtggtgaaaggaaggaaagaagagtaaaaaaatttatttgaatacattaatgattagagaccatattgtttctatctgttgtaggatgctaatatctagataacgtagagtttatatctgactatatatctttgtacatgcccttattccgctccggctgcaacatcattaccttccttacataatccatatttctttctgttgataacgatgcccttgtgttgttatctgacgggaaaacctccaatcagatggctgatggcggcagaccggttccgttgttccggctgcaaaacggccgctcatgaaagctccgttcacaagatacaagcaggccgacgccctcacaataattttctgatcaaatgatgcgtactattgtgaactaatctaatcaggcgtgatgcagacacagaaggaatggcatctgagccgcgaggagggactttcacgaccgaatcaaaagcagcagagccgcgacaacagacgcaccggcgtttgacccgaacaaaaaccccacgctgcacgttaactccactgaaaaaccgagctctctcactcctcacaactagtacgttcacaagcaccgtgacagccagctccaaatggaacacaagggtttgtgcatcctcgccgtcgtcatcgccttccagctcgccggcggggaggccgtcaccgatgccactgcccgggcacgtcgcttcgcctgtaacgtgtcggcgccgtgcgacacgttcgtcgtgtaccggacgcagtcgccggggttcctcgacctcggcaacatctcggacctgttcggcgtgagccgggcgctgatcgccagcgccaacaagctgaccaccgaggacggggtgctcctgccggggcagccgctgctcgtgccggtcaagtgcggctgcacgggcgcgcgctccttcgccaacgtcacgtaccccatccggcctcgcgacaccttcttcgggctcgccgtcaccgcgttcgagaacctcaccgacttcgtcctcgtcgaggagctcaacccggcggcggaggcgaccaggctggagccgtggcaggaggtcgtcgtgccgctcttctgccggtgcccgacgcgggaggagctcagcgccgggtcacggctcctcgtcacctacgtgtggcagcccggggacgacgtgtccgtggtgagcgcgctgatgaacgcctccgctgccaacatcgccgcgtcgaacggcgtcgcgggcaactccaccttcgcgacggggcagcccgtgctgatcccggtgtcgcagccgccgcgttttcctccgctgacctacggtgccatcgccgccgatcccggagcgggcaagcaccgccacggcatcatcgtggcgacgagcatcgcggggtctttcgtcgcgtgcgccgtgctgtgcacggcgatcttggcgtaccggaggtaccgcaagaaggcgccggtgccaaagcacgtcagcccgaagctttcttggaccaagagcctgaacagattcgacagcaatagctccattgctcgcatgatcaatggaggggacaagctgctcaccagcgtgtcgcagttcatcgacaaaccgatcatctttagagaggaggaaatcatggaagcgacgatgaacttggacgaacagtgcaagctcggcagctcgtattaccgcgcgaaccttgaaagggaggtgttcgcggtgaagccggcgaaaggcaacgttgccggggagctgaggatgatgcagatggtgaaccacgccaacctgaccaagctggccggcatatccatcggcgcggacggcgactacgccttcctcgtgtacgagttcgccgagaagggctcgcttgacaagtggctgtaccagaagccgccgtgctcgcagccgtcgtcgagctccgtggcaactctgtcgtgggaccagaggctgggcatcgcgctggacgtcgcgaacggcttgctctacctgcacgagcacacgcagccgagcatggtgcacggcgacgtccgtgcccggaacatcctcctcaccgcgggcttcagggcgaagctgtccaacttctccctggccaagccggccgccatggtcgacgcggcggcgacgagcagcgacgtgttcgcgttcgggctgctcctcctcgagctcctctccgggaggagggcggtggaggcgcgcgtcggggtggagatcggcatgctgcggacggagatccgcaccgtgctggacgccggcggggacaagagggcggcgaagctgaggaagtggatggacccgaccctcggcggtgagtacggcgtggacgcggcgctcagcttggccggcatggcgagggcgtgcaccgaggaggacgcggcgcggcggcccaagatggccgagatcgcgttcagcctctcggtgctcggacagccgctgtccgtctccgacgcgttcgagaggctatggcagcccagctcggaggacagcatcgggattgggaacgaggtggcagctagatagatcaaaacacagcaatgggtatgtataacactgttgggtagtgtttggttgcaaggtttgggatggaatgcgatgggacgaacccacttttaaataggtttggtttaggggtgagcgggatgggttggtccctaaatagaataactcttaaatccgggaccaaccgatccggcaaaatcgagcggacgaactcgtcccacctgagatgggcgcacggcatgagtcccgttgctactttgctcctcgcatcagtcacctggggatgctcgacgagagcacgtcgggctcgagcgacagcaggcggctcagtgacggcggcagtgaagtttggcggtagggagggcggcggcggtggatccgaaggccggggactcggcagcggcggcagatccggaggcaaagcacgactagccatagcacgcagaaataaaggagacccaataaggggctcaatcgcggaccagtaagacccatgaaccagctagaccaaaagacaatgcccttacatatatccctgtcacgaggacaattatgtaaaatcattagcacaccaaaatttaaaggttgtaaacctataaatagatctcaaataatgtgtaataggagatccaattttagagagaaactaatatactatttattattttcctttccacttaaaatgaagcttgactttggtacaagcgtttgtccttcgataacagtgtgtcatggcccatatatatatatctgggccttaaaaataaacttgcgtttgtacgaactcaaatgtgattcaatcctttgtccaagcatgcactttacattgctatcgacttttcatctgctacggaattgttgccaccaatccacctccacagctccactacctccactccaccgatcaatctgagccactacgcctatatttaggcgtgaatggcagaagttgggcacgcgacgtccggcgctgctcgtgccttcctccgaattctcaacaaactccgccatgttctctccagttcccacctaatatctgaggatatcaccaacgtccatataaacaagataatcaccgggcaaattactgttgctgctagttcaccatttgcgcatttcctcttctattacccgcattgttcaactgccatttctctcctcaattccaaaaaaaaaacacatattcattttttttctcattcgagctaaaccatttcaatccatggaattcggacgaactccagcccttcaaatcatcgttggtaagtctgagaaactttcaggttaactttaggctgttagcatacatcttctttattcttcaacaatgcgtgtctcaatgcaggggtcctatggtcgcagctgcagttcggcgctgaggcagtcggcacgacggtcttcacgctgcgcaacaactgcacctacaccgtctggccggccaccttgtccggcaacaccgcggtggccgtcgggggcggcgggttcgagctgtcgcccggcgccaacgtctcgttcccggccccggctggttggtccggccgcttgtgggcgcgcacggactgtgcaccctccggcaccgcgtccctcgcctgcgtcacgggggactgcggcggcgccgtgagctgctccctcggcggcgcgccgcctgtcaccctcgccgagttcacgctgggcggcaccgacgggaaggacttctacgacgtgagcctggtggacgggtacaacgtcggcatcggcgtggcggcgacgggcgccagggtgaaccgctcgacgtgcgggtacgccgggtgcgtcggcgacgtgaacgcgctgtgccccgcggagctgcaggtggcggggaaggagaacgaccagcagtccggggcggcggcgacgacgacggtggcgtgccggagcgcgtgcgaggcgttcgggacggcggagtactgctgcacgggggcgcacggcgggccggacagctgcgggccgacgaggtactcgcggctgttcaaggcggcgtgcccggcggcgtacagctacgcgtacgacgaccccaccagcacgttcacgtgcggcaccggcgcgcagtacgtcatcaccttctgccccgcgcagcagcagtgatgatcaccgcaacagacctcaggatttctgattaggccatccatctccggtgattcaagtccctctcttttttttctcttacctttgcttcgtagtagtagcctagtaggtcgtgaatgactgaatgcaaattgtatcctctgtttcgtttttagggatttgcactaaaaaatgggttgatcagcgctgatctctctattgtagtactgtgtagttgcatggagccattttttagttgcgaaaatcaagccaccatccccgtgacaaagcgggggtttagtgggggcatggaatcttgggcctcgtaggctgatggttcgccaaccaggccgaccgaccaagttacgcaatcacggcccagcctgttaaggaacagagtggctaggtagcgggtagcgaaggaataagttcaccggaggtccctcaacttaacagcgagattttctgagatcccttaaccaaaaaaccagaaatcttcacccctaaactatacaaaaccgtctaatttaggtcccaaggcaatggctggttttgatgacgtggcatcctagtcagcaaaaataataaaataaatatgtgggggcccacctgtcagtgagagaaaatgatgtgggccccacctctcttttttcttttctttttctcttctgttctcaacttctcagctctcacgcgacggcgggatcggcggctggtgcccatctctacccatctagagccgcggcgggcgagcgggcgagcggcgacctcgctgtcgccagccacgccgcctccacggtgccgtgcacctcctcagcgcgacaccggcggaggatgcggaggagcggcccacccgccgcccgccgcaggccgagcgcagggagtccgccaagctgcgcatcaaccgcgccctcaaccagagcggccctgtcggccgcgccttcggcagccggttcggcatcgttgcgatgctcttcaccaggaccgagagtttcattcgcgaccagtgcgacgtcgccgacgactgggtcaacaccgtcgccgcgggggccagcgccggggcgctctaccgcatcgcgtccggcccaaggtcgatgattgtcgccggcatcctcggcggagtcctgtccggcgccgccgtcgcggggaagccgatgcttcagagattcgcaccgaagctatccgccagattggactatttactttgagtaaaatttcaggttaattactactcagcgttgtgcgcgcctggagatgtttttattcgtagtatctagcaaatctgatctcaattaattcatagtttgtaactgttcatattaatggacaaacaaacaccaccgcccgccgcaggcccgcccgaggtggactggtccttgaggacgcgcttcacgacgcgtgacgccacgttggccgtgtcggccgcgccgcccctgccaccgtcgtcgcagccgagcgcctggagcacctgcctctgcgtcgcgccccgcgcgccgcccgcagccgagcaccagggagatgtggacgacgagggcggacacggccgtgttcccggtccccgcggcggcgaggacgcgccacgcgagcggtaggcagaaggcgcgctgtgccgcggccagctgctaccgccggcgccccttctcctgccgctcctctcccccaccgccacgtcgcgcgccgctactctccgccgtcgagctcgccatcatgccggccgtctctctctccctctcccactgccgccgccgccccagctctgccgccggccacctcacgcggagtctgccgctgcgcctgctcgagagaaagagagaagggaagagaaaaaaaaaaggaaagaaaggagagatgtggggtctacaccattttctctcacttacatgtgggccccacataattattatttttattttttgctgactaggatgccatgtcaacaaaatcgggtgcacatactgccatgggacttctttgcacggtttgagtaagtttaggggtgaagatttctggttttatggttgagggatgtaaaaaattctcgctgttaagttgagggacctccagtgaacttattccggtagcgaattagcgaccctgatcgtggcccgtcagggaacctgattacgggcccagcctatgaagaaattggatcgctatagtgcttgtgggccgtaaacacttcttagttacagaaatgctatttcctataccaatataccatcgggatgggatacattttgtcaacctttcccatccaaagaggaacgaggctgagcgcctgagccgtgaggaggaggtggccgtcggtgactccggcgcaggctggggaagaagacctgctcggcgagaggagggcgcggccgtcggcgacatggttgccggattgtcgcctagtgctcgagcaccgctgctcgccgtccacggcaccgccgttaacgcccaccttcggctccatccgcgtggccagccggtgcgccccaactccgtcgccggccatgtggccgttggcgacgtggtcgccggattgtcgcctggagctccagcaccgccgcccgccatccacggtgccgccattaacgcccatccccggctccatccgcgtggccggccggtgcgccctccgccggcgtcccaactccgtcgcgggccttcttcggtcgtcgccttcgtcgccggccgtcgatcccgctgctaagtccgggcctttattctatccatctgctgcttcgagagagcaaagagacaagatgtggtgcaaagagcttattgacttggtcatggctgactgttgagtgtggtagaatcatcttctacgtgataagaatcgcatgatacctgataggtatcatcttctacgtggtaaaaatcacctgatatctgataggtatcattttctaggttgtaagaatcgcatgatacttgttagtatcatctgatacctcacacgtatcacttgatacgttgtagaatcgcatgatacctggtaaggggtatcaggacatgatacatcacaagcatcacccaccacgtggtaaaaatcgcatatcatctgatacctcgtaagtatcatctgatatgtggtagaaacgcacctgtcctgatacctacccggtttcatctcgtttttgaacgtgataccggtatatagcagccctccttagttaacatgtagatttctgaagaaaatgtagcgcaaatcacacatgagtggaaacttaaactattgttgaatctaaaattgaacgcttgagatttatccgtgttatctggagaaaaaattttacttagtgattcaaccaatttttcagatttctgaccgaataaatggctgctggtacagctggacatcatggactcacccgagtcccggatcgtccacgtctcaaactacgtggagtacagtattactgtactactcctagctggcaactacgcacgcgctcgacgtcacacctaattagccacaccaaaaaaaaaaaaacaccctgctgctgctgctaatgaacgtgcgtgacgtgctgctgcctcaacacgatggcgtcgcgcgccgcgacgccgtaccgtgctcctcctcccacctgctccttcagcgcctcgtaccgggcgacgtcgaagctgcgcgcccgcatgaggcgtcgctgcctggacgcgaggcggctgcggtagaagccctcgaaggacggctccgtggaggtgcgcatgaagaaggcgtatccggacatgaagtagagcgacgtgacgtagaagcagacgggctccatgacgtcccacgagagctcccagaaggtgagccgcatgaaccccagcgtctgcgccgccaggaggcccagcccgcaccacagctcccgccgcacctgcgccgccgccgccgcgtcgatgcccgccttctcctcctccatcgcccgcagctcctcctcctcctcccgtttcttccgcacttcgacgacgcttgctgcagctcgcgtcgcgtgtgccgtcgccggtatcatgctcccgatcgctttcgctatctgcacgacaacggagacacgttagtgtgggacgtaatttgcaggtgttcgatcatggattgtgtgtttgtgtttcgtgagtgcgtaacgaaagacgtacgtaccatgtcggggcggaggaagacggcgtcgccgaggacgatgacgacgccggagtcgtcgagcgcgcgggcgagcctgcgtcctccctcggcgccgccggcaatgtcgacgcagagcgcggcgaattccgacccggacacgacgctctgggcgttggacctcagcctcgcccgcgcgacctccatctccgccgcacgcgccaccttcctcgcctcctccaccgtcacgcccaccccctcctcctccggtggccgcgtcacggccgtcgtaggcgggaccagcccgtcgaggcggagccggttgaacagctggtcgccgacggggagggcggggaagcaatgggcgggaagcggaacggacgccgtggtgtaccggatggttcccggtctgggccgcaggtacgcgagcgtcgggcagtcgtcaaccgccggcaacggccgccgcgccggaggttttggagccgcagccgccggacaagcggcggcggcgttcgcgttcttccccgcccatatgccgcgtgctagtgttcgtcggaacgccattttcttcgcctctccgagcaggcaaccaaaatattttgcagattttgtgttgtgtacgtactcgtgttacgtgacagagatgagagatggcggcaactgctggttggttggtttggagttggccgatgaatcgacacgattttgacgaggagtgaacggcagccgcgggtcggtatttatattgggctcaccggtgacgcggcggataggggtcgttagctccagcggcgcgccagaaattaaattaaattaattaaggggcgtgtaacacggcgcacgttattattaatctgacctcgacgcgacgatgcgtccaggcaaaactgtacgctggatttggagagaccttctcaacgattgactcgtcgtgggaaatgctacacgtacgtaccgactaatttggatgtcgatgacacgtacatgtttggagattttaccgggtccgtcggggccgtacaggaatgtggacgaggacgacctggttgaagcaacacgcccttgtgcaaaggaaaccaacgaactgaacatgtcaaggaaatcaactcgctacttagcttcgaattgattttaacccattttttttctcaaatatatataaacacatacactcgtgtacggatgtacggataagagcattcccagcagctcatctaaatttcatcctccatactcctatttggatggccatccaaaaagattcatattacatcctacatataccaacatcctatattttactaatatttttcaactaccacacatttttactcctatttttctcacctttcaccacttaaaaaataatcttgggaagtgggtggttgaggatggagtgaggagagagaacctccatatttggcttgggaagagctaagtttggaggacctcaaaaaatagagtatgtgatggagactctgttggagcactgtttttcttctccatacttcaaatatcggatggatgactagatagaggagctgctgggatgatctaagttgattttgtgatacttgatgatcgattaatcagtcagtatttcgatgctcgtcgaatgtagtcaaatgatcgattatgtagctttttcctgggcagaacttgtgccaaatgtgcgcagagcaagcggctgctgacctaaccgagataagaccacaaggtgttttccatgtctatccttgatgagaagcctggaagaggtgcatatgtccaagagtcgtgttctggagtactgaacatatatccccatgacctcatcgcttagctagttcacaagtcaaacaagttgttcgattggcgattgctaacggctgatcgagctgacagacattggataggcatggcaattttattatttaaccttcgaacagttatgctagcagatatatctatttagtactgtaatgcttactggtttagtacatgtgggcaaaaagaacaggaaaatatgaactacggttccttatcagatcacattgagcgcgtaggctgacgttgaaattttagccattttcatgttattgctattttcaacactaccaactttaatttcggcaatgccaatttcagtaaggtaacaaaattcaaacaagttttagtgtctgcttagattttagccaaaataaaccttaccaaattttggcaatttggcaatattgccaagttttgacagtatttcttatttatttactagagttggtaagaaattaaatggatgtatatatttgacaactttaccaaaaaaaaaggcattaatttgaacaagcccctagataataacctatcacatcctaccatgcaaaaatttagtaattttctagaatcttcttcacatagcttcatagaaaaatatctgggaagggaaataaactaaacaacaactacttagtgtcgacgggggatacccgtaaaccggatatatagggtattggggtccgttggcacgaggatctatgtaatacgacatcaaacaaacaaaagacaatgattatactggttcagaccccttagtaggtaatagccctaatcaagttgatatgggattatatgatggaaaccacggattacaaaaggaatagcagaactcgatgataccgacgataccgtagtcgagtaggtccaactagatctcccggcgacttggctcctatgcgctccggcttcgtaggctgtggtgggtgtgttggcggtgagattcgatgccttaggtcctgcccagggggtcccttttataccgcgggtcagttgatctccaagtaggactcggagatatcggacctctcacgatatggtaaagacccagtctttgtctgagcagaactctttccatccgtagataccatatctatcacgtgatagatttccttaatgtatacgggaactatctgtatacgcgcgggtataccgtattagtatacaacgtatatccaaggatagagggtataccttatccgtaaccctgacacttagcgttatcaaatcttaccactacttaatgttgccaaatcttagtattgccaaaaactttgtaggattgaaaatagtagtaaactaaacatgcccttcatatgtgcaacatactccccctcattataagaaaaatgttgttttaggtattaacatagtctttaagatacaaatttttattactactccatccgtttatattataagatgtctcgaccctttttctagttaaactttttaagtttgatcaattttatagaaaaatactaacatctataatatcaaataaatttagctaaatctagcactaaatatatattgataatatgtttgttttgtgctaaaaatatcgctatgtttttcctttaaacttggtcggtcaaacttctttaagtttgactagaaaaaaaatcaaagcgtgatatgatatgaaacatatatgaataatttatattgcaccttattttaaaatttgatgaactagcagtgttatgaaaaaaaaaacttttcaccaccaatctacatatatgattttttatatatccaaataaatatttaaaaggtactaatgttcaaagttccaaagattttactgcataacaatgtaattcatgaccagcattcaacaactgagggcttaagttcatttcagattatttaccggattattgaaactgattgtttgctccaagtttcaaaaatatacgttttctaaaaagaaaattctactttagacttaattttatttattaaaatatttaatttagtctcataagcaagtagataattcaaatcaacaataccaacaatatgttttaaattgaacctaagtctatgatgatagactcctacgactttcacaatttcctttttacttgagactttcacattttcgatgttcaaacaaaaggtaaaccatagcaaccttgaagttggcctaaactaccgtggcaaatttgccgatacacgctaggagggtattatatgtgtatgaggattttatgttttttttctcgattacatggaagatgcattcatacacaccactcttatgtacccgtgattgcattctctattgtacgctaaaaagacagattaacaacatctccttagttactaaaattctattctaagtacatcggcctgtacgtaatgttcactagaatttgaaccctaaaaggtggagtcacgctcacgcacccatgactcattgatcacacaactagtgcttctgtggattttatgtattctggttttgatattttccatttgtacctaaaagaatgtagttttatcattcaaaagacaaatcagtagatggaaagtaaatgacttagacattattaaatgaggagaggtgctttgtaagatggggagaaaattgaataggatggtttggaagcaaaatattaccttgtactaattgttttcttcaatgaaattttaatgttagaattgtattcttgtagtgacggaggagtatttgtaagttctactgatatataactcgtatatatatctcgtatgtggtacaactcccaatcatttcaaaatgtaattttgaagtttccatattgtgcgatacacaactaaattacattcttttttagcataacgaaaatgtgcacacacaattatacacgagaaatagattattggcacacacaacgaaaatgttttttcgagtcaagtatgaaaacaaaaaacaattataaaaatatgtagcttaattaactggttaggtttcttttgttaaaacttatccagtttaattaatttataggcacgatatgaatatttagatttgcaactaattattctttcactgatagacgacgtatgtatttcagaggtgttaatttataggagtaggttgtattgtatgcatattgatagaagtgagtgcgcgtcttttgtgagtgtctatgatttttactttttaaagaaccaaatagaaaacgatgaaggagtataagtcgagtgtgatctaagacatatcagttgacgatgaaaaaggttgtcataaaatacgtttaaaacaaaatgtccgattcgcagttaaccgacccctggtaccacagaatttgtgacccttcacattgccaaggctcaagaaataaaaggtgatctttcaaaaagaaataaaaggtggctaaaacaaatgtctgactcttcattcgaaactaaaaaatcgttgactagtagtagctctttgcaccggatctagcctaacagaatttgacccttcaaattagcaaggctcaccttaatcctcttgcgataatccatcatgaattcatgattacgaagcgcacctttgtattttaaatttcagaattgttacagcctcctctgcattgatcaggctgttgacaaatgtaaagctggagccatggcaagttgctgcagatgcgcgcgcacatcagaaaaatttgctaagaaaccacacactcctccagtggaagcataggcagccagcactgcgcgtctttgcctgatgcaaagttaggcagcacaaagcaagcaatgctgatgatcttgcggtggattcgccctccggagagatgacttcgcttccacaactcccggaacatatcccacccaaccgttacattagctgatactgattccactgacaagtgaagtgacaacatgcgggcagccaccaccaaattaaaactgttcgattgttcatcatccattcctggctgcttgcttgctagctgctgccgatccattgtcgtgtccttctcaaattcacaagttgtgtcattcgatcagaattgctcgtgtgacgcatgcgtatcccttcaaagacggctctcactgtccacaagattagatccttgttgcctaggcaggcaggcatgcgagcggtgaacatggattggggaggctagttgaatgaatccccagtctattggacgtttccatgcatgcgcaagaatcccaataattcggggaattttctcaccggccggaacggactccgtgtcacgctgcaattgcgccgaaaggctctttccagtttttctcgctgcatttcgtaggggcttagtataatcgattgcgaaggtggattccacgaagcgagctgaggtagctatagctagtgggatctttgattaatccacaggccactagcaaagcgatcgatcgatcgattgagcttgttgagcccttgctacgaacatatgcgacgagacacttgctcatatatgctttctgattcttctcctagctcttgaggatctattaggccgccaccaccgggatctgggacatgtgctgatgcttattccgatactacttcggaagtcgtcgcactggttgccgttctcccgttgcttggaaatcaactcactaaatggaaccttaaaatttgggacaagttgggggtagatatactgtggagggatcggaatacatggccttcatgttgatcagatgtgtttgcagccgtagcatgcagtagcatatatattccagattctgaaaccgaccgggaacttagcaatttagtactagcatgttattataacaagacgatcactgtgcatggcgtgtctggactgattcgtactgaaaaattgatagcacaaataacgtggatagaacatcatgaggaatacagatccatttttgttaggttgcatttcactaaccaatttagtaaaacatgctgcacaaatggttatttcgtctgtcccataaaaaaaataggatgtgacacatcctaatactataaatctgaacaaacatatcatgtattaggtttgtgtttttatgagacaggaaatattgctagcctactctatattgggcaaaactcccgacccagcgactccttccactgcctcgctcctgacccctcgtttcctctctccgctaccttgccgctgtcccaagcggctacaagaaaggcggggttgttccttagtagggacctagcttgcgccttgtgttgcgacggaggaggggggcatcgggtctaggattcctgcccccagatctggcggcataggagacgttggggaggggcgtagcggtggtggctaggcctacgcctggccaaacgggttggtgacgacaacgggtagcggtaaggcatcggtgggtgcattagaggacaacggcgggctaagcgtcgatggctagtccttggtagggagaaggtggatcaggcggaggtggtcccgtaggcagttgacactagggatggtggcggcctaggagttcgggctaaagactccttggtggcggcggcttgagcaccggtgcaaggttctcagtgaggggacggtggtacaggcagaggcagatctcgttggtagtggaggcctggaagtcctggcgtaagaggatatcctcggcgacggtgggctaggaatccgagaggcggaggagggtctgacgacgacggtggccctatgggcggcggaggcctaggaatccagcgaagcggaagcggatcatgttggcttgcgtttggtgatcagctaattctgactggacaatgacatatgaaggtggggctaaccggtggcacatggcgttagcttacttgaagcggatgaagatggcaccagcggaggttcgcagtgacgacacactaggggcggctgtgactagacgacttccacttgtcaaatctggccatttcaggagaggatgtcaggaagcaagtttgtgctaaggtagtagttttttttttctgttgttatgtgttctcctacttgttgaggtatgagtgtaagtactcttgtattattttggctgtgtatatcctttgtggaaatagagaccggattaacgaaaatccattaatcgagaagcggatggcgaggcctagcaaaaatcgagaagcggatcctaagaccagaaatttgcaagatttttgccttaaatttatgtcaaatattatttggcaattccgcatgttgacttaaacttgacctttcaacattgatagtatgatcttagttatacactagcaagttcacgtaaaagtttaggttgttacacaaaggaggcactatgcctatgctttaacactcccttttacccttctttagaaatgagccgggagcttttgccagttacagtcacagtggagaaaaggatacggtccatcttgacgagtaaatgagcggaaattgttttaaacactcaggtggacatccacctatttcttgcatgtcatctaaatggttatgaaaaattttcaaaaaaatgacatgataggataatatgtaatatatcatctcacaaacatgcaagtttaaattcgacttctacaagctgtaacaaaaataacaaatttgactgtgaatatacacatgctagttagagtttaatttgttatttttgttacagcttgtagatgtcgaatttaaaattgcatgtttgtgaaatgatatattacatattaacctatcttatatatatatttagaattttttcataatcatttaggtgacatgcaagaaacgggtggacatctacccgagagattagaatcaatctccgttaatgagctgattcatgatgttcgaaagctccttcctttccaaccaaagagtgctagaatttgatgggggcgtagaaatgagagatcattcacatctaacaacattcagcatcttttatgtttcacagtctgacgacatagcacactattttttttcttttgagaccactatcaatttgaattgggaatcgacctgttagcttagctcctaaagtctgaaatttgttttttctgacaaagaagccaaataattttagtgatgcttttgtggaatgcgttcagagactttggtcgggtggttagttaaatgttgatttaaccgatgcttagtgtgctgtaattatgagcttctactttacgtcttgtgatttttccccgttgtgctagatctgtcagaatgaaaggtacaggactgtaccagttgggcaactaacactggagtaataataaaaaggcatgcctcatcactggttcgtctagcgttagtttaaatttcaaaagaggtcgaagaaacagaatacaaatataaacaacacaattgcagttgagtggctctattcagaagctttgttaggttttgaaaaattctctaaagtttggtagcaacagcgtcaatacaaaaattcaagacggacggaatttgtctgctctgtccaaggaaaaataagtttttggcagtctgtattactgcacacaatgacacaaaccagcattctccaaggtgtttttatctcgtgaacaattgcatgatccaatcgagatagcaacactgaatctgaatcgaaacattctcggagaatctcgggtgaatgctcgatgaatcacccgtcagttgaatccaccatatctgcacatatcttgaaagcttcagtagatgcctcaactcggatatgtaattaactagtgtgacagtgtcccaggatcaccgtagctagttgcaacgaataatgtcagattcttgctggtcctggtctagtagtgctgctgctcaagtatggaatgatgcagagaaggcgacgctgatgcatctggaggaatacgagcgtggcatccggttctgggttctttgattcggcagcctgagaaaacaagtgcggtgtatgcagagctggccaaaaggaacaaactttggtggccacaccccagcatcccagattcacaggaatcctttgttccttccttgtcaagcagcactaatcgcctattactactctactaggatgctctgtttgccagattctggactttgatgatcgactcttttcttcattctgtttcagggaacccaactagtagacattcttccaccggctgccataagtgagtgcgttgtaattgaatagtctagatagatcgtttgctagctggcttatccgtaactagaatttaaattttaaaacttaattttaaagttgattttgagaatttatcatatatatatttcaatattgtcttttaaatttactcctacaacagactcttggactaacactcccactctcagaaccgaactcgcaaagggggtctatcgattccccattgcagaagctccgttctccgatacacgtaaacattacgtcattcaaaactggtcattatactattttgggactatttagggcctgttcactttgatgccaaaaaaaaccttaccaaattttggtatagttgccaaaattttggcaaattttgacatgatttcttatatagttacctaaatttggtagcaaactaaatgtagccactttttttggcaacgttaccaaaatttggtaaggttgaaaatgacatcaaagtgaacaggctcttacaccgatttaaaaagctgagaatgtgttgtacttagttttaccgtagaaaaaaaatccaaaacgaagaaggaattttttttcctatcttgcttgttttgctgggccgatattatcttcttctatcaatcatagacggaataagttcatctgaggtctcttaacttgtcaacgtcgtgtaaaatgtggggcccaccatttttaaattaattttttggtgtaaactgatatgtgggcccacaatttttaatattttccaattacattgccacataagcgccacgtcatgtgaagaccgagtcaaaatagccacgtaggcgttacgtcagtgaaaaccgctatccaaaccaccatgggacctatattgcaccggttttaaaagttgagggacccattgtatctgtttttcggttgaaggacgaaaatcggatttgttgacaagttaagggacctcaaacgaacttattccatcacagactccgtaccccgggagtcagagttggcccataactgacactggcccgtaggccgtagtagcttatcggttaacaatctcatgggctcagttttcaacagatcctaacatccccgtactatacgagtctacgacgatgactatgctgcaaagcaaaggaaaaggccagtaaaccatatctttcgctttcgtccgtataagcacgaagaaaatgccaccaaacacgcccctcgcgtttgacgagatttctgaagcaatgaaaccgtcacgcttcctagaaatcttcccgaaacgcacggcacgtcgaatccgtgatgaatcgctcgcaccctacccaacccaaccctccccgactcgccgctccacgccgcaggcccccgcgcgcgcagaggcgtaggcgagcgagcaaacgacacggcacgacagtacggcaccaaaccccaaccccaacaccggtcgcgctcgcgtcgcaccgccccggcagccaagagagagaagcccaggaaaggccaaggtgatcgacgagcgcacgcacgcacgcacgcggcgccgtcagaaggccagagcggggggagaggggaggaggggctaaatcggggagaggtctccgtcatctccgactcgcggcgcggccccctcgccgagaccgacgggccgacgcaaccgaggcgagccagcgatcgagcgggcggggggcaacgcgtacaaaaaaaccccctccccttcccttcccttccctctcggtcgcgtcgtcgcgtggtcggcgaatattcgagcggcaacggcataacaccattgtcgcccgggacgcgcgctctttctctctctctctctcttcctggcgatggcggcggcggcgggggaggaggtggaggcggcgcggtgggcggaggcggaggacgagaggaaggaggggctgcggcggcggcggaggtacgggcttgtggagtaccgggcgctgccgggctacatgcgggacaacgagtacatcctgcgccactaccgctgcgagtggccgctcccgcaggtgctcctctccgccttctccatccacaacgagaccctcaacgtctggacgtacgttccctcgttcctttctccgtctctcctccccccctctcgattgattgtgcggttgaatttcctgtcatgtgagaaggaggttaagttgttcattgcacgggtaatgcggtggaaaggagatgtgacatcgatttctttcatggatggatctgttatacggagcaaagaaattggtctatagatcgggcgttcgaaacatctcttgtctgcttgtggatgctatagctttatgtttcaggctggataaatcccatacaacatatttcttctggcattgggtatttgaagtctgaatcttgaaatattaggctgccctcaaaatatctagccattctgtagatttttgctcttgtgcttatttactaatttatttatttattttatttgaatattctcaatagtgcatagttttgtagttgtgtaaattagggaggccaaggcttacagtttctaaacagtctggtattcaatttacctacctttctctctactttaaagactaaactcaatttgctcatatggattctcatgttgcaagctgacattaatttgaaagaaacgggcaaggaacttcaacaactagaatgcaatagagggacgactcccagctggaaaagccttcgttttgtacttgactgttcatatcatgcaacaggtcacaggaccacctaacttattgaaagaagtcccctgtggatgatttaatgcgtttaattgtagtagttaatggaggacagtggtctagcagtatttcttttatcgggattgctatatgtcattcgaatgaaatttggggatgaaatcttacagattttggaccattggatccatgccaagattcgtgcaccaccttctctcctccaactccggcgggctccccttcttctccggcgccggcgacaccccaactccggcagggagcatacgggttagggtctggggttggggtgagggtaggaggggggttgggggagggggaagaggggggtttcctcggagcttagagggatggccgtgggcggtgtacttcggcgaggcggtggcggcgccgccgaagccgcagggatggaggagggtggtgggccggcatcggcggcgggggcaaagcaagcgtgtggttaggaggcggcgggcggtggttgcggatccggcggtagggagccgccggagacggggaagacggcggggcgggggcacctcgtcgtcgccgcctcgaggagaaagagaggagggaagggggagggggcctcgccggcgccgttgaccccttccggccagccggcgaggcgggcagcggcgcggtggggcgatggcggtggcagtggtgggggatcgcgcgaggacgaggagtggcggcagcgtgcgatctgaattgggggaagaggagaggagttagggttagagtggtctacacaaatcttgaagcatatccaatggtccaaaattcgaataataggaggtggcattttttgtcacatgatatatagacagccccttcttttattgtattcgttgcatatatatatcgagctcgaatggagatcaagcaatttgattggcatcatacaacgtttatttggttactgttatttaaaagttatgtgctcgtatggagatgtatgcattctggaaaattatgactgtggcaagtgcaactcctaggcgacatttttttatgtaaaaaagttatcaatgtgattaatgcaggaatacgtctgctaagttacttttcctgatatactaaagctgttttttaatttgtgaactcaggcacttgataggatttttcatctttcttgttcttaccatatacaccgcaacacaagttccaaatgtagtagatcttcaaagtctgcagcatttacctgatgtgctgagaaacgctgatcttcataagattcagacagaacttgtggcatgccttccttcgttacctcacctttctgacttgcaaaagctgaaggatgaattgaaaagctcatggaattcaattgaggtgcttccatcattgtcccgttggcacctcttggagttactatcaagttgcttgccgcacagatttactcattccaatgaaaccagtctgtctgttcttgtaagtagtcaacaacttccctagtttattactcacttattatgctactagtatgttatttcagatatcgcaaaattaatgataatatgctggcacaattttcaaccggaaattattactagggatggaatatcaattcgcaatcgtttggtttcttagtttatgctagttcgtactgatctgatttcatctgacttatgacaaagtttaggccatgaccatgaacaaaagttgagtttatgctagtttaagctgatgctgacgaaagatttggtttctataccatgaccagtaaaaaatataaaaaccaacagattcctaggcaggtcactgctttactggaaaatcaggatcattaagaagttgcaactttatgattttgagaaccctttgtttagtcagcactcattttattgaaggtgtctagttttacaaacactggcacacaattacacatacagagaacaattgtatggtatgactagattttatctagacatttttgtcttcagagatagcaaataacattttctcacatgtgattatttgattgaaattttggagtgaaggtcattaattcagtccccgtcatcttatatacccccgttttttttttgttttatgcagcaaagcatgaaggaagatatagcaaacatgattgcgccacagttgattaggccaattccgagatggccattttatgccttcttgggaggagcaatgttttgccttcttgccagcagcacatgccatcttctctcctgccactcccgtcgccttgcatacattatgcttcgccttgattatgcaggcattgctgctcttatcgcaacatcattctaccctccagtatactattctttcatgtgctatccattcttttgcaacctgtatctcagctgcataactattttaggagtggcaactattgctttctctttactccctgttttccagaaccctgagtttcggaccatacgagcatgcctcttctttggcatgggtgcatccggcgtgatccctgtcattcacaaattgatcctcttttggcaccaaccagaggcattgcacactaccgcatatgaggttctgatgggccttttctatggcattggggcactggtgtatgcaactcgggtgcccgagcgctggatgcctggaaaatttgacattgctggtcatagccaccagctttttcatgtgttagttgttgctggagcatacacacactatcattctggactggtatacctcaagtggagagacgtgcaaggctgctagaaattatctgtgtgctcgtaggatgtggatagattgtaggtgccctgcttgtgtcccgaaaaagaggaccgctgattctctctcgtcttcagaaacaaaagatgactgttgttgttggccaaaagactagacctggtctgttgtaaaatgtaacggaggacttgctagtactgtgagatacaaattgataatgagtgatgatcggtacctgtaaactgtggtgtggtattggctgatttttcagggtgcaactcacttgataaatcaggccctattattcccagaaaataactattcagtgataccacagcccctgctgtgcatcttgtgccgctatttatcagcttgctcaagttcaatgcatacataaattgtgtttacaataggagcttgggaagtgaaatgaatgttcaggtaatgtccctatcgaacgaccaccgaaaccatcatcattcatcaccaatcatgagatccactccccgatttgctacggttgtgggcagcaaaacgaaggaaaccaacggcctcaccggctcgcctcgcctgtgcggtcaccatcaccggctcaatctgccattctgccgcctccaattctccaagaacttaaggcctttggggctccacgttgaagtcggatgtgtttccttgcagctagtacgatgtattgctgctagtatctactcctagttcacaggccgtgctgctgattttctgatggactcacgaagtcgcacacgtacgagtgcacgttagagacgcccgtccaagggctatattgcttgatggactcatagctgtgggctgttcagatgagtaacccatttccacccatcgtgccaagatcatgtgccggcccgactgcgatggcgacacacaattgtcgattgcctaccacaaacagctagatcttgaagaagaagaaaacgacgagatttttttttggcatctcgactgcgcccgctaagccgtgacgttgatcgtgatgaaaacttgacatgtcgagacccagagacagctaaccactataattgctgtaggtggcccgtattctcgcctcgcaacaaacgcacccacacatggatctcctccggcgagtcgccgtggtagccgtgctcctgtcgctgccgtcgcgtggccgctccggcggcggcggcagcgatctgcacccggtcgtgctcgtgccggggtacgggtccaaccggctctacgcgcggctgactgcggcgtacgagccggcggcgcctcgctgcggcgcgcgagaggggaaggatgagtggttccagctgtggccgatcgacgcggcggcgagcgaacccgcccaggccccctgcctcgccgagaagatgagcctcgtctacgaccccgtcgccgacgactaccgcaacgtcgccggcgtcgtcaccagggtcccctccttcgcctccacccgcgccttggttgggtgagtatcactgtgtcacgctgtcactgtgtcagagtatgtcttacgtcgtactaacaatcgtacgcacgtgtatcaatgcccgtgcatcaccaggtagatactcctagatagatgggcagccaaaatttatcggaattgctagaaaacttgcgacagttttctccaaagaaaacagtcgaatttgcagcccttagatccgctccgtgattcatgcgggcaagaaggaagaaaacagctaaaaatattgtcatagacaggagtcgaaccaaggccctccccttaaaaaggacagcataacaaccactaagctagctcaagtatacgttgaatgtgaaattacattttggttacattttacttacgctttaattaactacacaattagtcccctgttttcatctaatttttggataatcttgttatatttcactctcttacgggcttgctagcaatgacgtcgctgttggatgcaaaggctaaaaaagtttgaatgtttggtacctagtttctgtcgaacgtcctatacgtattcacgtgttttaatctacttacatagcacttacactctagttacatagtagttacgtagcacttacatcctagttatatagtagttacatagcacttatatcccagttatatagtagttatatgatagttatagggtaattacattatataaaattaggatttacaatttttttaagatcatgcatattacttttgaattatttttcccttatatatgttgaacaaattcttaccgttgaatcaacctaggcataagattagtggtttgtacttgtgtggacccgtttcaacagatcctatggttgaaaaatttgaaagttttgagtctcaaaaactgtcaacaactcactagctacttccaaatttatttactatttatttattcttgtctgactggcaggtgggacccactggtgcggcagctggaggcgatgggccaccgcgacggcgggagcctcttcgccgcgccctacgacttccgctacgcggtggcgccgcggggccacccgtcggcggtgggcgagcgctacttcgctcgcctcacgcgcctcatcgagagggcgagccggctcaacggcgggcggcctgccgtcgtggtggcgcacagcttcggctgcgcgctcacgtaccagttcctgcgcgcccgcccgctcgcctggcgccaacgcttcgtcaagcacgccgtcctcctggccgccgcgctcggcggcttcgcggaggggatggacggcctcgcctccggcgccggctccggcctccccaacctcgcgccgccggcgagggccaggcttgcgcggagccagcagagcgcgctctggcgcctgccgacgccgatggtgttcggtgaccggccggtggtggtgaccaagaactcgacctactccgccaacaacatcaccgagttcctcgacgccatcggcttcacggaaggggtccagccgtacgtgacacgggtgctgccgatgtggcgggcgctcccggcgccgatggtgccggtgacaagcatgtacggggtcggtgtcaggacgccggagacgttcgtctacggcgaagctgggttcgaggggacaccggaggtggtgtacggcgacggcgacgggaacatgaacattgtgagcctgatggctgcggaggagtggtctggggtggaaggccaaatcttgaaggtggtcaggttgccaggtgttagtcacgttggcttcttcagcgatcttgctctcaagaaagtagttgctgaaatacagaaggcagttagcagcatagaggtacacaggaaagagaaaatcttctcttttctgaataattttgaatttacaattcctgtgccactaggatggtgatgtccatatgtcattactgatccgtgcaaataaataatagcaataattttggctgctgtaagtaggcaatttatgggtgactagaaatgatatgattttttttagataagttagtttggtacccctctaactatggttgattgtcggggtctttactgtaacagtgaaggatgttgatgaagccgaaagatgcacgctaaggctggggctctttgatctcggtattgcttgaagctgctgagaacttgcactccgaggtgggaatggaatgatgctggcttaccttgcgaaggattctgatcttagtgttacctatagtgtgactgtatttagtttctggtgttgctgcttagttgtctaggtaggctagttgcttaagaacctcctgtcttttgggtgacctatgtgcccatggtgcttaataggtaaagctggttttgcctaggtgggacttatgtttctgtgagaatgactaaagtttagtccctccttcccaaacactaccctagtatccatcttttttgctttctaaaaaaacagggctatgtaagagaactcttttaatcacttgaattaacatccacacgtttattacatattaattagttatgatttttaaaaaatatcaagataaattaatatgtaatatatcacttcacaaatatatacaggttcaaatttccaacttatacaagctataaaaataataaatttaactataaatgtatatatactacctagagtttaatttgttactttttataactagtcgtcagagtacggaactcctttaacaggaagctatgcgctccctaggtgagtttagctagggtgcaagtttcaagctcaagtcatgatcctgcgaagggaataaacacaagcatgtatacatattcggctcgtacggatacgtaataccctattcatgtatggtggacgatggatggtgaagaggattacaagtaagatatgaaagattctaagtgagaaggagaagatctttgctcgcacggtgtttggctagtctagaaatgtgaacccttttcacggtggtatggatcctccttttatacattaagtggagtccacaatactattgcacgcatgcaggagtgggtctcacttctctaaacttaatatacttactcttgttgttgtcacttcaagccagttggccagatgtgacgaccacagctactgattgacaaatggagtagaaaggcaaaagtctttgttccaacttccacgggtccacgtgttagcaacaatagtccacaacggtgcccccgaagggaggatgttgaggacacaccacgtcgtacgtctcgttctcttcgggacgatgtgcatgcaaggcactacatgcacagccacatctcctatatttgtggatgagctgtgcaccgagtttgtaccaccccataatcaatgtaatgtgatgatttaaaagtaaccacggtactaagtcaactctccttaatagggtaacccctctaaggagagcctagggcgtcctcaggaccctaattagcttgcttatttgtgtagtgatgtattatatattaatatatcatgtcattttagaaaaaaaaagatagaaatgtaggatatgtacatatactagttaaaatttaatttattatttttgttacaacttgtagaagtcgaattttaatttgcatatttataaagtgatatgttgcatattagtctattttatcaaaattttattattaatttattatcatttaatcgatatgtgataaacaagtggacatccattcaggtgattagagtccctcttcgggctataaacctttcctcttaaaaaaaggtaggatattttagtttgctaccgtatagaatctttgccaaaattctggcaagacaaggtggtctggtcagatactcagatagcaaaggccacaaagctccattggaagtgtggaaattttggtatggttcaaaacttcaaattgcatcgattcaaaccaaacgtgcctacgactctttgccacccaacgaagcttcaatagagtcaggacagacgggctaaaatagttgggctttctggcccaacatcagtcatagtcggcttcgtcagcctggatgacagccgaacacttctctttatcgaacggctccagttatctcgtcccctgacaaatccttgtttgggctctatagatgataggcactcttctaacatgggctgcccatgtgcacacgcccatgcgctacttggcacaagcctggaaatcatcacttcaacgaagcaacgaacacttgcccaacatgaaactgtcagatgtgcccgctttcgagtcgtctacccaaggaaatgtccctgtagcgcacgaacacgacaggtcgcgattttgcgagtgctcgtcgtatcgttcgtcctgtaacgatttcgcgacgagacggagcagcagctagccatctagcgaggaccaccattatcccgcgggccctttcgatgggcatctttcggccccattaccccgcgcagtgaagttgatggcgctaggccatccgggtccagccaatcggaggaggggagatgggcccggatgcctgtgtggttccaagtcctgtcgttggtttggctcttttccgccacttccacggtttcaaagcaactggatcttctgcagatcagtacagtggagttagctggaggcctggacctttgatttcttgagattttgctcaacataaatggcgcaggttatctgtcgtttctttttctgttatggccatgggtgtgagtatgctttaggtctatcattttcatcaaacctttgtgtccccgtcagtggtataagctatttagaaaagcttgagaaattcatgtgtttacttccggacattgtgtttttgactagtccatttaaagctatcttgatttgtagggaaaacatttgaatcttggaagatttcaatctatagaaaaaaaatcttatgaagtactttcaaatagagaattgaattgtatcctatctttagaaattactatgaaatcgacaacaaaaagttagcaagagcttaaacggattgaaaatttccatgtgagaatattccatttgttagttcttacggtctattcatacgatcattcttatatttttcgaagtttgttttgcaattgaatttctatcaaaattaaatattttttctattcctttatgttttcgatcctgcattttaaagagctttagttgatatttttttccaccgatcgattcggtagcacctgatggacatatattttctttccaaaatggtccagagcgggaatttcttgtagcgtatagccccaagaccgtgggatccataccagccaaacgagtcccctaccggcagggcaagggaagcaatcaaacggatccacgtccactccgtcagttcatctcttcaccaccacccacctctacgaccacgattactcctatcatcttcctctctctccctcttcccatccaatcctgttaacaagtgttagctgagaaaagaaaagaagcgaaagcgttgctgctgctagctacaaaaacccgaccagcactggtccttgagaaagcgaagtgcaacagatcgatcaaacgcttggtgaggtcacggtcaaagcgaggaggaggggagcgaggcacggaggaggcagcttgcaaaggtggttggcagcaccgagaaatgccctcctcgattgctgctgctgctgctgcgtgccgtccccccctcaccctcccctcccctccctctgccttccgctgtgctggcccatccgcccatggcacattggcatggctcgctcgctggctgcatcccccaccccaaaccttggaccacattgaccggtcagacaagaggcctcaaccccaccccgtccccgcgcggcacactgcacaccgccaccccccgtgcatgcgacgccacgcgctacggtttccgtctcctcgtgagccccagcgccgcacaccacacgccctgtcgcggtgtcgcccccgtcctcctccggattagtagcctacgtcgctgcctccggattattttgattactactactagtaatcagaccctgtttacatccctgataaaattttacacgctatcacattaaatatttaaataaatatatgaagtattaaatatagaaaaaaaaacaaattacacagattacgtgtaaattacgagacaaatcttttaaatctaactacgccattatttaaccatgtggtgctacaataaatactccatctgtactcataaagaaaatcatttaggacaatgtttaagtcaaaccttgggaatataaatcataaataactctcaatttattgagtttaaaaatataaaaaatatataaatagatttatcatgaaaaataatttgataaaagtatacatgcatcgcctggagcgtagcgtgatgatgatcgtagcagcagcgcgcggttaagttattgctgtttgggtcgcgcggatgccggtgcgggggctggctatctcggcgagggggaaagcgaccctgtctccctgatgccgcgctgatttgttttatggctgctcagacagctgctgttcttctcctttgtgcttgtggtactagagttgtactatactaccactaccaattggagtattttagccgggggggggggggggttagagcaagtttaatagtagagctcactacttactattagttaatgttaaagctaacatatatagtatgttggctataaggttatctttattttcttcatcctctctctctctcaccatgaatttaatgcatattttttagagtttgtgtgcagttagctcttgcatgagagccaacactctctactttttttatctctctcttccacataagcatatagcttgcttatagcccactattatcctttttatctctctctttcacataagcatatagcttgtttatccttactcttataagatgctcgctttctgcctctcagggacagaccggattaattagcagcgcgcgcatcgcacaggcttttgacagttttattatagtgctgctgcgtcgtcccagtgaccgtcagggcggttttggatgcacgtggacgctgacactaacctgaaagatgggttcaaggtgggtgcgtacccatgctagctcaatgccacttgaattcacaaatgtttcgcccgggtgaggccatgtactgtagtacgatggtttgattcaggtataggaaagctttgaaagaaatgatcgtaaaactaaaaataaaacctcgtaaaaacacatgcataaaaagacagaaaccaaatgccatactaattggattcctatgaaatttcataattcacaaaaaaatcaaaactattgttcgattggcacgcatgaaaatcacaagaaatcaatacacctgaacaagaaaacatgaggtgagatttcacttttattcttagacaaatttgcttctgctattccataggaattttacaagaattgctagaaatcgatcatttgtttcaaaggatttcatagagttatttttctcagaatacaaatcctctataaattatatggagtgaagtgcatgagcggttcttaaacttgtacggatgtatcatctatatccataaactttcaaaatgcatttttgggtctccaaacttgtcatgagtatcatatatgtccaaacaggccccaacctactccgtgaggtgacgtggcatccatggtgacgcttatatgtcagtgagatccacatgccagtcatatagaaaaaataaaatttaaaaagaggggggagagagagagagagaggagaaagcgatgtttttaattttgaaaaaataaattaaaaaagagagaagaaaaaatatgttcttattttttttctatatgtgttgacatatgggtcctactgatacgtaggcgctaacgtggcatgctacgttagcacatggagcaggttgaaatctgtttggacctatatgacacctgagacaagttgagggatccaaaaaattcattttgagagtttagggatctaggtgacacatccagacaaatttaggggccgcccgtggactttacttaattacatgttattcctttatttcaaaacccgaattttttattcataataattaataatgcagaaattaaatatataataaagcaaagtcattttttacgaaaatagaaaggacgctattgcatagggcgtccaggtgtggacgctgttgtagacaacgtccagatggggacgtttcttacaagggcgtccataatgctgcagttgaagaccccaaagagccgtccaattcaccggactagggcctgtttggttggtgccctgagtgatgagcctgagaaaaaagcatgcctgggtggaagaaaatttataaaatgttttccctgatcaggcatataagagggtttgttgtttggttggtaccctggacaagaaacgagcctgagagcatgaaaccatgtgaaagcaaacaagaaaatataaaatattgcattctcaaccggttagtacaagtaaacattctgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcaagcttcagctcaggcgaatttgcttcagggcagcaaccaaacagacccttataagattggactttggaaccaatcacacaatggtcgaactttgcctcgttactcctatgcagactattgtctctcgttgattgcttgcttgccgagcaggcaccgctctctacctgatctgtcagacagggtcgccatcccccggccctccttcaatgcttccgctgttccgcatgacggacactctactcggggtcatatgtgaacagccgccacttttattttgagatatttgattagtttggtttttgttctggtccattgtttactacgcatcgagctctctgctgactgaatcttgagaagcagtcgtcagatgaactgcatgcgaggtcttcgatcgatgcttttttttccttttgcaacaggccagagattggaagtcatcgggcgacagatgatctgatagaaggaggatgtttgcgtcctacccttcgtaattttgcattctttgtaaactttctattgcagaacatatacacttgaataccaagatctatgaactgagcatacttgctcggccagccatctggagtgaggcgatgcctggacttgctgttaggaaccaagaggggcggacagacgacgcaacacaagccggcacgagtgggttattgttccagcatgactcaaccagaacgtggatagcggctgcaacctcccggcgtgaaggcagaaagcggcggcgtcctctccggattcgagagccttcgaggtgagttgaggtaaacggcagattactgacgttgtggagacagaagccggaaggcggctgctgcagtctcccagagtcgaagtgaacggcgggcatggcagcaccttgcccgagccctgcaccaacattgggcccgaggagaggagagttgacgatggcgcctctccgcatggcggcatgggcaccccaaaccgagcctggacgtgcttcggtacagcgtccacctctggacacttcttagaacagcgtccaaatctggacgccctttgaaacaacgtccatcctatttttacaaattcaatttaagatttaccacttatttaattcaagacttattaattactataaataaaaaattcgaaaaccccaaattttttattcataataattaataatgcagaaattaaatataaaaaattcggtttcaaaacgacttctcatttctcaaatcatcaaattccctatgttttgtgtgtttcaagtcacctttgtctccacgccctgtaattccagtactctgctcaccattggttggtccttgcaagttgcaaccgcttcggagaaaaacagctggtttgcttactgaaaaatcaacggtggctggagcaacgtactgcgtaccagtactactactccaccaatatactcggatactttctccataagtcagagatatatttcttttatcaccaagaaatatactccctccatactcgtaaaggaagtcgtttaggacagtgacacggtctccaaaacacaactttgacttttatttctataaaaaaatatttattgaaaagtgatatatatatatacttttataaaagtatttttcaagacaaatctatacatataatttttacattttcaaactcaacaacttgatagttatttatgatttatattcccaaggtttgacttaaacaatgttctaaacgacttcatttataagtatggagggagtactttattcgtctcatattaagttaatttttagctcctttagtttatcccaaaataagtttatttttaagaacaatcattgtattgtagcttgtaaaagtaaggactagttgtaatgggataagataatgcaaggaataattgtattggatttgataaaatataggcattttactattgttggttttatattggtatgtgtggaatgagtgaaaaaaatatttcgggatggatgtagtatattaatatatgcaaccaataaatattaaaatgatttcttgggttctttaaccgtttaatttagtacatcaagattacaaataggtattaaacttttaggaaaaaccaaaaaataaaatggatcttagacttttggatgaatgtctgagtactactcatatatattttatttaatgtgagtatgtattaggaaaaatcaagaaaatgcactttaactctccatatgcacaagaaacgagagtttaacaatctctaaatacttgcatgcatgcatacttaatttgtatataaagatgtaataatactacatgtgaaacaagaaacaaaggatatatgatgattagtttcgaatttctaatttttgatatgatgatcagtatggagggagtactaacgttactttgtcacgtcaggaccgtgcatgcatggtgcccatgccagcaggcgaccggttgccctgtttacctgtagtcgggcaaaacggaaggcgctcctccctgcgctcgcacgttgggtcagtcagtccgctcgtcagtcccttccgacttccgtccacccatccgtcagcccacgccacgcgcatgcgctgtcgtgcgtgctccgtcctccccccctcccgtccccgtacgtcgctgctaccgtcgtccccgccttttccaggcctcgctgcagccaccccggcgccgtttcctagccagcggcgtcgcatgcctacgccactccagggcgcaggcaaagccagcggccggtaggcggctgtgcgaagaggaagacgacgcgtctccatccgtccatcgaccgacccacccccggctcgctccggatagacttgtcgtcgttgttattcctgccccgtgtttaatgcccccgatcgatcgcttcgattcgccctttgacccgggtaatctgcagggtacgtacgcacggggtacgtactttgcatcgcatcgcatcgtgtggcagctgggcgttgagatcgtggcgttttaatttttctgtactagtactagtaggcgtcgtatggagccgctgtgcacagcgtgtggccggtcaaggagctcgctctggacatgtccggttaggctttactgtttcgcgtactgttacagacttttcccctttgtgttttcctctttctccttttgtttttcctcccttcgttatctctttcttttgcttgagagaagaaatctgtcctctcgtggtctttggtcttggtcattaagacgtccttccgcaagaaagaggggctccaacctggcatcaatgcacgtgtgatgttttgccaacctttttctctccccctatccgattgtaacatcttttccttctttcctagcatgtgtgtagatcggcttccccaaagactttaaaattcaaatcaacatcgtttcctataataaccctagtacacctgataactctcgaagagtgtttgataaactagggaattgtaatggaagacactaaaagtatagttaaatttgattaaattatattttcattgacacagttttcttttataccaaatatatttttaaaataaaattggatttcatatataattttgagctactgtttctctatataaaattgcactttttttcagtaaaaaaattgtattgtaggagtatataaatatattcaccaatttacaccattttgatttggacccaacataatctaatggtctaaatatttttctttttctctcattagtgtaggaatttctgacatctagagtaaaaaacatgtgcaattttttagctctattaataatataagtatgagattatcaagtgtgaattgaacggtgctacaataaaaagctagaattatattcaatacacaacacttgttttattttcatagatactattatattgtatttttgaccaatgtattttaaaataaaattttatttaatgtacaaaatttagcttctgttttcatagatacaactactatatcatcgaatcaacgttgttacgttctgaaccacgatcttatcgtctaaattgttttgttacctgtggttttgttttcagggctctaaagcaaacgttgtggtttacttttttttatatattttgaaaaaaagttcttttaacttttttagtaaggtgcagattgatattccctctgtttaaaaatatatatttaattttcacttatcccatacactcaataaaaaaacagaatacccactttaatcaaatctgaatgcatttactcattaattttacaaactccaataaaacaatcaattaaaaataaacagattttgagacaaattaaatactcccagatactcacaaattaaatcaattcctaagggcacccgcaatggttatcgataggctctctacaaaagatctatgtcagcatattttcctacttggaaaatattaaatagagagagaataaagctatctactaactcggagatagtctatagagaaaaatgaaacaatggattagagagctatagatacccatgtaaacatactattgaagtggtttactattaatctagtctattgctgagatgtacatgttctatagatagcaccttactttactattacgggtgctctaggttcccatactcgctgtagaccaaagagaacatgatgagtggagtatactgtgaaaactgataacaactgtgctgccagtctgctactcgtactgaagtttagcatgactgctccagtgattcccatggatttgattaggagcggcgattggctagggtttgaaactttgaaaactgatctgcggcgatcaatgcgcggtcagagctgccctcgggagagcggaacggtcaaacgggggccgggggcaccacctccggtagcgtaacgtgagggtcgcgtgccacgaggagaggctgtttgcttcggtgatggatggtgatctcaccgcacgtgcggtccgcgtgccgagaccaatagtacagtgcacacatcacggcatcacgctcgcttccgtctgcgctccctgcactgctcccattttcccagaggtaatatagatttaaaaataaaagcagtgtagtgtgagtttaataaaagtaaaatatggaggcggcaccatttgtaatgggaatgaaaatcacatcaagcctagctaacgcaccattccctgctatagattctactccatcttttgttgttgttgttgcgctttggcataaaccaatttcctcgtagtggagtagcagcagtgaaaaagaaaaaaaaatcaaaaatcaaaataatataatgccagtctgcatgagcagaaattactccataaaaaactggggagaaaggaccagctatgggcccacctcacaggcagcttgtcagtgagtgtggcaatgtctggtccccactcttctaatccaatcccctcactagtcctccctcctcggtcatcagtcatcccaacccaaaccaccaaaatgaaaagaaaacccaaataattccatcaggatattcttgctcacacatacacacaccctctcacaaggtcacagactcatcgcccttgcagccttcctctctctcctctccacccactctagcttggcttggaccagatctcacattttttgttcagtttctctccacgccaccactccctcctccctcttcctcttccccttcctcctcacctcccattccctcagatcttcccccatatctctctgtctcgccgcagtccgcctcccaatctgaggagcttttcttcagctcaagcttcttgctcgcttgctctctactatctctccttttgactcgtggccaagctgcagaggaaacccaaaattccaagaaaagcaacaggtcaagaaagagggaaagctaaggtgagaggagatgggaggaaggaaggaaagaaagatggtgatgatggcgataagtcgccccatgattcgcgccatcattccgtctcgcccgaggccagtgcgctggtaaaagggcctcgccgtccgtccgtccggccggccgtgcggcgcgcgtggaggaggtggtggtgggtgcggaggtgcgtgcgtgagaggggcgtcttgccacaatgccgcagtaccaggagcttccctgcggcgggcaggtgctcgacatcgacaccgcgctcaaggacggcatccttgggggtggcccggagctcggggacgcggcggccggggacggagggaagcagccggtggagctgaggaagatgatggacgagctggacgcggcgggggacggcggcggggacgaggcggtgccggcggtgttcatctgcccgatctcgctcgagcccatggtggatccggtgacgctgtgcaccgggcagacgtacgagagcgccaacatctcgcggtggctcgccctcggccaccggacgtgccccaccacgatgcaggagctctgggacgtcacgcccatccccaacaccacgctccggcagctcatcgccgcctggttctcccgccgctacacccgcttcaagaagcgctccgccgacttccacggccgggccgccgagctcgtccacgcgctccgcggcacggccgtcccgaagaggcagcccctcaagggtcaggccagggtagccgcgctccgggagctgcggtccctcgccgccgcccaccagtccgtgaccaaggccatcgccgaggccggcggcgtcgggctgttgacctccctcctcggccccttcacgtcacacgccgtggggtccgaggcggtcgccattcttgtgagcggcgtgccgctcgacgccgacgccaaggccgcattgatgcagccggcgaaggtgtcgctcttggtggacatgctcaatgagggtgcggtggacaccaagatcaactgcgtccgcctcatccgcatactcatggaggagaaaggcttccggccggacacagtagccagcctgagcctgctagttggagtcatgcgcctcgttcgagacaagcggcatccggacggcgtcgctgcggggcttgagctgctcaattcgatatgcgcagtgcacaagcctgcaagaagtttgattgttagcatcggtgcggttccgcaactagtagaattgctgccagagctgccaacggagtgtgtagagccagccttggatatcttggatgcgcttgccgcagtcccggagggtcggatagcgctgaaggattgccccaggacgataaccaatgctgtgagattgttgatgagggtttcagaagcatgcacacggcgagctttgtcaatgctgtgggtggtgtgtaggatggcgcctgaagaatgcgcgccggctgctctagatgccgggcttggggccaagcttctcttggtcatacagagtgggtgcggaccagagctgaaacagcaagcgtccgaactgctcaagctgtgcaccatgaattgcacatcgacggtattcatctccaagtgcaagcttacgaagacaatccagtgagtggagtttggaattgtgctgttccgcttgtgatttggtcgatggtgaatggttcacctgttgggtctcacataatctgaagaaatggcagcaattagcaattggcagtcgacagcgtctatgtatagataaactttgcagttatgcagaatttgccatgtcatctgatggcataagggtggatgatatgagtagattgtgagacctgtggccatgttatcactgtccagcgagatgatgcgtatcgcagcattcaaaatgcagcatacacacagctaattcagtggcaagcaggtgggatgtacatgcaaattgatgaggattttggtcagctcaataagcactcgaggctgggaggtggtaagtacagccagttttgccattggtagtagaaaaattaagcaagaaacctgctgttttagattttcggcaatgtgggtctttcagggctgtagatgttcttcctttttctcatcttcggtgtaattgatggtataaactgggtagaattgtatacagtactgttgcttcataattgaaatacacattgccataggccatatcttggaaaaaattggaactctttgctgcatctttcattgctttgatcatccagtaaatttttcaaggataacctttgtcctgtagcatatactgaaaagcttcaggcggcgttcctggtgctgaaattgaaacagtagaaagacgaagtccagtgtcagcttgtgctggtgccacaagtactactgtaattaacaagtatagtatcagatggcccagtttgaatctagagagcataatcagtcaagcaattgtagtcttcttgtagatttagccgcacactatccttaaaaagggagaaaacagataatttggtttaagttcttttctgatgattcagcaaatagtcgagaattgccagtcaaggttgacaacaacaccaaacattcattttcctggattgcatctactagtactctcactggaaaagcgggtctttgtatatttcacatcagggggctgtcttatctaatctcagggaaaaaaaaccttggtcatcagcaaggacagataaagccatggcaacgcctagcatagggtcactcatctatgatcaggagtaggctatgctcagtactttttccctttatacgttgccaatcgtaaagcagatgatgggtgctggtgccgcacaattgacctgtggaatggaagcaggatgaggaagtgagcgcaccatgcatgccatgcctcgtcagtctcctgcttttgccatgatccgcgacgtgacgtaccgccctccatgcaccgcgccggcgcgcgcacgcacaaacgccacaaacccacccgtcgtccgtccccatttccacacgccattctccggtctcgcctcgcgagaaaaaggtggactcgcgggccagcccaaaccatgtggcgtgggcacccccacctctcctctcctcgcctccgcgcagtcgaacgcgaggtgaggtgatcgcctgcccaaaggctggatcgggagcgagcaggaccacgggcatgcgcgcctgcctcctcccgttgatggatggacgacgactactcactgattgggtggcgctactgtgccgagcacaactcgtacacgggagcgccaggattgtggtagtgctggtgcctgtgtacgcgtactctactcggacggacactggagtgagtgatcgagtcagctgctgctgctgctgcatgcatatgtgtgcgcgtacattttgcctgggggcagaggtcgccgggaacgaacgctgcaatctattcacaggacgtggcatgcattcgccacgacgcgagaggggggcccatggtcgatcggctgtacagtacgctgcactgcggtgctgcagccccgtcactaacggctgatcgatcgatgctagtagtagctccatgtgcaatgaatgctggtgaggtgttatctgaaggaaaattttctgccggcttggcccggcttgttcgctcgctcgctcactcggagctgaaggaaagaacacatggacgcagagggaagatgttggttttgaaatttccggcatcgtcgtcagttccccctgccccgccatctccgttcgccggtagagatcacatgagctcctacccccgaaccagataacctcgttgtgagcttgtcgattatttttagacagacaggcttcgaactttcaactttcaagcgcaagctgccgctaggatggagggtgcaccgtgcacgtcattgtcagcttgaacctcatcagggattttgtctgatactcttaaaagtagagcgtacgtgcgtatggtcatggtcacgtcaagagaggagtatagaggagacggatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatgaaatgcacagtactagtagtagaatttttggcaataagtttcgtgccattgaatgcttacagtcctttgaatttcctaggctgccttcaccataactgttgtctagttccagatcgctccccctgccgccgcagaacctacgccgtaatgtttgcattcagaaattatgaaaagacttaattaacctaggtaggagtcaatttaagatagagtgagaatgcaacctgttaaatgtatacacctgagactctgaggaggggaaattacaagaagctccacatcgcaaagcctctcttagtatcccactataaaccaaagggtcatacaacagaatgagaaggaactggactaaaagctcatgtaattcaagatatatcggcaagggtcaaggactcgtggtttgtaattccctcttccctcttctaagcaaatcatggactcatggttgcttcattgtcccagtaattcctcaactgcgacatgtggaggagcagcccatctcggcctaatccagtaacgctactcgtcatgatccatggaggaggctctgggtacagggaactgatcgtctcctggaactctttgatgttctcctctggccggccccctttacctttcttggatttatcacactttgtgaacacataggtcaatccaatctgaaatagtacccaaacaacagaagtcagactgcaacaatatagttggagaacatgaaagatatgttattagatatcagtacatggcatagactgtcttatgttgccttacattgttacggccaagccaattggcacagtctatgtcaattttctgaggcggaatactggcatcaacaaggagcagtacgccaaccaaggtatctctgttcaagaagtaacccttggtaaatgaagaccaatctgttcgagcagattgagatgcagccgcaaacctacatttgtgaacagatttgattatcaccaggcgccaaatgagttccaacagtatgctggggttgtgtcccaatgggaatggaaaagcaacagtagttgacttataaagtttatttcgtacagaatgtgctcactgttacaatgtcagatactggcatgcagaaacagaaactacagccgaatagaagggaataattgaatctatgccatctaaagatcaccacttcagaaatatataaaactgaactgactaggttcactaatatgatcaaaagatcacagttcaagtttctaacactccgcctagtttcataagccttttcctcctcattaagtggtaatgaagtgaacaacatcgattcaatggtataccctggtggcatatacacaattgcctacttctaacatagtattttcaagtgaaaatttgctaccggacactcaaagtttgcgctctttgctactggacacccaaagaacgtgtatttgctgcaggacaccgtgggaatatggtgacactggccgtattattttattatatctgatccaaatggagagagaaattttcaaaaaaaaaacaagtttacccatacgacatatttctttttaactcgaccaggtctagtttgaatcagacctacaccatcagagtgagaatggactgtatcgagggagtgaaaatggactgggtctggttctaaccagaccgagttgtcttacaagccgatgaacacaagggcaaaattgtacttctcgctctgtttctctccatttgcaatgccatctatgattttgtcattgtgatacatcctagaaagtagcacatgcaaatcaagttacatatgaattgagggtagaaaaggtcaacatacccgtaaccaggcaaatccacaaggtaccaacttttgttaaccaagaaatgattaatcgtctgggtcttccctatgaaagcataagatattccatgtaacaacagaagtacacatttcaacaaaatgcagaagataacaacatgttggttttgtaatgccaaactacattatctgaattcgtgtgcaattacgcagctaaatgcattatatacatcattatatacaattacatttcttatacacctaaaataaccctaatatctctcactagtctacaattctacagtttcaaccatccaaaaccaattgtgtgcatataccttttctccagcaatttacatggtattttttaaccaacttttgttaaccaagagccaatatattcatgaagtttgatatgaaaataacatagagttagatggagcaaatcataaaacaaaggaatcagttcagttctgaaggttggcattttgttaagagttaagcaacgaataggatagaaagataaacaagttgaaaaaaccatgtattcggttctgaagggtgcacaaataccaaactcgtcctccataaaactgcataatcaatagatttataaggtttgcagcaatatcaaagttccccatcaaaaccggagcagtagcgtagcaccgtaagctaaattaatttcttctgttgctttaagcactgagctaacttcagctcccgaattgcgagcaaacgaatgtgtttgcagtctaggacatcgcactgacggttgacgctaccacagtcctaaactcacttgggagttgggagtctacctcagagctaaactagaaattgcatcatcaaacagatatgcagaaacagataaaagcttaaaaatcaccaggctttttggaggtgagcgcggcttccttgcggcggataagggcgttgatgagcgaggacttgccgacgttggagcgccccagcacggcgaactcggggcggtcgtccttggggcagtcccgcgcgcgcgcgctgctcttgacgaactccgcctccttcacccgcgagtcccccgcgtagggccctaccacgatgttcgacgccggtatcaccatctccgccgccaccgccgcgtcccgatccacccccggcgggaagaacagcgcggggttcacggacgaacccctgggaggcggcggcggtggcgcgctcttcctcccgcccttgagcccggttcgctgcgccggcggcggcgcatcgccggcggacgcggtcctcgccgctccggccggcgaggagagcgtgcgacggacggggagcgaggcgcggggtggtggtgggacggggcgcggcgcgacggctcggaggagggagaggcgtggccggagtagcatagcaaccgcagccgcgcgcgcggcggagaggtggcggatggccggatggggcgcggcgcgggtggctcacgcggccgtcgagtcctcgtcgtccctgtgtcgcgacctgcgcgaggccgtccgccaacatatgggcctattaggcccagagcatttattcggtaaaaccagagcccgttataatcacagactaggcccaatagactgcaaaagtggcccaaaacaactgtgcaaaagtgggttttgtacactactgaaaactgataaaaaaaacgcgaatatcaggaaggtatgggaggagactaccgcccggacgtccgatgcaacgcaaaatatcggacactacccgagtcctacgtcagcaagctgatcacataactgctacatgatgatactacatgcatgcattgattaacacatactagtagcgtttgagatgatttattttccaaaccatttatcttattgtcattctgattatatggttgtattcattgtaattaaatctttacaacaatatctcacaaggttatattttaattgaaaaattatatatgtttcaatcgttaagatttaatgtttcacgtgttaaaaataaaaatgtttcatctagaatttgattatgttgtacattttaagttttttatccattagatgttgttttactgttgcacacgggatcaataaatatattatgatgtttcattatttatttgtgaatgttgcacatcatattatttgaatgtttcatcaagtatattgtgtgcaacagttacaaagaattagtgaaacataagaaaatatctattaaaacatctaaataatactaaataatactatgagcaacattttgttgcaacagtaaacttaaaatttattacaaagtaaaattccatttgaaacgtttatttctcatacatgaaaaatctaattgcaccggctaaaaaacacacacatatatataattttttcatcagaaatataatcatatgagatcttattatagtgatcttgctagaacatagaaaacaccacatgcaacattacaaataactatgtgaaacatcaaccaatatttattgaaacattctaataacaccgtgtacaacactaaaaagagtcagaaaaaagtcatcagaatacaatgatgtgagatattgttccgaagatttaattataacaaatccaactacataatttattcatagtttggataaatagttggagaaaaaaatttgaattctcaaccattatgagctgttttcctaaatttgattgcatgcacgaatgcacttacaccaactgatgtgaatgttcgatttcttccttccttctgcccggacggctgatgtgaagcattttccgaaggtatgaggtttcgaacttaattcgtctagcccaccaccttatggagctagccggaagacccaataatatttctctactaaaaactgctgattgcaatcagattattactgaggaattatgttagttttagtctctacctaaaaagaaaaggttacggagtagttttactctttgacgagattaaatgtcgttgatattttgtggagatggcacaaggctccgttggtggcatcgtcgtttctgttgctggtcattgacaatctcgcatcgtcaatactgtacctgcgaatgtcctgaaggattccatatttccattagaatcagtcacttggaagttgggaagttcacttctatggggcgtgctaccgcgtcattattgatactcgatgagaaaacaagcagcagctttatttcccggcgcttaatgacaataaccgaccaaataaacgatccaacagatcgaactgcgattatagtaaatagtttgtactccctccgttcaaaaaaaaaataaataaataatataatatattctagcataacgaatttggatacatctaggatgtgtcatggagcggagggagtatactagatgtaaaaggtagatcgctgacaatgcaaattaaatattagcaagcatactacgacgaccaggcgtacataatagaagaaccagttgtatatttgccccccaaaaaaacgaacatgaggaaaatgaaatgtgtgaaaggttttattgacccaagacctaataactggtatggactcagcaaattctagttctttgcagcgaaccttctattggtttatagttgtggcatacaatttaaaatgttaattgcgtataacagcagattcttgagaatctaagaataccttaagcagcatgtactagtgtttgaactgttctaaagtactccagttaggtcacattttgttaaaccaatgagttataaaaaggagttgaacgcatactctataaaaaaaacacgaatattaggaaggatctaatattaaataattagaaagggtgaggcttggaattcagatcgtctagcccaccacttgtatagctagccggaagatccctgggcgtttctcacacgcatactctataacaaaattgactctatgcaaagccctctgcagctctactagctgcaagttgcgacttgacagataggagtgggagaagaattgaagaaagtagcaacaaccttacaaccccagtgaggatgcgactatgtaactaatggagtataatcatgagctagtttcagcgttgactatgtacgttggcaactatcccgtcagattcaacagctccgatcgttttatttgctgtttggtctagtacagttattaggcagaatacaatacgccgatttttttttcagaaaaatgatgatactaacaacaaagataagtgaagtcaactgcttataataattggctggtagaccgggtgcctaaattaatttgactgcatggctgacgattccatctaggagcccaatacgtcaagttggtcaaccggcctaactgtccgcgcgcaatgctaactgtgcgttcagatgtattgagaagcaatagtatgtctggtggtgtgcgctgcgagcaataggacgactgcatgaatgcttgccaatgaatgaaacatccttccattttttgttctacaacagctgaaataaagtttccaagcatcatctttggggattcgacaccatcgtaacgctagtaatctgaacaatttggagggagcgaaataatagggttttcaatctcgaagaaaaggtagctgggtcaaggtagcaaaagggatggtctaggaggtagcgtcatggtgtgcggctaatatggtgatatggactatcaataattagtttgcagggagttctttttatcgtggtagacagtcaatatcgtgataataggcttatgttcatttgccggttccagtttccgtctccttctgttttttgatttggggctcttggtctgtaaataatctttatttctctttatgaaaaaagtgtgctccttgcgtattccctaaaaaggcaagcaatggtatgcagaaaattatccactttgctgaaatctttaaatgcatgccactacatctaaaactgttagtttgtcaaattattcttctggttccaccggccggcatgccaaatcaaaaatcatacacataactcgtccactttggcccaagaaagattcgatagatattagaaactgtaattttattatagctgaggcaagatggatacataagttcagtatctacagtgcttacatcccaaagttccatgtactatctgaaggtgatggccggaagtcgagaatggatatacgggctgaagaacaaggagcgagaaatgtacagatagtccactacaaagttggtacaatccactccccgcaaaaaaaaaaaggggggggggggggggttggtacaatccacagaaatgaactgcagaagatcgatatccgtttgcctcatcaagcctttcttctttgcttgtttgaacgcaggaattcacagaagatcttgtagaaactgtgcgtcagagctagttcattcctccaagaatcgtggaaaattcccgtgttccaaactaccctgggcagaaacttgtgccaaagagcactggtgcatatatttgcacagctactgtgctacactagttgtgattcccttgggtgtagatgtagtcggtgtgagcaactagtgtcctcctcatcaggcactcttcctctgcttcccctcccttgcactccactgcctgatcaggttctccctgatgcatttccacaccgattccagaactaccaacactcttctgatgggcaatactggaggcaacaacaccctagaaacaccaagaagaacgcggttagatagccagcaccgatagccaaactgctcagattggaagcaaaatgcaaatactgtgtagagttcgaccaggttatgcattacatggtgactgtacctgtgatttgtggccactggatcccggttcaggccttgctgcttggctcctcgtgcagatgaggcagagcagaattgccgtcaagaagagagcagacagtttggagctggatgccatgcctcgccctttttctctgagctctccctctctgggaagttcagggatgagggatcacaggctaattattgggtgatctacaagcttaaccaagtgctttatatagggtgaagaagaagagcgaggctgatatgccaagacaccacatgaaggacagcaatgtgccgtcgccgctaggtctactccgctgttcgcgttcacatgtggagtgtttatctgacgcggacgcgcgtgtggacgtgccagacgctcatggctctgcatgcaccgtgtcaccccctgtgcgtggatgcatatgctgccagattcaggggcatacggttgctcgtgttactgtgtcgatccatgttttctagtagtgtacagtatgtgcctagactatacggtgcccggtgtcctcccagtcacatgctccttcggttttcacgcctccccgcttccaaggaatccaacggatggttgaatcgcaatgtcaatggattacatgtacattaatcgataattatttttaaataatttaacagatttaatacagtataattctgataatttttacataactttcaaaaatcctcagtaatataaacctaaacgataattatatacgatttttaaaatatcatataccaatgacaataaagagaagagacagtggacggctgtagaagagtataatgataacatttgacggaacttatagaaattataaaaacaaaacccaacgggacaataaattataaaaactatgagatccaatttttaagagagaatctcttatatgccactgaaaattggcccgatctcttatatgccactgaaaatttgctcttcccctatatgccattggaccaaatttgcacactggatttttcacattttggtccttttgaaaaacttatttcgcaaatagacccctagaaaaacttatccaaaaatggtcctttttggggcgccagagtggctggcgccgtcatccaacgggacggcccagcctctctggcgc

SEQ ID NO: 81118 - DNA, 27209 bp, Oryza sativa
cccccgtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggactgagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggattgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtattacaccagtagcacgaaaagcatgtagccaccatgacccatctactcgtgctgcttaatttgcaatctgcttcaggctattgcattgggtcggaaagaaaaggggaccacggaatatgtatgtcgtcgaggtcgatcggctttagcttgcgtggcacgctcgcaagcttgctttacaccggagattgcgcgacgggcaccggagattgcgcgacgggcataggctgtgtgtccgtctagcctggtgcatgaactcggtccaccggcgccgtcgatacatgctagcaatacgtactcctacgtcaccttcgtttctgtttttttttctgtacccacgcgggtgacgaaaaaacaagagagaaacggatcggatcagtgcatatcacacacattaaatacggcgcgcgaagggttgcccaagcaatgggatactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatatacattcagcaaacttgatgcacaaatcaagcatatatttcatcacattctcgatgctggaaaacagatagtaagatctagcatcctgatttttcattttttaaaaaaaaactttcacaagttagcaggaaatcatattgttagagtatatggtagttatagttatattagaataggatttatttgtgtggactccttccatatctgtaatccttctttatctcaccctatgtactcctatatataccggtccctaaggctcaatgcaattgatccacgttacgcaatatacctctctccctatactatccaatatggtatcagagcgagcgacctagaaccgctgctcacgcttccgtcaccgtcgccccgggagggctccgatctcccgggggcggccaactttttttttctctcttcgcgtcgtcaagtcatcatcctaagagatccatctctcaggcgtttgtgttgtcatcaatcaagcagcagcagcagcgtctccgatcgtcgtcgatctcaccgaccacctggcgcactgcccccgcccgtggccatccacgagcaaccgttgacgtgtggatctccgtcggccatgctaggcctgcctcgccgctgccgctgggggggggggaggggaggggggacggccacctcttcacctcggccggcgtcatcgggccccgtccgccgctgaggacgcccgcctgctggtggtgctcggcgctgccccgcagccatctaccctagcgtgacggggcttgcctcttcgccgcgctgaggaagccacctccatcaaccacgccgccgtccccgcactcctctacgccgctggccaccgttgacgccacctccgccagccttgccatcgatctcttgctgcccatctctctctcttatctgtatacacatgcgttcatggataggatttgggaaggtagtaattgacacacaagagggcgttgtggaataggattgatttgtgtggattccttccatatctgtaatccttccttatctcctctccatatactcctatatataccggccccctgaggttcaatacaatagatccatgttacgcaatatacctctctccatatactatccaacacatatgatggagcttgataacaatgtaattatccaaaattaacactgcatacctcaacttcacaacgatatgctgaacacattttatcaatatttatacagtccatcacagcgaaaaaaaaatcctttgctctttccgtgacatttggagcaaacttttattagaaggtgtcatatcactactacagaaaacatttttccgaacgaggacatctttaggttacgggtgaaccgtaactagtcgtgcctgcaaacatcggtctacattttcgcatacggctacttaaaagatctgcatgcaaaaatcaatttcattccagttcagcgaaaacccaccgcatgttctagttcaccacccatcacattcccattcggcgattggtctagttcgatgatgccagctgccactcagctcttgtcttgccggttaattatcgcccttctccctattgctgaccgctcgctaccacctggagggaagcctggaaaagatggggacgagagagtaagaggagggaggagtaggaaaaccgacccgttcacatgtagcgtccatgtggtcaccttgactcaatgacacgtcagctaaaaccggacataatattatcatgtgaatttagtagtatttcagtattgtaagttaaagacgtgttatatctcgtatcatgatttatggatgtgatttaaactcgaagcaaatacgagggattaaagtgaacttattccgaatgaaacaaaacacatggagcaatctgaactgcgtttggaaagtgaactgtgacaccaacggtcggcgtttggaaacatgggatcgtgcgtccagataaaagcaacaaagaatcacaaatcgattcttccaatctccacccctcgccatcgatcatcgtcaccgtcgccgtcgccgtgatccgcagcatggcggcgccaccgccaccgcctccgcgtccgcgtcaccccgtggcagacaacgacgacctggtcggcgagatcctcctccgcatcccgccggacgaccccacgcgcctcgtccgcgcctccgccgtctgcaagcgctggcgccgcgtcctcgccgacccgagcttcgccgcgcgccaccgcgcgttccacccgagggcggcggcggcggcggcggcccccgtgctcggcgtcctccacaacccggccgaccgcgagctggaccgcttcgtcccggccgccgcctcctccttccgcgccgccgccggcgaccgccgcaagcaccacatcctcgactgccgccacggccgcgtcgtcctctacgactacgactcccactaccccaccgacggccacgtcgtctgggacccgatcaccggcgagcagcacaggatccccaacgtgatggatgccttgacccacccggccgtcatctccggcgccgccgcgggtgggggtggtggctcggcctccttcatcgtcgccttcgtcggcgtgcagaattgggagaggcacttctgggacgcgcacgcctgcttctactcgtcggagaccggcgagtggagcgtccacatcaacatccacctcgacctcgatgggtaccacctcgaggaccgccccgccgccctcgtcggcggcgacacgctctacttcgtcggcaagtcggggatcctcctccggtacaggtatggcctcccgctgcgctgcggcagggacatcctgggccacggcatcacctcggccgacgtgctctcggtggtcgacccgccgccgggcgccaagcgccgcctccgcctcggctacaccgtcgtcatggcggcgccggagagcgacggcggcgggctgcggctgggagtcctgcaccgccacaagctcgccctgtgggacagggaggaggacggctccgccgccgccgccgccgcccggtgggtgtggcgcgtggccatcgatctcgagcaggtgctgccatggccggtcgggaataccaagggcaaggagcgggcgtgcttggccgcagttgccgaggaccccaacgtcatcttcgtcggcacggaagaagacggcgtcttcgccgtcgagctcgattcgctgcgcatcaagaaagtgtgcgaattgggcaaatcacaaggccgtttcttccccttcgtcagctactgcgccgagtcatttctggtatccatctcatatttctcatctgttcatgcaagtttggttgctgatttaaaatgacatggtttggtggtttttattttattctatttttatttttacagctgagcctagcaaccagcaaattgccagcaccagcggcaaattaatccaccatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgcatggagctttaaatgtgaacggaaaaaaaccaattacacagtttgcatgtaaattgcgagacgaattttttgagcctaattgcgccatgatttgataatataatactacagtaaacatttgctaatgacagattaattaggcttaataaattcgtctcgcaatttacaggtggattatgtaatttgttttgttattagtctatatttaatacttcaaatatgtgtccgtatacgttaaaaaaaattggccaacgaactaaacacagccatcatcatggaatgttattaatcgcccaagactcacacgatgatgtcgactccgccactgcatacataactctacgcgagcaataatcatactccatccgtttctaaatactttgacaccattgactttttaagcacatgtttgaccgttcgtctttttttattaaatacttttgtgaaatatgtaaaactatatgtatacatataaatatatttaacaataaatcaaatgatagaaaaagaattaataattacttaattttttttaataagatgaacagttaaacatatttaaaaaagtcatggtgaaatatttaggaacggagggagtaatttattggtgtgggaaattattgcttagactgtcttgtaatattgccttttgctttccttactttgtttttaataaaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaaccttactaagttgtgataaagttgccaaaaaagtggttacatttagtttgctaccaaattttggtaactatatactaaaatttggtaaggttttttttatctaagtgaacacgtccgtcattttcaaagttcaaaaaatgccctatgaatttgcatgcacctctcaagaacaccaccaagataatgagaaggtactgtagaattctatggcgtgagctgagttggcaaaattgacgagtgacgacattgggtgggggagaaagttggagttgatcattcaagatccagaaagtccgtagaaataatcacgcaatataatacataaaagcatgctaattgctttcgtagaagtgctgcttttctctagctgaagatcttgcaaacaggtcacactaaccaaacgattgttacagaggacggatgggtacgtcactaatatttttttaaaaaatacgttgagaacactcccttaaccgcacgcttcaagagcctaagatgtgtttacgttagaataggctaatgtgttgtcaaaattcactgaacattataaatgtttggtaattaactaaatccatctgtatatttattattttttaaaatatagtatgatttaaaataacattaatctgaacaagcccatgagtaaattcagactttcagcacgaaaggcataacattttaagcatggcctcatagacaactagtataaaaaattacagtcattcgggattgtctcgtctctaagatctttctatgaagtttaggtgagaggtcataattattttatagctaataagtcatgggaaaataaatgaagttaccaaaataatgatttaaaagaaaatgcaaaaaacaaaattatgattaagaaactgaaaattcaaattttagctatgaaataagccaaccagtaaaagatggagctgaaagagctagctaggcggcttgcgtgtccatacctctacggtcctagaaaaaaaagagaggagggttttagaaaattttagaagagctctaagcttcgccgtctcctcgtgctaattaatcaaacccacacaacactaatcaacgcgatcccccacatccgctaatcacaacagaacacctgtaacatattaattaactaactaatctccccgcaaaaaaaaaaactaactaatctacatccatctcgttgctcgtgcctaatccacatgactaattattggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaacatggagacgctggactgcacgagcgtcgcagtggacggtgtggtgccgcaacgaggggatcgaacgaatcaacgaatgatcgaaatcctctcggaatcggtagcatctctttaaaagcgacgctctatcggttagtaattaaacatatttatcatttaaactactaggtattgatattaatatgatgcagaaagaattaaaaaaacagattttaaaaatagtctaaaacggtacaccttatacgaaaacgacgctcggtcaatcaggaatttcatcttaaacgaaccatatgtaagccaactcactgggcaccggtagtaaccaacgggaggggagagcaccctgagtttactaggatttttcactggtattggactataaagtgacgcatttgcacgactataacaattttgttatgtgtcattaaacaattatatcatttgacgtaaaatttgagaacaaagtaaggttattttgagaaatatctttactgtatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcaacgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagagggacccctgcactgcactgcaatggcagagaagcccgtaggcacgctgctactataatatactacccgctactgctggttgctttgctggagctggactgaggttggtcaagctagtttattagggtagttcagtacacttatccaactggtaaattattactactactgtaatttttaatttttttctatttttattttgggagaggtttgttttgggttggaatcattggtgcagggtacaatggtcattttgtagttgatgtttcaatttgtattcagttttccatggaagagtgggggctatatatgcatcttcggcagtggctgtatgcacgttgttggtgtagaggctgagttttaatccattattaaaaatatatttgtcatttggtaattccgtcgataaaaaaatgcataggactagtttcttatcggtggatctacatcgagacttataataaagtgcgcgagcggtccctaaacttgtgcgggtatgtcatttaggtctctaaactttcaaaatgcattttcggttctttgaacttgttttgggtgtcatataggtccaaacaagctccaacctcttccatgcgctgatgtggtatgccacggtagcgcctacgtgttagtcggatccacatgccagttacatagaaaaaatataattagaaaaaaaacatattttctcgtctctaccttcgaatttttatctttttttctgtctacctaagaggagaaaatatggtttttaattttatttttttatatatgcttgacatgtgaatttcactaacacgtaggcgttaccgtggcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttctttttttcatgccgctgctagctaatggagaacacatccataatcagtatctaaaatgggtgaggtacatctatatatcctttaggataataagattttttttctaattatttctataaaactttaaaagcaaagtcgatctccttccatcccctcctcacaccacgtgtgtataaccactggattaaatgatttgtcctcaatcaccattctaactcatctctatttatatgggcatgttataacgtacgagcgtgttattagaattatccaattccattttcttggtttccttctcgcataggtatatcatcatgacttcaagaatatacaaagtacatatgacaacttaattaaaccgttaatatgccaccttcctatctcctgaagttgaactatatatgctgtgaagaaatatatggatggttgaagtagaatctaattcaatattgtcacatcgtatccaatgatcactgcaaccaatcaggatgaatattcacctatagttcccgataaaaaccgatgttttatgccgtgttctcttgtgatagcttagttagaccgcaacttacaaaagggacactatcgaccaaacgctgacgtctcttgaaagagatgttgaaagagctcaacaattgaagctaatggaagatttgttatgaataaactctagcaaatgggaatatcctagattccatggatgacgtacatacagagttctttttcccttttggaagttatgggatataggtagctatagtactagtattgcatcggaaatgcttgcttgcaacgacctagagtatccaattagagtggaactataacccaactatttgcgctcttgtacaaacaattgctcttttgaagctcttttcttttccttttatgtgtaatggaaggaacaaccttttgcactacttttgttgtctagcattgtgctgaattcactagttaaaatggttagggtactcaatgtaccaagaaaacaaggtcgacacaaattgaagacaatttattgtcttatacttttgagtttacatagatttatccccaattgggaaattttggacacctagtagccaacaatgccatttataaatccttggtaggaaagatcgtccatttctcatgtgacaataatttcatttaaaccatgaaaagataatcaccttcagttgtattcgaattagtggcgaagctttttttttttttttttgaggatcttgtcctccacatacttattatatagtactccctccgtacttataaagtaagtaatttaggacaatgtttaagtcaaaccttaggaatataaatcatgaataactctcaagttgttgagtttgaaaatgtaaaaattatatgaatagatttgtcttgaaaaatactttcataaaagtacacatatatcacttttcaataaatatttatagaaacaagaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccgcgctggctgtcacgttgggagatcctatggtaggagtacggtggtggtggtggtgacaggatccgtccttctagggcgtcccgggagacgtcgctgttgggagtttggggacacttgtcgcctctgtggtgacccggcagattgggattgggatttggatccggtgcagtacctagtgtgactgcaacataagcagtcacattaggaccttttgatgtaaatctgagggtccaaaatctatcaagtattgttcacacgaaaaaaaaactgtaaaactagcatcaacattgtagcatcagatctagaccgttcattgaaaaaatggatggctgagatgatgtgcagttcctaacttgcagtcacagttaggacttcactaaatctcaattcatcagattgagaggtcatcgctgcttggtgtggtaaaaccgtaaaattagcagtgctaggatcctaaaacctactccttctttaaaattaaccaatctaacattagattaaaagtttctttttccagatttataatagtagatttaggtaatgtctccaatcttaaattgatttattttaagatagaagtagcacgtgtgaggtttttttttttacatcagacagatataaagaaattctctatttctagaggaccattcacatggtaacaacatgacaactgacaagtagatttgtggtttcggcttaccacatctgagccatgcctccactttagtcaagcccatgccccacaacagagctacacgtgtcttgcaaaaggaatttgtgtctagttaagacgatctacttacaaaccgtattgagtgaggccgtaccctcgagttccaagcagtgaaggccaaatctggaactagggagaggcggagtatggttagatatgtcaaatatgaaagaaggcggcggtgctcactgccagggacaagtgaagagagggtgaggaagatggctgatgatgagggagggagaaaaggggcccaccaccatggatgttgcaccgatttacctctgcgccaccctaatcttattatttcgttgctccacgtcgcctcgatctgaccaaattcaacaagtttgtagctagcattggcacgctcatgaccagatttagcgaggtctttgcttgtttgatggttgacggtgaaaaatcgacctgacgataatctcctcagccctaaccagccttgatctatgctgatggctagctcgtcggccgaagaagttgaggtcatatatgaggagaaatgaagcgatgacggtgcccaagagtgcttgttggcatgtgccaaggaggagcatgtcaggagagaaaggagaatatgggaaatggtgaggagggttatgctaataccccatctttagagtgtttaatgtaaaattatggacatagtgtatataaattgagataatatcgtgaactaaaatagaaattgatatgggcaacttgtaaaattaaagccactacgtgttattggagaggagtatagtctccgtctatgtgttcttatgagtggcttccactaccgttgctaccctattaaactttagtagttttcaaaatacatccactttaaactctatcaaaatttgataagcctacaaacaaatacatccataatcactaaaatttggtaacaacataatgccaaactttactaaggttatttctggcaacaattcacgtgcctataaacactagacctcggtcagctggtcaagaaacggcgatttctaaatccaaaagggatagtggagaagcgggtggacgagagacacgagacaacgcaagaggctgtagccagcatcaccagctagcaccaggaacaggaagcttctgcccggtttctccctacgtctacatccccggttgcccagttcagctcccctccacttctcaagctcttccaaccgagtagctttcatccaactgcgagagcttctagaagaccagaacaacccagagactgtgaaacatcaacctctcgaggcactcaactcttttcatcaagaagcttccttctaatcatactgcacacatggctgctcaagagtttatctgaattgggagtatccaatctacatgccacacagcagcacaaggcctctcatgagtgaccactgatgttctgataacaacaggtaaacaacaatggcagctgacagcacaccatctccttgctctgcacaaacgttggcagctattgaaacttccacaagtttctgagaatgccagttcagaaagtatggagcaagccacagtaccactgcttatggaacaagagaagactgccatgtaagcagtccagaaagggatcaacttctaacttctaagcacatatatatacatgtacacatacaatttgaggggcattttaccgtctttacactgctcaccgggtcatttgcgtattcatttaacagggtaaccataaggaagttatattggtaaagctggcagattattacatacagtaggcattgacttttttggcatgtagccaaggggcaatacaggcatgtataaccagcaccctttctgcagggcaatttcgtcgtcagtaaaggtcaagctcctctttaatttcaggagcacaaggaatggtaaattaagttaaagagtgttttcctgtgttttacagtttgactaacaaaactcaccccaggacaggggcaaaataagccttcaggaattcacgaggaccagctaactcggagcaaacgatgccttactgaaatgtcaaaagtaaaggaaatgagtcataaagaagagaatttgtccagatctgtgagaacatgagttacaagtttaaataactgaacaaattatcatgttcataaactaactcttgaattagaacagtatcataattcaccaaggatcaggccctccgtccacatataaggtattttgactatatacatggacaagtgctcccaggtgcatagctaaaatccccttatatttgtggacagagagagtaggtaacatagttcatttggagtggaattgaaactattggcaaacaatattgcagtaatgctatgaagttggctccaataatacaattagaacctgacacatgaaaagagccagctgtatattcgacagatttcaacaagcatatttgttatcagttgcatgaattgtatgggacaatgagtacaaactaagattcgttaaactctgggcatacttagtactagtttgccacggcaatgctcccaagtcctgaaatctggaatcaaggctcataacaaagaaaagataattaaattgttgtttttattcctattattttgaagtaccagggcatctagaacagaagtaccacttatacatacggttttcaaggagacaaaatagaccacaaatctcataacgtttcaagctaactattctatacaagttaataatgtttcttcattcaaagcaaacaacatttcatttcatcaccttataaagtcatatagagatcatgcttccaaacagaactgatcccattgatattccaggacatacaaatattattaacaggaaaaaaaaatatttagtcacttccacggcaggtgattccgtgattggcacatataatgaaattgaaatgtcctaatgtttagacgctctcttgtgtgcattaatgtaatagacaagatcggaggaggaggacgagcaagcagatttagctgcaaaaacagtatggaatggatttccgtctgtacctttcaggttctttggccattaacatatttgattccagatctagtatcagtcaaattcgatcttactttggccattaatatgcacacacatttaacttatactgggtccatactcatacctctgaatatcctgcagcttaactaaataataaactaaagtattaacatagtccttttcaagtctttcactttttttgaagtctattcatgataccaaggtgtattcagctatgatacaaaaaaaaagttatgcatacgatagctgtctcttacagtatgttccacttctagaagactaaagtattatagagtattaactatccatatgagcacagttaaactgtacaccaggatcagcaaattttaggcatttagcttccagtacccactgggtttctctgtcacaggatcaagggaaaaaaaggacaaaatgctcagttttcaagcttgctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagt

SEQ ID NO: 81119 - DNA, 45615 bp, Oryza sativa
ccccccacagtgacccgactatacttatagggcggaattctagactttttagatgtattggcccataatattgaagcccatttaacatgcatatatataatctaaccctaagtcaacaggtcaaagccaaatcctccaggacctccacccatccagatccacagcaaccaccacccaagtcacgcgcgccgcgccgccgccgttcgccagtccgccgggagcctaggagccgtgcacgccactgttcgctgccactcgctgccttctctcgtcgggagattgaagccgtcgtcaccggccggcgcggcgcttgcagccgtcttcaccgagagccaccggctgcctctgtcgacacgccgccagcctgcagccgtcttcaccgggagtcgtcgtcgccgtgctgccgggagccgccgtcgccgcgccgccgggagccgccatcgccgccgccatccgttgaccatggcttcagcctccccccgtaagctatgacagcgacgatgcaaggtgagcatactacaatccctcatcccttctctgtgctcgatagacgcctacctctagttcttctccatcgagttattcgtcttccatagctgcattgttgactcactaacccacgaccggcggtccacgcgaagggatgctgccatggatttggacctgctaccacgtgatacaagtaaagcagtagtcgctgccgcagccacacccaatgttgggcatactgccgtatccgccgccgtgctgggtgctgcccctgcggtcgtcgcattgggtgcagcccctgcggtcgtcgggttgggtgctggctcctctcgcaagtccaatgcaaatgcccttcgcaggcctcctcctttgaaaaggaccacatccaagccgaaaagccatcttgcagctgttggagctccttctgcaccgactactctaaacacgtcatcttttgccggcggccttcgtctattaaaatccatggggttcgatttcaagcacgctacccctcttatatgtttcagctcttttatttaacaatttggaatatgtaagttggagtttatgacttatgagattgcattgcacttaggtactgaatgtttcagctcttaggtactaaatgatggatttgttgatgttactgtcatatattttctttgcaaattgaagggatatttctttgcacgttactgttatatattttctatatttatacttatgtacatgcattattgtttggtgatttatagtgctatgcaggtatgcgtcaacatggtctgaactttaaatttgctttcacagctttgtaaagggatttcagtatgttactaggccattgaataaattttgaactgaatttatttctctcttctcagattcacatcgaagtcaactgcgggtagtgcgaatagaagccagcaagactcgcaatcacttccacctcacgatgagagtgttaatgattctcagccaatacaaggtgatgatgatgaagatgaggctgaggaggaggatgtggactttggcaccaagaggaagcttacttctatcgtttggaaggatttcaagaaagtaaaaatctgtggtaaagtcaaggctcaatgccttcattgccacaagcggcttggagggaaaagcagtaatggaacaagacatctccatgaccatttgaaaatttgcacattgaaaaagatcaagatggcgggacaaaacaagacacttgcacagtcttctttaaggttcaattcccaggagggaggaaaaatatctgtggagaagtacacatttgatccacaaatagctaggagagagcttgctgccatgattgtactacatgagtatcctttatctattgttgatcatattggatttcaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatggaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaactttgattgtataggttcatatatgtgcctgctccacacacaactgaagttatatgtgaacaactttatgaagcattggtggaatggaatcttgatgagaagatctcaaccttgactcttgataattgtaccacgaatgacaaggtaatcactgaacttgggaagaagattggcaagtctaagttgatgttggagggaaaattgttgcatattgttaacgaccaaatttggttatttaggtatcggagatgaagataaaatcgaagcggaatccaagatggagatcgttccagaagcggagcaagaatcggctgaagtccgaatcggctacgatcaggatcggtagagttcgagtcggacaaggttgccgattaagccgattccgacaatgtgattcggtacacgttgtcgggttgagttaatgtgcttcatgaggattgccatgcatggattgagtcctgaaaaggtaattgtatctattaattagggtatttcatgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaacaacacacgttcaatacaatctcggcgcatcgccaccctttacttttgttttttttcgacaagttcttgctttcgggttgagctgcatcagtttcgatcttcaactagatgtaaaacttgttatggcgggttgcgttatcgggattagtgcttccatctttatgatactctaatcttgtttatgtaattcgtcgaattatcatatattatgtataatcttcaacaatatcgttatctaaccttcaatcggctaacatctattattggaaggcaaccaatcaggttaaatatctatgttgacttagattatacagggtatctaccactctatgaaacagccaacagcttgattgtctagatattgtccttcttttcatatttatagctgcatcagttgagtttgaccttataagtcgttattaaaatctcaatttctagcctgcttttggttgccgattagggtagtgtcggggtttcagccgatcttacctgatttaactactctatgtcttatatgcttgattgacatgttaaatccgccctttatgttaagatcttgttgccgatacatgctagatctatctaatcggctatgctatgaacatctataatctcattgttattatatatttcgatctaagtgatttatactgtctcggcatggtgaccgatctatcccaatcacttgatttaagtatatatcaacataagaattatatatggttaatatctacagccgatcaagtagatttagttctttcttacttattcatgattgccgatcgattcaaatatgacatcggctcaaagacaaatgatacgtcatcggcggctggtcgatcggctatcgtttatggatttaaccgctattttcctgtctttatttcttgttgattgcatgatcaaatcaactggcacgctcacgaacctaaaggcaagatttttggacctgcactggagttaagcagatctcccaggcctcgtgtttttcacatcaacacatatgcgttgtgctgcccatattcttaacttaattgtgaaggatggtatagaggtgataaaatattcaattgcaaaaatccgtgaaagtgttgctttttggacagccacgcctaagagagtagagaaatttgatgaaattgctaagcatgttaaagttaaaatggatcacaagttaggccttgattgcaaaactaggtggagttccacctacaagatgcttagcattgctttaccttatgcacatgcttttgatcgtgcaaaacatgttgagaagctctttgattgtgcccctagtaaagatgaatgtgcttttgctgtagaggtagttaataggctcaagttgttcaatgatatcacagaagtgttctctggaactaattatgtgactgccaatgtccaactcttgaaaatttgtggggctaaagagcaaattaggcagtgggctgtgtcagggttacgggtaaggtataccctctacccttcgatatacgtcacgtatcgatatggtatgttcacgcgtatacggacgttttcggcatacgttaaggaaattcatcatggagttcacagatggaaggagtcctactcggtcagaactgggtcgtcattgtgtcgtgttcggtccagtctctccgagtccaactgggagacaggtgacctgcgatataaaagggaccccccaggaggacctaaggcatcgaatctcagagccaactccaccacagcctacgaagccggagcttatcggagccaagtcgccgggagatctagtcggatcaactcgactacgatcttgtcggtatcgtcgagttccactgttccctttgtaatctgtggttttcatcatataatcccatatcaactggattagggctattacctaccaaggggcctgaaccagtataatctctgtttcctgtttgcttgatgtcgtactacgtagatcctcgtaccagcgtaccccaataccctctatatccggtctacgggtattccccgtcgacagtggcgtgccaggtaggtggacttggtgctcaaggttctactactatgacatccagctttgtcgacaacagtgtcaacaccaacctcaaccaaggagttcctacttcaacaacactggtgtggactcaggtcggcgaaatcgtctttccggtttacaccacagtgccgatctcagctggtccgccaatggccggaaacgagaatgcagtggctacaacccagggcgactccatgtcgaaggatcctcccgccgaagcggagataggaacgtcgacaacatccgagcccgagaaggatcctagtgcggccaagccttgtctttccgacaggaatcacgagccgacgaggattacttccgaggtgacaaggtcctggtgtcctatccacaaaaccaggaaacacaccctgcaagcctgctgggtctttctcaacgtccatgctgaaattcgtgcctgcaaagagcgtggaattcagcgtacctctccaactcgtgatgtctattgtccaattcacaagacaaagaatcacaacctctcgagctgcaaggtctttctcagcgccatgaagacgccaccttctaaggtccagcagtcacgcatccccatcagggatgaacacaaggaacaaggagcgacgctgatttcagatcgattcgttggggtaatcgacatagatccccacgaaccatcagtcttgcacctgctcgaagactatggatcatcgacaacgagtacgccgcgtgaggtattggctatcgacgatgtcggcacatcagcgcgcaccaatgcggaagcggaaaatcaagcgactacactggcccagcacatcagagccgtcaacgcaatactgagggaaaccccctacgatcccattctgaacgacgatctcgcacgatggacagaacgactacgggaatcagtgaccaacctcagcaacgcgttcaaagaagccgctgctgcagtgcacccagaacagccaccaactggcgatgctaatggtgaagatcctgaacaccgggaattgcctcatcgagccaccccttcacctcgcggcaccggcgatctccgcgatcacctgaatggccgccgagaggcgcgacgcacaagtgacaacgagaaccgttctcaacatcgcatctcttcacgacgtcacgataacgaagatcgaggaggccgttcaagcgaagaccgaggccatgataaccgccacaaccgctgcgatcatgacgatcacgaacggcgggtgctgggcgatactggtcgaggacgtcgccataatgacgacgatgatggagatcggcgccgagacaacaacgggcgacgacaacaaggttctcgagaacccggccgacgtcctcgtaaccgcacgccggaaccgagcgacccatcgtcatcgtcatcatcttcctcatcttcatcatcagatagacatccacgaagggcgtatgatcgccgacaacccaccgcccccagcgctgggtgtagagctttcgatcgttcacttcgggatgtccgatagcctgaaagattccgacctggagcaatagagaaatacgatgggagcaccaacccagaagagttccttctggtttactccacggtactctacgctgccggagcggacgacaatgcgttggtgaattacttgccaaccacattgaaaggctctgcacgttcatggctgatgcatctcccccctactcgatctcttcgtgggcagacttgtggcagcagttcgtagccaacttccaaggaacttacaagcgccacgcgatcgaagacgacctacatgcgttgacacagaacccgggtgaatccttgagggattatgttcggcgctttaacgagtgcagaaacacaatccccgagatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcgcgaagttcatggccgcatctcactacgcgtatcaagtgctcaagatgccaggaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccgacccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatctcctcgaccttttctcctttggaatcttcggctaaatcggtttggaaaccgatgggttcgaggtcgattcggatcggctttgagcccgatctttccttctcgtcgccggtcgccgtgggccttcgccgccgcctccgagcccctttaaaaggaccccccgagctctcctctacccgtcgcccccttcgccttcgcctctcgtcgtcggagaagccctagcgccgtgcgccctagctcagccgtcgccgccgtcgctccagccgtgcgccgccgccgttccagccgtcgccgtcgctcgggaaggccaccgtcgggatcgccaagtcgccgccgtcctcgtccgttgcttcgccgccgtcggagaccgctggagcaccatcgccgtcgtcgaaccgaagagctccgccgcttcttcttcgtcgccgccgccgtccgttgggtttccgccgtcgttttggtcgccggtgagttcgccgtgccgtccgctacccgttggtgccctccgtttgcgtcctcgtgccaccgttcgccggcgagtgtgcaccgcccgagccgtccgagccgccgagccgccgccgccgatgatgacgtcatcgctgacgttatcggggccgtccgccgtgagccgtcgtggacccgatcgatctcggccgtccgttttggatggatcgatctcggccgtccgttcgcatgaaccgccgcctgtgcgctcggtccaccgcaaaccctagccgctgacgcaataaatccccttttccttttcaaaaataattctttattgcgtcataattcaattaaaaccggtttaagtgttttaatccgatttaatctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgttttcggagagttcgttttcgccggagaagagtttgaagagttccaaggccagcaaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttacagtgatcagttggccgatactgagtatcgctatcatcctcgtcaaccccagggaagtgaccgtggcagctaccttgagactgaaggaattgagaatgatgctaccacaaggcatttggttgagatgctgtgggctatggatgaaagtcgtgcggagactgtgttagcggctcaagatcgtgaagatcggaatcgtggtaagatttgcaagctagaagacaaggtggatcgtttggagaaggaactagccgcattgaagggagaagcaccaccgcagaaggccaggattcgtcttaccgcaaggaagagagctctatttgtccctcgctatcaattggcgccaaaggttcgtgtggtggagaaagaagttgccccaactctagcagatcctccggtcaacatcataagtgatgatgaggaagaagaatccaagcgcaaccattccaagattgagtgggtagcaactcaagatgatgaagatgagccgaaagagccttcaatcgacctccgatgctcggaagaactagagtgacttgttaagtcgttgtcttagatcgttgtgttagtttgcttgctttaagttgcttgtgtgtgcttcgcatgtaatttacatcagtgatgggatgtaagtgcatgtgtttgtttgcttttgagtgttaggaagttggtgagtttagtggtgtgagagttttcagttttgtaataaaactcagttaagatcaataaaagttaaagtaattctctgtcctaagtagtttccccccccggtttctcttcttgtgccctgtccagcaagatggtgaatactcgcagcaatgggaatggccccaacaatcccaataataataacaatgaagggaacccaactcttgcccaagtcctggctcaacaggtgcaacttatgaacatgatgatgcagcaacttcagaatcagcagaaccaaggaaataaccatgcacctccgcagaacaggttaactgattttcttcgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaacgccggattgctcaattcaagacacaacaggggaataatcagaagccgcgtcttactttaggaccccagtccataccacatggaagttcttcgtccgttgttcgtccgcagcgtcagttcttcaacaacaatgctggcaacaacatacgtaatcaagttccgcgtcctgttgcagctccaacacagcaacaacctatcaagagggagcaaggcagcaagcccgcggtgtgtttcaactgtggagatccaggacattatgctgacaagtgtccgaagccccgacgcgtgaaggttgtccctgctcagaacaactctactgtaccagtatcaaaggcccgtgtcaatcatgttgctgctgcagaagctcaagatgctccagatgtgattttgggtacgttccttgttaacttagttcctgcaacagtgctttttgattctggtgctacacattcatttttatctatgagttttgctggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgctaacagaaaagtaactctcaccagcaatgatggtcgagttgtaactgttcatgcattgtcttctgaatctttaaggtcgagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatcgaatggcagccaatgagttggcagaagtcaaaaggcaagtagatgatttgcttcagaaaagatacatcagaccaagttcatcaccatggggagctccggttatttttgtggaaaagaaagatcatacccagaggatgtgtgtggactatcgtgccctaaatgatgtgactatcaagaataagtatccgctacccagaattgatgatttgtttgatcagcttaaaggtgccactgttttctccaagatagatcttcgatcagggtatcaccagttgagaataaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtggtggtctttattgatgacattcttatctactcccgaactgaagaagagcatgaagaacatcttcgccttgcactagagaagctaagagaacatcggttgtatgctaagtttagcaagtgtgaattttggttgtctgaagtgaagttccttggtcacgtcatctcagcaggaggagttgccgtcgatcctagtaatgtggaatccgtaaccaattggaagcaaccaaagacagtttcagagattcgcagtttcctaggcctcgcaggatattatcgaaggtttatagagaatttttccaagattgctaagcctatgacacgactgcttcagaaagatgtgaagtacaagtggtcggaagaatgtgagcagagttttcaagagttgaagaatcgtttagtatcggctcctatcttgattttgcctgatgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtgagagaatttgtgtccccgacaacaaagatttaaaggatgcaattctgaaagaagctcatgatactttatattccattcaccctggtagtaccaaaatgtaccaggatctcaaggaaagattttggtgggcaagtatgaagcgtgaaatcgcagaatacgtagcagtatgtgatgtttgtcagcgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttccgaatctcgaggacgagattctgtttaaggggggtaggtttgtcacaccctgaaaattcaaaatttataaattgttgtttaaaaggaatttttagaatttatttttaaaagtcttgaaaataagatctaattttaataataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaatcttcttttggctttgggccgaaagtcggctcaaaaacctctcttttctctctcctcggcccagccggcccagtccgcagccgcgcgcgcgcgttcggtcgctgacaggtgggtcccacctgtcaggtcgtcgtcttcctcgcgtcggcctccgcccgaaaccctagccgccgccgccgccgttcctttccaaatccggccgtccctttccgtttccggccgaatcaatagaggggaaatgatctccgggatctcctccaccttttctcctttggaatcttcggctaaatcggtttggaaaccgatgggttcgaggtcgattcggatcggctttgagcccgatctttccttctcgtcgccggtcgccgtgggccttcgccgccgcctccgagcccctttaaaaggaccccccgagctctcctctacccgtcgcccccttcgccttcgcctctcgtcgtcggagaagccctagcgccgtgcgccctagctcagccgtcgccgccgtcgctccagccgtgcgccgccgccgttccagccgtcaccgtcgctcgggaaggccaccgtcgggatcgccaagtcgccgccgtcctcgtccgttgcttcgccgccgtcggagaccgctggagcaccatcgccgtcgtcgaaccgaagagctccgccgcttcttcttcgtcgccgccgccgtccgttgggtttccgccgtcgttttggtcgccggtgagttcgccgtgccgtccgctacccgttggtgccctccgtttgcgtcctcgtgccaccgttcgccggcgagtgtgcgccgcccgagccgttcgagccgccgagccgccgccgccgatgatgacgtcatcgctgacgttatcggggccgtccgccgtgagccgtcgtggacccgatcgatctcggccgtccgttttggttggatcgatctcggccgtccgttcgcgtgaaccgccgccagtgcgctcggtccaccgcaaaccctagccgctgacgcaataaatccccttttcctttcaaaaataattctttattgcgtcataattcaattaaaaccggtttaagtgttttaatccgatttaatctttaaaaattcataactaattcatattagctccgatttagttggttcaagtctctaaatttttctaaaattgagatctacatgttaaaaatatccacatgtactgttcatgcttgtttatgtgctgttttggtgatttttctcttttcttcttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacagcaagctactcggcttcctcgtctccggcagaggaatagaagcaaatcccgagaagatcatggtaatcgagaacatgaggtcgcctacaagactcaaggaagtacagaagctaaccggatgcatggcagcactaagcaggttcgtcgctaggatgggagagcgaggacaacctttcttcgctctgctgaaaaaacaagacaaatttgtatggacacaggaggccgaagaggcattcattgcattcaagcgctacctatcaaatccacatgtacttgttgcccctcaacctaatgaagaattatttctctatattgccgccacgccatattccgttagcactatcattgttgttgagagagagaaggtgcaactaccagtctactatgtcagcgaagctctccacgacgtaatgacaagatatccacagatccaaaaactgctctacgcagtaatcatgacatcaagaaagctatgccagtacttccaagcccacagggtcacagttgtctcctccttccctctcggtgaagtcatgagaaataaagatgttgtcagccgcattgccaaatgggtagtcgagctaagccaatttgatatccacttcgtgccacgaacagccatcaagtcccaggtactcgccgatttcgtagccgattggaccatgcccgataacaggtcagacaaccaaatcgacaatgaaacgtggaccatggcattcgacggcgcactcaacagcaagggagcaggggcaggattcatcttgacatcaccttcgggagatcaattcaagcatgcaattcacctcaacttcagggcaaccaataacacagccgaatatgaaggactactcgcggggataagagttgcagctgcgctcgtagtcaggtgactgatcgtgaaaggggattccgaactagtcgcgaaccaggtgcataaagactacaagtgctctagccccgagttattcaagtatctcgcagaagtcaggaagctggagaaaaggttcgatgggatcgaggtccgacatgtataccgcaaagacaacatcgaaccagatgatctagcacgacgtgcgtccaggcgagagccactcgaacctggcacctttctggacgtcctaaccaggccatcagtgaaagaggcaagcggcgaagatagcccggtcgcccccgacatcagctcgggggctatagaggcagagcgcaccgttgccgatatcgagaccacggacgactggcgcaccccactcattaaattcataggcagcgaagagttgcccgaggacgacgcagaagtcgagaaaatatcccgtaaagcaaaagtctactgtatgatcggcaatgatctatacaagaaggcaccaaacggggtactcctaaaatgcatcttgtccgacgacggcagacacctcctcctcgacatacatgaagagatctgtgggtcacatgccgccggtcggacattagtcggaaaagctttccaacaagggtttttctggccaaacgccctcaaagacgcctgcgacatggttcaacagtgtgaagcctgtcaattccacagtaaacacacaaagctgccagcgcaagcactccagactatccctttcacttggccgttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagtacacgagtacagaagtattccgatgaggatcaggaagagcagcgatacgacgatgtgaatctactcgaggaacatcgcgaacgagttgccgttcgagcagccagctaccaacaagcccttcgccgttaccacgagaagcgcatccgagcacgcatgctttcgatcggcgactacgtcctccgacgggttcaaagccaagcagggcgcaacaagctctcacccaaatgggaaggaccgtacacgatcacgcaagttttgcggccaggtgcattcaaaatcgcagatggcgatggtcgcgagttggcaaattcctggaacattgatcaattacgtaaattctatgtataagtcaatagtatccatacttgtaagacatcttacagcctcaataaagcctattttttaggtacagactacaatcaaagtgttccttttcgatgatcccttacccagatgacacctaacgttgaaacctatcctcatgtctctttacgccgtcttgacaaggcctccgaggaacctaagggaacttcggcggggacacccagagccgataaggccttgtcggatcctgtagagacgaaagaccatgtaagatctggttgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctggaggctagggagagtgtataactcaaacgactgatcgaagtcgcgaagtgagaagacactcatacacactacgtccagagtaagaaagcttagtaagatagatttcttttctattccacaagtatttcttacaattccatcaaaattcaaaactatattacactttttccaaagacatttgtcacaggatacggagactaccaggaaggacaacgctagtccatcgactggaaaaccttctccgccagcggcgccatcgactttgccaggccatctatctccgtaggagttctctgggaacgagaaaacccttcgcggaggaactcgagatgcagctgcgaacgatgatctcgtatgcaggccaacacgtgccccccggcatatcggcttgagcgacgacactcctgcttcaaggcctcgtcgatatgttgaccgatgccttcgagctgggcataggccccattcagccatgagatgtatccggcagccgattcctcgggatccccacggggtattcggagctctctacagactctcgacatggatgtgcagcaactcttcagatacgagttgaaccacacctcacgaccccggagtgtctctacggcctggtcctttctcacctccagcatagtcctctcgagttccgcgacctcaaacttcgtcctccaatactggatgcgacgatcctggtcagcaagcgcactctcgagatctgctcagcatggaaacgactaagtcaagctgctcttctctcccgagaacacaacaaatcaagtcgatccagacggaagggcaaaggaaatggtaacaaaggacaacaaagtactcaagatcaaaatgctaaataaagctaaggcaatgaccgcacacactagggcggttgagaccaataaaagttttacaaagcatgactaaagagtacaagagagctaagaccctactcttcaaaaagcgagaggacggactcccccagatcgccgacctcctccatcacatccttgcgcgcgtcgctaaccgccccctgatccaagatcttccacagatcgagttcagggtgcgccagcctcacacatgcaaggacgtggcacaccccggtgtagatcccattagacgtctcctctccgatcctggccgcatgcttggaggggatctcctccatcaccgtcaccagctccgcaagagaagacgtcagcgagaactcatcgggattcgccgggatggtggacttgataccgcactccccggcgagctggtgcagaccagtataggtgacccgcaatgagccatggatttccgacaagttgttctcaagctccgacatgcgatgctcgagcccctgccgttgtcgctcgttgccggccaccagttccctcatcttctggaggtcctcgcgaacctccgccaggtcgcgcgctagccgatcggcgtgcttgttcgccgacgacgcagccgccgccctcgcctccgcgatttcgtggctaacaccgcgagcaccagcctcgaggaggcgccccatctcaacctggagctcctcccaggtgaggacggcagccggcgaaccacaatcagccacaagatcccccagacatccgtcgcctcatggctcctgggcacgacaacgacatccgttgaggccacggcaggagacgcgttggaggtcccccagacccatcttgcgctgccttcgcccgcgccgccctgcgaaaggctgcgattgagacagagttcgacgaaatcacgaaacctcaaattcattcacttacttctcgctgagcgtcacaagccgctgccatcgcggaggcgggggagacgcgtccgaggcctggagtacaatcgatatgatgtgaggtggaagttttccgactacgtgatcaaataacaggagaacttaccgagggggtgggtgtcttccgacaatgtccgactacagaggagaatttcctcccctttttcggaacatcgctgccactcgtcgtggcagcggcagcagcagtgtcagacgcctccttggcgaccttctccttcagcgacgctgccacctgatggtccacgagcggcccgatgatatcagtcagaggaagagcctatgtttcatgaagtcataatgcgatcccggaagaaaaatgcaaaaggaccgctaagtacacttacattgatggcagcgtcacgctcggctgcccctttctcgcaaagggggacggggacgttgctcgccgttgtcgggccgctgatcatcagttggctgacgcggcgctccacggttgcactattcaagcctgtagatcgagaacagaatccgataagccgggaagaacatgcgcataagggagtcaatttaactaaaaaggaaatacctcgaggagaaacccgggtcgcgtcctctggcccataataatcaaaggcaggaagggctcgagcctgaagcggctggatccgcctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgatatggtatgttcacgcatatacggatgttttcggcatacgttaaggaaattcatcatggatttcacagatggaaggagtcctactcggtcagaactgggtcgtcattgtgtcgtgttcggtccggtttctccgagtccaactgggagacaggtgacctgcgatataaaagggacccccgggaggacctaaagcatcgaatctcagagccaactccaccacagcctacgaagccggagcttatcggagccaagtcgctgggagatctagtcggatcaactcgactacgatcttgtcggtatcgtcgagttccactgttccctttgtaatctgtggtttccatcatataatcccatatcaactggattagggctattacctaccaaggggcctgaaccagtataatctctgtttcctatttgcttgatgtcgtactatgtagatccttgtaccagcgtaccccagtaccctctatatcctgtctacgggtatcccccgtcgacaggctgcatgtggcaataatattatagaggaaatgtcaactgagatgattgcgaagtttgataagtattggaaggagatccaaggaccaatgggattggccaccatacttgatcctaagtttaaaacagactacctccttgggttcattgagtccattactagccaatcaagtgaggagtgtacagacaaacttgaagaggttaaaaacaatttgtatgacctcatgaaggagtatgaaatggaagaggatgaagataacacagaatcttcagctcattcacttgctaattcaggtgtattgtcttcaattagtgcacgtgttgcttgaaggaggccaccagcaataagagttaaatctgagctagataggtacttggaggatgagttagtctcaattaatatggaaaacttcaagatttttgattggtgtaaggtggctgggacacaatatcctacattgagaaaagtagcatgggacatatttgccattccagttagcccagttgcatcagaggctgcattcagcactagtgggagggttcttagtgagcaccgcagctgactcacttcagatatcttggaggccttaatgtgttcccaaaattggctacgaaacaagtacaaaggtgtatgtgttgtaccattcaaacatagtgtgatcatttatatttttccattgtcatggttgcataataatcattacaactaattttgtagatgctgataatgaagaacctgcaagatttttggagctgtcttcaagagatccaagataagatggaggtattcttttcaaactaaaaataattgactattgcattgtactcccttcatttccttgctatcaaataattgactaatgcctatgtattttgcttgtcttttgcatgcagagacttgcactagtttgagacatgaagagtcgaagacagtgccttctaagctaacgtgtgcatgatgcctatttgtgtattttgtttattgtgatgatccattggatgatggttgtcacgaccggaaatcacccaacgggcgttccttacgtgcgtgtattattccttgtcccaggaggcaaggtacaccaaaagttgatacaattcagagtttaacaagcggaagcgtaaatagttaattattacatgggcagcgacggcccagcacactcaaagacaacgaagaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagcataattgcaaaggagtacaatggaattataatataggggttaggagttgcagtaaatagcattaaaagacacttagttgctcaaagctatgttgtaaacacgatcctagagctataaaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacccccgggacaggtaggcaggactgagcccctagcagcagggcaccaaccctgtgccatgacatctcgactaccgggccgcagctcgtgtagccttcatttgtcctagagatgtccatcgaatcccccgacttcgtccatctccatccgtgtacttttgtttataaccagactgagccacaaactaagccttacccattagacatgtggaagtacggtggtgctttgcaacagaggcccgaagaccggtccttatatggccgaggtgcgactatcaaaaccatgcaccccgagcccagcctaaaaccattttgagagttttgaatagagggggcggggtgaatccaattccacaataatccaacaattccagtgtccaggtgatatgaatattaccacagtctagggttttaaaaccacctaatgttacctaattaatcagcgaagcatctacctaaaatcatactagtgataccacaaatagagtgtccactagttgggggttttgtttattctagggtgaacaaggtaataatagcaataaaaataataaggtcgtaacaaaggtaataggcatggctaaataaaacagtgataacgcgggaatttaaataaagcgataatgcaataatttaaatcaaaataatttcagaaattgggattcaatatgttcaaggatgatgtgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattctgagttcaaatggccaagttatagccatttgaagtttatatgctctttaaatgaatatttgcgaatttcttcatttaaattttaatttaaaatcggatttattgcgtcagccgaggggagagggcgcgcggaccgggtccacgggagcggggcccacgcggcagcctcacggcccacggtggaccgggtgcacgcggctcacgccgaccggcgccgtgggccccaggcgtcagccgcacccgagggcgcgggcggctgacggccgagccccacgtggcagccgctcggtgcgcccgggggggcggccattgcggcgcggccggcgggaggcggcgcccgtgccccgatggtcaccgccggcgaccaccggcacggcggaacagcgaccgagagaggggagggaaagggggaaacgaagcggcggtccacggctcaccccgagtcgaaggcgacgacgaaaacggcggccggagcggaggaaggcggcggcgcggctcgggtcgacggggtcgacggcgttccggcggtcggtgagcgaagcggaggggcggacgaggtcggcgaggatgcggcgaagccgaaggaggcggcgccggggcgggagatggtccggggcgacggcggcggcggaccggagctcggcggcgacggcggagagagagtgcgacggcgcgggctcgattccgacggggaggaaaggcggcgagtggcggaaacggtggaggggaaggggatgacgggtgggccccacccgtcagcgagggtggcgggcgggcccgcccgtcagcggcgcgcgcgcggggaggaggccgagtgggccgcggggagaggagagggaggggagggagctgggccgagccggcccaagagggggagggggagggaaagggaactttttagggtttttctttttataaaacctttttaactttgtttatttcttcttaattatcatttgtgctctgaaaattccactaaaatttatttacgcattttaggctttttaggaaatatacaaaaatcctccaagccttatttgacttttaactttgcacattttaatttttgaaggctttcacatggattttaattattctaatcataatttagaggatgtattttagagtcgatttgggacgcgacaatggtgccccagactcatatgttgctgacttagtgactatgctcatttgtgatttgtgaaactaatattagcttcagactgtcattttgtggctcatgtgatcatgtgatgtttaatattagctccagagtctagactgcaattttgtggctcatgtcatcaggtgatgtttatttgtgttttgcctaatgaagtaatgacaaatgataatgatccttactgtgattgtgatctataatttgctgatttgttgagtggagtattttggatatatttgatataatgtgattgtgaatatgttgtttaaccggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccagactcaaagatgcaaaaggtgccaggactgcgggatgcaggtgcacgtcacaagcctgagaaggagcgatcgtatcgcagagaaagagagaggagaaacggaatgggatagaggacagggcatgaccattgatgggagatttttgtggtgcatccagcatatggtgggtcccatggtatgctttatatttttccttttaatttccgtcgcacttttggacgtatcaaagcatgcatccataccaatatacttatagcaaatggtctatatcatatacctaattaaagaaaatatgtaaagctttcggcgattttttttcaattgaaatggactaaacttagagtttgcttgtttagaatagggcttaattccgagtttgatacacaatggattttctctgatttttgggacaacggaaaaatgaaaagataagaatcgaaaccctcgatcaattttagattatctataaggaaatgacctgatttcacaagaggtggcttcagccggtgttgggcaactgagagaatctggacagatatgggaaggcggagggaaggagaaaggaggaaaatgggccggcttagctacgggttgaggaagaaaattggctaaaaaaggcccatacacaaatgaggatttttatttagattttgttttaaataaatgctgaaatgatatttgtattatagaaaatagcaattaatctttgaaaattccgagaaaaaatcaaagagtgtaaataatcatgaagaatttaataaaaaattaaattcagccatgctattttatttcccacacttactttacttataaattaatttaattatacatctacctatttaaaaatacctagatatctcaggaaatttataatttaattaactacaaaatgtaaatctttctcaattgttcctcaattttctcgttttttcttcccttgcaacgcacgggcactttttatagtcttttaaaatatttgtagtgtttttatcatctcacctgacataatgacgctgaaaaaaaataggaaatcaaaaatagatagctcccttcacaaacccagattcgtattcctggtttgcaacctaggactaaaggggttgcaacccggactataaattctctagcagttccaatttctttaaagtattatgtaattcacgttcttattagctttgaaccatttatttaaaaagtggctccaactagctaaagagtactgtactctctccttcccaaattgatcattatataatgaaatctaaaatttctcaaattgatcatcatataactttatggacgcggatttcatcggaatacaattaatgcaacatcggagaatgtgtgcatgctagcgaccaattttattaccatttctaattcgatctttattcctgatccaattggtactacatctcctagcgccggtccccctgctccgtgccaatcagatctttgttcccgatccagcttctcctagcactggttacaacgctcggaggccggggaaagaccggccgcgacgatggccccaacctttggcaccctgtgtcatctcctcgcttagagcaggtacaatagtagtagactataaaccagctataaccactgcatatatcgagaaaaaaagagaagagagaaaaaagcgggctacaaatttatagctagctgcaacacggactctaatatgttatgtgtgtatgagatgtgggaccgggtattaatggtgtagtatatttttatagttaactattgtataaatgggctattagattatttatagataatttagagtcagtagttggctatactattaaaatactcttaaggattagagcccgccctctcgtagtgagttcgtttccaaggttgggtgctggggttcttggttaaatatggcgtatatacataagtatataacgtatataaattttatataagtatgtattaaaaaataaaaaaactagaaaatatattatgtatacaaagtttgtatacacataaaaagttttttacacgtatataaactttgtatcccgtaaaaaaaacaaaaaaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtggagtaccacgtcatggcgtggggcgcctacgaggcgacccggcccgcgctcctcggcctcgggttcatggcggggccagggatcgaggaggttctcatcgagtgcatcaacaggggcaacgccgccgtcgccgccgccgccgccgccggcgacggccagccgaggctgctcgccgcgttcgggatcaagccggagagcctgccggcgaacccgacggagaggcgcttcgtggccggcatcctgtacgctgcgctggagatgaggaactgcgtgcggaggcgggtccggtggctgaggagggtggagaggttcaaccagcggcggcgggaggaagaggcggaggcggccatgaggagggaggaggaggaggcgaggaggaagctggaggtgcaaaaggttcttgaggggtatgaggaatttataaattttaaataaatatttggcttgtttagattcaaggaattaattttggaggtttttcacagtaattaattgttttgatccctatgaaattactactttccaaagtagcacttagccttacaaagtactgaaggatccaagcttcacagtgcacttcatactattgaagggagtagttgcattttcaattgttttcagtggctactcgtgatagaaaccattatatatctttggctgttattgtgacttatatgttctaaactcatccaatttgtttttttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctcttctaaaacatcgtctctaaaaaaagaacaacgtgtgtacgtatcgacattgccatgatccaatcagtaaatataccataacataggttgtagttacactatgaagaaactcttctaactctatataataccttcaacaagctaggaagcaaataaacatgcatgccgccccaccattccaaggcggttcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcaagcgaaataacgaccgctcttggaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccggagctaccaatgtcccaagcaattagagcattcacttcccttcaagttgtaccaattgccacatgacgacaatagtctttgattaatcaaaaccaatgaatcgaatatacaatttcagcatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccaatgattggaaaggaagaactcagagagaaagcattcgattgaatcacttgattgcattgaacacgaggaaaacaagcatcaaaagatccttgggaatttgcaagttccccttgtccatgtcctccatgaaccaatgcatccagcagaccattgttgtttggagagagatattctgatctcagggagccaaagtcaacctggtcaataggatgtcctaaggggtcgtgatatgaccatgcattattattgttaaagtcatagttgggatattggagtgaagggagctctacattcatgggcctctgtatggtcccagaagtagagaagttgccatcaagaattggatgtccactgacaatggcactaccaaaaggtactgactgatcttgtgtggcaatggcactaccaaatggacttgtggcatcaactggaagagaatttggagtcacacaatttggccgaatataattttctggtctactatagtctaaattatcgaaaaaaacctctttgtaactttgaccatttccctgtaaaacctcatttgttcgtttcttggcacgtgattcatcagggctttcacagttcatcacttccagatctgtcaacttaaaatgattaaactccttcggatatagaggttcaccagttctctgaattctcttacatctagtgttccagaagttcttgatttcattatctgtgcggcctggcaactgcaataacaacaacagaagttcagatatgcaagttaacatatgatctaataggatttttctaggcaattagactaaagaaccttaaggcattagcctaataagcatttgcattgtacctcagatgttagaatggcaaatatagcaagatgtatcatggtgttgcaatagttggagaggatttaaacatacctaacgaaacagtgaatgatattgtctttacataaatgaaaatatgatgaagtcctattcgatgaacaaaaactcataggaatttagtaggaggcaggaaaggaacccaataaaagtttaaaaatatatatgaccatgtcaatgaatcctcccataataattgcagaccctaccttatcctgtggcctagatgtcagcttttcctgttgcagtttaaaagttgacactacttataacatggctcagaaaactaagaattgaaaattaaattcacatctttcgagattgtgtctagctagcgagtcacagtacatccgcctgcttacagtaacacaagggaaaaagacagttccatgtgttaactgactgtatagattcaagaaaataggtattctatttttttctaattagtgcaagctctgaatgctcaaacaagccgagttccttctctacagaagaggaataacagtaaaatatatatctagtttcttttctgcagtgcagcactgcaagcacgtgtgccccatggcaccacaacgcactaaagaaaaagtatgcccggcaaccattctctatttaagtccttagcaactaacgatattaagacaattaaattgaataaaataaagtctgtcaccaatatacataagaaagaactatttaatgtccactgattatatccagacactagcaaatagtatatatggagaagactgcactagacaaactgttagctggctttaatctagagacaatattttcctctaatccaatacaccaatgcatctaaatatcagatacatgattgcaatatgccgtttggttttctacggatactcgactgctattctcgggaccacacctcgagagctattctacggatacatgattaatagattatatactgcttgattaatagattatatccagagcaagggtctcgacctcgccgacctcatctggttgtcaggtaaactattcactcttccattaatttcagtatttcaccatccatttcagagttcagacttcaccatcaatattagttgcagtttcacctgatgacagtatcgtttctgaaaagaaaagtaaaaccattcacttaagctaatgaatggttaacttgacacaaacggcagccaaagatcgattttcacgttatatcctaattaagtcgattgattactagctagtcttcaggatagaactcagatttggtgttatatctagcttgatctagctagctacgtggtgtttgcaaatgcgtagtacaaaccaccaacaaatagtgaattagtgatgtgatatcgtgatgcaatatggagaaaacgattgttaacttttgcaaattctttatgtgttcagtccgcaactaggacacactctcactctcactcactcaggcactcacatcacaccagtaatgctgtccctaaagattcagaagatgaaagatatatagcctcgatcacaccgattttcatgtagtaacaatactaacaaacaatgatcctaataggaacctagaacagtgactacagtctacagatgccgaatttctatccattatctacaaaattctcgagccacgacaatccagaattgaacagacagcttacgtccaacatggaggattgggtctacttaattcatagaaggccaaagcttagctgaattttgttcacgggtatcgcatcaaatcaaagttaaaaaacagtttagatacgctgtttggttttctacggatactcgactgacaatatgccgtttgttctgattataaactaaacaatttatattaatcaagcagtatatcatgcttctagataggtagtatatatacgactaagttgtaacttgcaaaggttttgcagccaatggaggccagtgtccaggtaggcagccatgaggctctgcccctgcttatgtaaagccactacaagcaagaagatttaaaggataattggtctgaatcaattttctttcgatttgttggaggaccaaatactatttcagacaagactaacaacaattgtaaaagaacgacttactttgttattctctgcaaacaaggaataatggcaaagcatttgtctactccttttaacaaggccatttacaagagtgcagcatgtcaaatgtgtctgcaccatggcactacgccacactcagaaaaaagtatgcccagtggccattctctatttaaatcaagttggagccaattaaatgaataaaataaagtctttcgccaatacagaagaaaatactggttgatgtactctgaatacatctatctacgagcaagtggtatatttgcggcccctatatttggagtggacagcatgcattctccccactaggcaaactgttggtaggctttaatttaggtggttaaatatttttgctctaatccaactaatacaccaatgcacctaaatattaagcatgctactaatctaaactaacaatgaacggagtatcaatgcacaagctagcaaaaccaaggaaccatgaaagagtaggaggaggagcacacttacagagtttgccatcttagcccacttgttccccagccataaatggagcttgatgatcatctcctcctcttccttgctgaagggccccttcttgaggtcgggcttgaggtggttcgcccagcggaggcggcagctcttgccgcagcggttcagccccgcgttcctctgcacccggttccagttcccctcgccgtgcgcctccacgtactcccgcagccgcttgtcctcgtcgggcgtccacggccccttcttcagcggaatcctgccacgcacgcgcacacggccgccgccgccgcggcgacgaacccccgccctagccacaccgccctgctcctcttcgccgccgctggcgtcaccctcatcatcgccgccgtcgccgtctccgtctccgttcgggtgcagcatcgccggcgactccccctgcgagcccgccagcctcgccgcctcctcctcctcctccatcggcgacgaaccctccatcctcatcctgcacgaggaaaatccagtcaaatccccccaacaattcaacaaaaaaaaaatcaaaaaccaaaaaccaaatatccaacgatccaatctcgctccaccctagcccgaactaatccaaccagcggcgcgtggatctccagcgggggagagtgctcaccggcgtcgagacgaggtgggcggcggcggcggcggcggcggcggcggagagcgaagtagagtagtagactaggcggagtagggaggaggaagcaagtagtagacgacccccgatgacgatggctcgtgtcctgggccggaatgggctgccatctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaaggggagaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgcaagcgtcggtgttcgcgaaggaaattggaaagtaagagtatatggtgctacagtacacgtggtactgtagcatgcatatatgtgtgcctactatgaattgcagtagcgtggtgatgcatgttgtgctatgcatgtgtgtatgcgtactgtgcagcatgcagcggctcggcttggtgatgcaagcagggcgtcggctggcctgggcatgtggcaaggcaagccgagtctgactcggtgaattttctgtggccggctgtggctgcaggtttcggagagtttgtgagaattacaattttttaagcaacttttgtacaaaaatttttttacaaaaaatacaccgtttagcggtttgaaaagtgtgcgcacggaaaacgatcgagaggggttagaaaaagagggtgccgaacacacctcattgtgccaagatgaaatatgactatcaaaagttgatggagggagtacttaattaattatgcactgcataatgctcacatcctaaaatcatgcaccagcgcgcttcactgtaccaccaaccagcagggcagccaccattggatgaaggcatgaagcacacacgtcctatttgattcgatccccgaattttgcctggttgccaatttgcgtgacagtggaacgcaacagcgcaactcgctagatagctgtacatccatgtgcaaacgaatgaattactaacgattattatgtgcacaagcaaacgtacgtgtaacacccttatatcggagcgggccaaaaaattcaaatcagcactgaaaaggtggaactaactgctggcccgctacaaaaaattttagaaaggtatttcgaatggaagttttttttactgctgattatcggttaaaaaaattggttaacttgtaacgatggggtgacgtttttcatttcgatagtgggtaccatacagggtttgccattcggattgagcacgatccacctgtgtaaccttggtttacaggactgcattgagtgtttcttagatttagtggtgaacttcctgaaaacgatcatttgttttgtccgatgaagcttacataaaatctaggatgcaataataaacctcgcatttgtgttgtttcccgtgaagccattcgaaacagattatctgtttgtcaagcggtgtgcacatttatggaagtctatggatatatcacggtaatgtcacagcttgttgttgattcacatccttttctgccagtggtattcctatagtattcatttctacaaataaaatggattaaaaataaatttattatgagacgtaagaagtaagtacatgaataattactgaaagcccaaagcgaaagggggcaaataaaaaaggcataatgcgtgcatatgcttttcaaatttcaagtagtttgaggttggcgcatgcacgcacgtcggccgctcgctcgctgcaccctgcgtgccggcccgcgaggcgatcagtcgagtcaggctgcattgctggctgctgcaacttcaacacgacgcgcgcgcgacgggatcggagacggagacggcagaggcaaagaccgccgtgcggcgcggcggcgcgcggcatgcggcgtactccctccgtccaagaaaaagttagaccatagatttccgtgtccaactttaactgtctgtcttatataaactttttttataattcgtatttttattgttgttagatgataaaatatgattaatattttatgcgtaacttgtctttttaaattttttttataaatttttcaaataagacggacggtcaaacgttgggcacggaaatcagggtttgtattttttttaggacggaggaagtagtagccaagatctcgtccgtcgtgtccctctccgcaagggcgacgtccgtagtcgcgcgggcgcgcgcgtagtacgtagagtatcgacgacttgcgcatgcgcgttgtttcggtcgggccaggttcgtgccacctgcaggcttgcagcccacagccacacatggagggaggcaacacgggggcgcgtacgcttgtcgcagataccgcccggtgcgcacgcgcgtgcacgtgcgccggccgttgactagctggaaaaaaaaggttaaaaatatagtagtattatttttcttctatgattttgcgtggatataccggattaacaatgtaattacgcaatccctgaatccctaaaaagaacgatacattttgagagcgtccgattagttagttaaaaaaccacgcgtgcgcggcggagacgaccgaccgatcgatcgatcaacctcagcgactcctgccggccacctagctcgatccgtccggaaagcgaacgcgatcgatcaacgacgaagccgcgcgcggcgcgcagcagctagcggctagctagcgcggcatgcacgcagatgcaggtgcgctgcatctcgcgcggggggggggggggggggg

SEQ ID NO: 81120 - DNA, 29542 bp, Oryza sativa
  unsure (1)..(29542): unsure at all n locations
ggtagtggcatcagagggtgtgtaaatttggaccaatatatggcatataagggaagagccaattttcagtggcatataagggatcagaccaattttcagtggcataagagattctctctttattttttgattaaacaactgcagcttcttaaaataaaaaaaaatagactgattgagaaaacttttacttttgattctggggaaaaactacgactatatcagaagctcctagatagagctagccaccttctcgtactctaggttgggttttccagtttttatattctattttattttttgaattatatatttgcaaattagaatcgaatctacattgtgcaaaggagaagccgcagcgagtaaaactccccaaacaaggccaccacagacttcggtcggttgactgctattaataacctttaagtcttgacaaattaaacttcactctgaatagtcttcagtaggaaagaagttgacccaaagggcttggataggcttggaccaacttttttgtttgtacgttcaaaaaaagttgaacaattttcataaaacgtgttttgattttaattagtaagttaaggttcaaatattttgaccaacaatttattaagttaacatacgagtatgtttatgtataaaaattacaccattagattcatacttcaaggtagtgggtccagaaaattggttagttgttggacgtgcttatcaatgttatagcattgctaattatacgcagatcatagtgttatacgatgtcatcgtcaaacatcatatttgcaaacgaaaaataatttgtgaataaaacttatatatacgtgttcttaacgatctaaaagcaaatactgaaaaataaactatgagaaaaaaaattctaaatcaactctaaatttaaggttaaaaattcaaattttagcttataagcataattataagcgaaatgatgaggctgataataaatgaataagtaattctgctataggttttatcaaaagtcgatggtgtcacctacctacactaacacaatagaactgctcctgcttccaagtaattccactcaatattgatttttatacaagttagaaatatattataagagagaaactaacgtcaaaatttagttataaggactttctaaaatgaaagtacgccttataaagtgaacatagagaacatagcgagtagttggtaaggtggctgcaaagcaattctgatttaattttactcgtggctatttgttggaaatgtcactctttttttataattgaagtaactatattggaagtgaaaaaaaaatttaaataaaattcttcccatctactctgaatttttatttttattttcatatcatctcttatctaaatccttggacttttgaagctagctggggtgagtcgtcgttgatggtgccaccgtcatattggacttcatagtggtggtagtggagctggctaaaaggctgtttttctattgccttttctccaactatcgtatctgtcgctgatttttaaggggtttgaggattacgataatctcgtttggtgtaatgtaatagctttttgatatttagctgtcgggcaaattacttttaatttatgttacaaaatattatattattgggcccattagtaaatgttaaaaatatgacacaattggaaaagacatgacagccagatagcatattttacccatctaatatgtgtttgatgagtttttgtgcaaaaaaaaattgggcatttaattttgtacgaaaatattatctgccacctaactttattaaatatatacgagacgtgtctatatgacatgtgagcccagaaattttaaatatcacggtgtccgaatatattcgatattggactcgttttgttgtataattcgaatagaaagtaatggttcaaatggattttaaacccgatgtacgattcaaaaagattgaagctattaaaacaaaataaataagcaagtgctattgttactatgagcatgcatggtcattggctgtggcgattaaacatatggggctcactgtcattagacatgttaatcacataattatctccagacggcagtacacgtcgatggatctgctcatctctgcgtcggcttatcgcgaagattagcacggggcgctggaaattcggaagccgtttccgccaccgctgcctatataaggagtagaccccatcaggagccggggacgctgacgacgctaaaggagacacccaaccaccattttcattcatcccattcctcttagtagattaggaaaatcaagagaggagattgaagccggccggtgatagcaaaccggcgccgctgcggagagaattaaacaccgcagccggcatccttcatcaagtcgattcatttatcgacaacatgccgccattcaggatatttgcgctggatggtgagcacattgaataaatattaattttctagattaaacacaatagatgttcggtctttattggtgatcggaacatctgcgtgttcttaatctatcttgatctttatgattaaagccagatcgatgagagccgaaacacggttatcatcaaactccatttatacaatcaatggtataaggctggtccggtcctcattggcgatcggattatccgaatactatttgatattttctacgctcaaaactagatgtccgaccctcattggagattggacaatctaagcggtgtttttacaaaatatattttgctaccatgcacacgcatgggagctattcgtgatctttggaagataaaaattatggccgagtatttacgaggccggtgtcatgatattattaacatgtccaaacagataggaacggatacacattactaggttccgacgaggcaaaagtaatgatatatccacatctaataaaggccggcatatatgactgggtaccgacgaggcaaaagtcatcccctttattatgatacctgattcatgtatggacatggtgataatatattgtgaccaggtttcggcaaaacaaagccaccaatatcacagttatcattaaatctctgcaccaacctcaaccttcggcgagcgattaattttgaagacgacgatgacaagcgcagcttaatcgaaggtattccataggctcgtcccatggatgtaattaaccggccgcctcattgctaggcactgggaatcagcggactacacgcaatctccagtcagcatacctttccattaagtattcctcgcgaaggcaaaaggcgaactcctacgggagccctcatgtatttgtaaatattcatgttaatgaatcgtgattaataaaatacagggttttcctattttcttgtgcgttcgttgttttgttttcatcaaacaatatgcaaacaagctaaaatgattataagtttttttttattttcacaataacttaaacaataagcacaaagcaacaatggcaaacaaaggcagcctttaggatgtccaataaatgtaagcccgcactgttatgtcctgcctttgcaaaatgattttgttctgcttaatttcaacaaaaatagtgtctcgaactttggttttaaaactaactttgttccttggatttttagacataggggagagaaggaccaatttacaattaaatccacgcattgaatttacaaaatgatacatcagggcgatcaattcagttgcagtgtacaaatggaggaagtgcatttacagagaattgtttcagaagatttacaaggaaggcccttgcttgggccaaaaaagaacattttctgcagaaaatgtgtttttgcagggaaatgaatggctctacagctacagtttcaagtatatgcctttcatgtggaggaaacaagcagccaggcaccagaagatgatctccaagacgacgaacgccaaggttccccagcgtttggagtggaagattgtctgaagcagagattcagtcaaatccacctgaaataaaaaggagaattttccgcgctatgaatcaagtctctagaggtagtagagctttgcaagatcattttctgttagctaacatgtaaggttattgctccaggaaaagaggaatttggtattcttgagtaaatattgcatctatgaaagaatccaccccatatatggtaggatgcacagcacagcaagttgcttaccaggttgttttcaggtgatctccaatagaacccttgcacaagtgtagggaagatctcacaagcagcaagaacatacactataagcgcgttcatgcccatccactggaataggatgaacggcttcttgatattgatgacatcaacctgcatgacaaaaagaggctctgtgaatcagaatccactaatgaggtaatattatctgccttcataacagtttgttcgaacagaaaaggtaaagcttccacaaactaacatgggtacatcaaccgtcattaagattacatatatagtgataccatactatcccacagtacggtttccagagattgttcgagcactcaaacttacaatgtagtatagcaacaacagcaggaatccagataccccaccggttagtagcatgtagctcaccgtgtacaaaggcttgctgaaaggcatgcctaatgaccaaaacatgcatgaatcagattgaggaatggaagctctgattaaaacaacaaattgctgaatgccagcagtctcacgaaacacataattacctaataactgaagtagaaatcctgagactgttaacacagtggaagctagtagccataatagcattcgaggtgaatgatcctgtggtagaagcaaaggttagagaagtctggaaatatcattgtgtttttaaattccattttgctcaaggttcaagagattctaaaagggaggtatgcagttcatgggcactaccttgcaatgaaccaaaacatgtccaaaatgcaatccaacaaagcaagtcactgcagccatcaatgtactgtaaaaaccaataagggaggttattttctggtttgcctacaggaaatgggaaggttcaattgataaacattggtcaggtcaattgaggattgaatcggttgtacaattattttaagaaccaaataataaaaataaaagatataaataaccaccttagcaaaccctcgggatcaaatggagccaggcaccagtctggtgcatttggaggaagtggtccataatcaggagagttaacactgcattcctatggagcaaataaaaggaatttaatcttgcatatttttcaaattggtatcctataagaacatggctatttgatatccaagtgaatcgggaaaagatcaatatcatgtgtttgcttaaggaaaaaaagaccttagtccttttatagactgggttcttgtacaggtgattttcaccaagtaaaactcgatctacaaatccaactgcattgcaaggtggcccaagactacctctaactccacactggatctgaaacaccaaaaacaaaaccagcaaaacaggttagtaactgcaacgatgtagatatgatgattaggaccacaaaaagctgtaaaggaacccacagccacaggtaaagactccacagcaattagctttcaaacactggatgaattgaccagttattcaacctaggtttcatatccaccagtaacttatggagttttggttccagaaatactttatgaataaggatatacaaaatccgatattttcttaggttagtaactgcaacaaggtagatatggtgattaggaccacaaaatgctgtaaaggaacccacaagtaaaaactccacgacacctagctctcaacactggataagctgacttatctgatctgaacataaggtttcatatccaccagtaacttctggagttctggttctagaagtactgtacgaatcaggatttacaaaatctgatattttcttaatatacatactaaattcaattcaattttgaattcctgaatccagggtaaccaactaggaaccttcttcaattaaaattcggttgaagttgagttttagttagcaaccgttcaggaattcttttccccagtctttgccaggaagcagtactggcctgatccagtattttttttatcaagacttgggttattcctggtaaatcaattctggataagcatctgagaacgaaacaatgggacaaatatgatggccgtgaattcatgtatcttaaaatgtcaccaaacatatcaactagttttgaaaaatataactgtgtaaatacgaaaagggtctgtcacccaatcaaaacatttttgtcaaaaggaaaatagtcagcataaatggggtcaaagtatatttactgaataaagctcagttagacatgattgaaatattgcattccagcaacttgagtaggtttcatccaaccaaatatatcactacagatacagaatcatgatgtgcttcaagtattgaaacaaaatcacatgaaaagcaaacaaatggtacatctagcaatccgattcttgagcacacaggataccatccaaatagaataaagtgtttagattaaacaggatattctcttcttaccattttcattccaatttcgttgcccggagttggaattgtaaggattgaattgctagtttgaactttaaattcccaatttgaaacataaaggccgagtagcaagccaacataaagtgctgaaatcattacggccacgatccttcaaacgataaacaaatgtcagaaatggtatggccatattagtatatcttccatgtcttgagttcagaataattctcagttataatctcatatgaagcacagccaaactacaaatattgcaatttttttaactgtacagaaaaaagttacctaaccctctagcagatgaacagatcgagcaatcaaaatgaccagaattaccaaaactcccccaaattcaggactattaatcaactaatgcagataacattctttagatggacaactaaacatgttatttcatatcatggaacgtttgtagagcaaataccactttacatgaacatagaatgtaatcagcatgtataaacaatgattggattacataattccaaatgctgaacaaaaactgaaactttccatagtaaattgttacacttattaactaaccactccatgaagtatttcttcacaaatgatatagctgaatccactgaaatattgttgacaagccaaatctctgaaattgccgctagaaagtatccaatagctatcctctaccagaagtataacaacaagttaacgtttcgaacattcagtaagccgaagaggaaatgtgataaagcttctccttttgtttttaaacactacctgcagcacacctagccatcgaatatgatccaaatcaatgccataagttaaattgtgtctgccatgaatatatcctcctacaggtaagatataattttaaaaaggaaaaactccgaccaaaagaaatggcaaaatatggagctaaatgttgctggtatagttggcaaggaaacacagggataagtataaccttgcaaaattacacccaagatgaaaagtttgatggccctgattgcagccttcttagttgccactgttttgtttggtgttttctgttgtgcatcatccacaatagtcagatgttattctataactaagcagccagtggtttaagtcacgcagtgagcaccaacatcatgagtaatcacacacattccaagtgatggagcacaatgacataggcattaaattttgttatatgcttacatcacttggcagattggaacagaagttggaaacaaaaaaaggtataccagatttaaagtagaaaaggtaaccaggataaaaagattgtggcataaaggtttgcagaatttttttggcattgcaatcaggtagcctattatattctcacaaagtttcagaagatttgcacagcagatatgctcattacctcattggcttaacaactgagtattcacaaatcctctgaaacttagtcagcaatagggtatctcaacaaattccccaaaccaaaattacctaggttcaacacacacgggccaatttttacaagtcacaggcacatcaaagttcctttgatttgcttgatactccctatgtttcagattataagtcgctttgactttggtcaaagtcaaactactccaattttaactgagtttgaaaacaaatatagtaatatttacaacaccaaattagtttcattaaatcaatagttgaatatattttcataatatatttgttttgggttgaaaatgttattacttttttctacaaacttgatcaaacctgtagcaaagtcaagacgacttataatctgaaacggatggagtactacatatcaaagctttttcttgaagtagcagaattcgggtttgggcgtcaggtaagcaggagagggcactagggttgggggtgtataccttgaagacgagggcggcggagacgccgatgatgaagaggaaggcgggcatgacgaagtcggccaccgtcaccccgagccacggcgagtggttcatccccggccacgccccgccggcgtcgtccaccagtatcatcatctgcgcccccaaccaaaaaaaccaaacccccagtcaccacgagaatgagaggatccccgaccacgccgtcgggagaaatccggtcgaggaaggaggctcacggcgacggtgaggccgcggaacacgtcgagcgaggcgacccgccgcggcttccgctcagcccccgccgggtgctgcggcgaaggggatgatgcggggtaggggcggatctcgtcgtcgtcgtcggcggaggcgaggagaggacggcggtggccggcgtcggcgtccccgtcgccggcgatggcgacgacggcggcgtccatttttgggtcgtttgctcgtgccgtgtacagagtagaccagttagtagtaaagtatgtcgcgaatttgtattatattgaaatacgtgaaatattcggtcggttagctctnnnnnnnnnnnnnnnnnnnnnnnncgtttagtaagcgggaggtcttgagttcgactctcaacgagagcaatatcttttttataaaaaaaaaattatacaactaaatttttaaacctgcgctccatttaattttattagggctaaaattttaattccggctattttaatttgtttcaaaatttggaggctgtaatatgagaacatgaacttcgcttggatcatcttacatttatttcagctaatgtattttactttagaaccttttattacatttttattttttattttggattattttacattgctgccatacccaaatcttcaaataggccgaaaacatcatgggtgcattagggtgtcttaacttggcttgttatctcgacaaagcttaactagcccatttaaaccaagctcatgataaggccatgcggttggttcggtcgatcaagaattaacagttacatctatcatgtagcaaatgaaaaagaagcaaatcttgcctttagagcatactactatgtccaaaaaaagactaatcctaacaacgaatctagacacatatgtgttttggctctcccttatcaacacgtattttcttgtgtaggtggaaattagccgcacaagctaaagaagctatctaacacttcacattgtcaaactatgctaacttttgaggaagatccaaatgcgtctattgtccttgacgcggcaagaggattgtggatagggagaagatcgtgatgacacatcaagtctaagcttgaggaaaagtataaaggatagttcatcgtgaagaaaaagaaaaggcaatcctaacttttcttgtaaaaatatgagtctaaagagtaaatttagaaatttgataaaaatattaagttttttaaaatgaattactaccagatcttacctaatagttgtacattaattaattagaagaattaacatatacaaacaaaatagaactacatggtttataaccaatcaaaaataccaaaaagatctaaaacattcgaatttagagtctcattaatctcaagacagctagcatacatcaacgataagaaacacacatttcctatttttgtttttgtccgtgtgaactaaccttatagatcgacacatctcgtccacgcttagtcatcaatatagcaatataaaattaagagataccatataaaacatcccaaagaataaccatcccacataaaactcaaaatcacctactaatcgatttgaatttagaaaaaaaaagtcatagtattaatctccaagacaagcttaataaagccttaaacacccttaaacacaaccaaaaaagcatcccaaaacaccgaagttaccatttcccacccgttcgataccgtgtgcaagccacccccctcccccacaccccaatcctcctatataaacccccaccctgcctcctctcccccacccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacgatgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaaggtttgtatatgtcccgatctggcccggttttttggtttggggggcgggctctcgatctggcggttccggatctggttttctgaccccctgtgtgggtgtgtgtgcagttggaggggttgccggcgatggtgcaggcggtgcagtccgacgacagcgccgtgcagctggaggccaccacgcagttccggaagctgctctccatcggtgaggtttcgatctcctctctcgggaccgcgagatttggatggatgtttgttgtatcactcgttgacgttctattatacgggattaatattattgaggactaggccagctctagattcgtttgtggatgaccacgacatgcttgtatgataatttactttgcagattgggagagaatgagagatacaaatccatcgcggtgtttcgagattgggaactttgttagcactgtctagtacacttttgattgaacaatcatggttccaatgggatacttgtttcggtagttataaagatggtgtttgcttgttagtttacacatgatctcttcttttacttttaatcgaactgctttatttcgttttaaggtagctttttgggtaaagtccagtgaaatataactgattgcatgattctactcctataaacagactgttaaaaggtgccactttgtaatgatttgtttaaatgtttgtagagcggagtcctccaattgaggaggtgatcaacacaggggtggtgcctcgctttattgccttcctccaacgtgaggattatccccaactccaggtgtgtcaacagtcacagtgatttaatttactaatagtgttaactaggaaccatttgctaaagctaaccatcccccatgggttttcttgcgcagtttgaggctgcatgggcactcactaacattgcatcaggcacatcagataacaccaaagtggtagttgagtctggtgctgtgcccatctttgtcaaactgcttagctcccccagtgaggatgtccgtgagcaggtatgtcaacagttaacagaagaattataatttccctgagggacctgtactgcatgatgtttagattgttacatttctctctctttttttttaaatcttcgcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtttaattctgggctaccttctactttgatgcactgacctaagtttttatcattaggatggttttgttgattttttgtgttcgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgtaagtgcctccttttctcttcatgtaacccttgcgctatgctgaagtctgaatttcataacaaattgttgaagtctgaactgctgttgcttaattcaggcatccttcggcttcagtgctcattccagctttgcgcacggtgggtaacatcgtcactggggatgacatgcagactcaggtaaacatattaattcatttggttcatttctatttatacattattcttttgtgaacaaacatgaaagctgtaattcctagttgctgcagcgattaaagagcaatgtctccagaaattgattttgccatctgtttgcttcatgcgcgtgttctcctttattgggatgattaactctgtagctaatagctgcagtactcttctgtaatgtcaagttatggcaaagcttctctgatcctactagatccatgagcatgctgaatggtgaaggtgtttggattgtacggggagcatgccctatagatattcttctgttttctcccctaatatttttatggctaattgattatttagtgttgagaatatttacagctcatttattatattagcttgatcatttcctctttaattctttttatgcgaagtgtggcaaaattttcaactaggatgtatcctttttagctattcacatatacataattcggctagttagaatattatgtagcatgaaaaataaagcaagaccaccatgtatgtcaaattgtgcattctttgttatataccaaattctgaatgagttggaacacagtatgtatgataatctaagttgggaggatgaaatagttctgttcacctgataactggtactgtgtcgtactgtgcaatgttattgttgaagcaggacatcattttagaaacattttaagattatctccatcgattagtgattcaaaatgaacaatacctatggtttagtgcctccatggatgctcatatttccctctttttgatatgcatatattgtaaggatggtttgttagtgcattgttgtactggcagttgctacatttctgtacattttgcatgagattgatcatggggagtatttgctaggccaacgatatcgtgttgacattattgactccattctcaagagagaactggcatttcatatttcacttgacctgatttttatgtgctatcaatgtttattgttcatctctctcaattgctgcttgactacgttctcaagaaagaattgacataagatttttatatgttatctgggttcattgttcatctctcaattgctgctgcagtgtgtcatcgatcatcaagctcttccatgtctcttgaacctcttgaccaacaatcataagaaaagcatcaagaaagaagcatgctggactatctcaaacatcactgctggcaatagggaacagattcaggttggtgtgatttgaagctagaattatcatattgatattgcttacaacattgctaaaatactattgtccgtctacaggctgtgatcaatgcaaacataattgctcctctagtacatctgctgcaaactgctgaatttgacatcaagaaagaggctgcgtgggcaatctcaaatgccacttctggtggaacacatgatcagattaagtatgccttttttttttctttgcattacttgtgtataatatttatagaatttttcattgtcattatggtttgctcacaacatatgaaatgtcgaccaggtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctgaaggtatgctatctttagcagttaaactaagtaggattgtggttgatcatggggatggtgttttctgatcgatataaatattgtttatgcagatacctatctggaatgatgtaccactgttccttagctacttgcttggggctagtcagagttgggggagtcttgtcgttggagtcttggttgggtcctggcggtctggtctcaggcagtcgtaatgtcagtcccagtccttgggcttgcatcatcgccagtggtgcagcttggtcagtggtcagtcttgaaggtcatccagttggatttacttgggctctgtctcacctgtggtgggagcatgggggagagggcgtccagagccgcaggtgttgtcgggagagagttaccagttggcttttgcctcctatatagcatgaatgaattatattatcatctgttttgaggtaaaaagaaccttgaaagatagggtttattcatggttgtgtcagtttttgtcaagtctctatgtgctgtattaacatgtcagaagagtattggcacaacttataaacatcaaatagcaactgggtttttggtggagtcccatgctggtctgtctattcattggtttgttgttgtaatgtttttaatgtcatggttttgtcgcgtcaaagtttgtcggtggttgtttgcgtacttgctgttgttgttgtcgttgtcgttttgagattcatgttgttatgtctgtcttctgtctagaaaactgaaaactcaggagaaccgcctagggaaaaagaccgcctattttggcgatgagttttggttgagttcttggtgtcatgtgtggagtgtaaaagggaagatgatggttcctagttttaccccctggaacccggtttatgattgtatgattattacgttatgaaccatatgcacatgataaaaggaagagaagggagctgtcccacttcatatttccctatggagatgatttgcactggtactgtgagacttgttcttttgtttagtcatgcgattttgatcttactagatgtgcctgtgctgcttactacatgtctcgtgggttggccgccgatgattgcagctcaatcccaatgcaatcatgaaagcagaaagcaggagcagcaaggcagccactatgtcctaataattggaaaccatgtgggcaggcggctgacggtttgggcgccgtggagtagtttggaagcggtttctgctgatcttgtgctgggcgttccatgatgattgattgatgactagctgtggcttttctagtcttttttcttttattatcgtgtactgggttgcattgcagattagcgcggctgggaaggagatttggtgtgttgggttagtcatccccaggtccctggctcctggaatcttgttcctcttggatgtgatctttcaagtgttgctcttcccttatgcttcctgcacaactttcatgttcactccaaatttaactttgacctgaaaaattaagttgtatgcgtacaaaatacaatgtgttaacactagcacgacacatcgaatgtgattaccgattaacctcagtgcaatcattcctatgcagattgggtacaagagttgatgctctatgtacgagtaagtgtttaattaatagtagacacgtcatctctaatagtctacttgtacacatatacgttaatacctcacagcgtaatatttttcttcactctactcttctctacctatgttatctacagccttatcttttcagttatactcatacttatcaatttttagtcttaaatttagagttgattttggtttttttattgaactttatttttcagtgtttgtttttaatcactaataacacgtataaaaaagttttattcacaaattattttttgtttgtaaatatactatttggggccgctaatgtgttaatttttgaagcctgcttatgtcatttattgtattcgcactaaatggctgtgcttcatatcacgcaggttagtagtactttcttatttaatactccctccatttatttttgatagtcatatttcatattggcacacagatcaatgataaataattctacttatcattcatttaaacatgctactagttatttctcgtaaacaagcgattcattaatatttacatttctcgatgcccatgtagccaatcatgtgtggaagaatgaagagtcacgcattaaatcggagaaaatcattaagatgataggttgttagattgaaatatgcctatcaaaaatagatttctcagatttgaaaatatgactatcaaaagtagatagagggagtagtatttattatacttcacatgaagtgtcaagaaaacggtggtgtgaatcgcttcatcccagaggagaaaagcggacggcgcaatgcagcaaaacactccatagtggagagggagaggagatgaagggcagggagggacaaaccctagtgctctcctttccacagcatcaatgacacgagttgatgaagttgactaaagctgtgattaagccacacagatcaggagagctcatcagggaatctcatgctgggacaatgatagggagagaggccctgcctttgcattgcatttctgtgttctctgcttttgtccccatcttttcatgactgttccctctgttctgttgcaacagtgctaatgctttgcttcttttctttcttttcttttctttttttccttttcaatgttggtatttttttcatcttaactacaaaactgaaattgtattataggccttacaattgatgggggttgatgatgcatatgcctagctgttccatggagtgtacaattaaatagggatatacaaaaggattagatggctagaactttccattgtttctagttggatgtcctttcttagttttttcattgttctcttgctagtacagtaccttcttatggttgtactttgctagtaatttaaagtcagtaaaaatgattgtggactagggcaagaggttaggtgctagtatttttcttctttagggcttgtttaattatagacaatactaagccacatagttggacttttcaacaatcagtatcacctttctctaattttttttgtacagcatttctatgtatttattctctaaagcttgttagtacttgaatcattaaatttcaaataaaaatttggaaatcgtactggctttgcggttgacatgatttttgaacaagctcactttctcctcctttcctgactgtaaagaagcaacccgtttattcagctgttccttgtctccagactccaaagcgactcatctatatttggctggaccttttctttctttcatttcatttcattttcctttttctttttggtcttcctgtcctaattctctccctctcttcggctccttgtttgacacattttcctcgtttatttcaatcatctttagttcatgttgagttaggtcttctcttactactcaactatgtgttgtggatacaggtaggtgtaggttggatatgtatccatttaccatgtgcatatgtaatgtatactgttcgttttcttttttccatgataaataatgtgtttctactaaatatctagatggagcatataaatgcactatggcgaaaacttgcagagtatttgattaatagattccaaaaaaacaaattgcaataataaaattggtggtagaattaatcaggtagaatttcccacattccccactaggtctcagtgcaaaatatctcgtacattagtatcatcactttcttttctttccctttccaagtgtttcgccttaaactcttttatctgcatgattggaactagaataaaaacggtcagaaacgatgaaatctctctgaaaacaatatgctccgttggtcaagaatttatcccacaagagatttggtgattacatgactgcagctcaaatggtcacaatatatctataatcatcgtatctaaattcaagtgctaagatttactaccccaattactccatactcatataaatgttaatgaatctaaacatatatatatatatatctagattcattaacatatatattaatacggacaatgatagaaagtcttgcagtatgaaacgaatggagtattatattaggataatggataatgggatgacatataatggttaacttacacactctgcatcagtgatcctggtcccacaaggaagacactgatgcccggttttcagcagataaggcagagggcaccactactagagatagatagggctacctgcccccatcagggcccacacgtcagcctcacacccccatatccccatctctccctctcttttatacaccacgtttgctggcttggcttccttccacactcctactgctgctggatagtatagatcgtctctttttctttctttctttccttcctccacaactactccctcctcttctctcctcttctcctccctttcgctccaagaaacgcagccaagctccgcttcgcttgcctccacgccaccatctgcgcgcgccactccgatcgatcgatcgatcgatcgatgggttcttccgatcagaaggtgggtgatcggcgcagtgatcgtctctgttctctgatcagaagaagaacaagaagaagggaaggtttgatgttttcgttgctgttcttgcaggtgatcgggatcgccgcggcggcagcggcggcggcggaggaggctgggaggcggtgctgcgtcgaatgcggcgccaccaccacgcccatgtggcgcggcggcccgaccggccccagggtgcgttcttgttcttcttcttcatcatcgatgcctttctgaatttttatcagtgctgttgttgatcgtgatcatgatcatgatcatcagtgaccttctagatttgataaccttcggttcaattcttggacttaatggagtgatcttgtaaaacagtaaaaagaagagagtttgttggtggtatttagtgaccttctagatgagttttactacatgaaaattgcggttatttagtgttttttagatttgaaattctaagttttttgacttattctaagtatgagtttacttggtttagtggcacaagatgattaagttgatgatttatttggattaagctgtgagggagaaagatatggtgatgattgtcgtaatcatatattgagtagctgccctgtggaacatttcaggatctttaattcagtttgattccattttggtggttaggtgagctgttccttgcaacagtactaacctccaatccaaattccaaagtgtgaactgcttaaaaaaagggcagctttctttggttccatccaagctcctaatcccatttttaattgctcgggtcaattctctaatggcatccttatcaccatacctgtttctctgtcctggtaatagcatcaagccataatatagttcagagaactgaataaaatagattgccccaaaaaattgatatgatattgcttgtgcttattagcaccatagtttgacttgggctattattgagtggaggattgttgctgcggattatctaccattaaatatttcgacaaataaatctaataaatagcttaaaacaagtagtctaagcaatgcagtagaaaaaagctttttgagaaaaaaaaagtatagagtaaataatccatttcaataattcggtgaaaaatctgaaaagaactaagcctctggatgagcactgaactattctttttttggtttgattgcagtcgctttgcaatgcgtgcgggatccggtacaggaagaagaggaggcaagagctaggcctagacaagaagcagcaacaagaacatcatcctcatcatcatcaacaacagcagcagcagtatcagcggcagcaacagcaacagcaacaagaagatcacagtgatgcagcaagttcagtaaaagacagtagcagcagcagtagcaacaaaagcagcagcctccaagtggtgaagaaaaggagggtcctgatgggagtggaggaggctgcaatcttgctcatggccttgtcctcatcttcacccacactactacatggctagctaagaacctcacaccattgatgcacaattgtacatacagtgatacaacacaaacacacaaaacacagaccacccaatggttccaagccaatcagatgactgtcttagattatcatcaggatgagatgagataggagggggaagaggccattttcagggtgatgttgatgtcaaggggggactggatttggttcttggatccatcctgccttttgtgcaaccttagatctctgaaatcgtcatatcgcgatccaaatccgattgcgaaggcgcgatggagggaaattgtgtgcccttgaagagggtaagaagctggtccctgtccagttgtcctgtctattgttgatcatggaaggctccttgtaattagttagaggtcattttacacctctcatatcccctttttctgttcatgtcttttgtttttatgtgttttgaatgatgatgttcttttcaacttgagaaggatggtgaccaaaagaagacaccagccttcttgacttcatgtgtgcaataaggatgaagtgaataaaaatgatttgtttgtttttatttcagttagtgcaacaagtagattttctactatcatctactgggattacagaaagctgccaatgtgttgctgtttcttgtgccaatcagatgggattacagaaagctgccaatgtgttgctgtttcttgtgccaatcagagttctgacaatggaaaacaacagctgtgacattttgcatatcatcagaataataggcagaggctgtggcattgagtccaagaccagaataatagacagataaaaagactatcaaattccaactttattagcatatcactcttgcaggtgcagatgcaaagaaagcatcatatacgattatatgaagtaggaagatataagcaaaccaccaccatgaattacactcattatgctgtagtaatcactgatcagctctgcttagataagaaaggctcggcatatacaaggattagataaaagcagtgatcaactcactgtatcactttatttaagccctattgcaactgatatttgtgtaggctagttaacgctgcctctacaatctatgaaagtatgcttcttcgctgttgcatacatcaggttcaaaattacagctctctattcgtggtgaaaactttgaactagtcctgatctcaaaacaaagaaagtgactatggtttttgaaggattgattttcacaaacaacgatgcaaagtttccctcgacatgtgaagatgttgagatttggccgtaaagaaaagtcattccaactggccagtcagttcagcttcctcgtcaccatcaagttcttgctctactcctttcacctgccaaagaagtgtgaaatatcaaatttcgctagatcaaaggataaattactgctttaagcagtctgaacaaactaataggaattgcaacttctttcaacattttacttatcagataaaacaccttatataatgagccaaaaggagtggaggttttgaggaaacagaaataaagcacagaagagatacctcagggacataatgcatgagcatgttttctatcccagacttcaatgtgactgacgaacttggacatccactgcaggcaccttgcatttttagcttaactatccctgtttctctgaaaagatatcatcatagtgagaccatgcaattaaaattcttaaaatcagcactgcacatgaacatgagagagatagactaacggatcaaatcctcgatattcaatgtcaccaccatcatcttgaacagctggtcgaatgcgagtctccagcaactcttttatcattgcaactatttctgaatcatcctatggcatagaggaaaaatatgtgaaaatacttagggtgtgtttgaggaggaggggattgaggagattaggaagatacgcaaaacgaggtgagccattagctcgtgattaattgattattaactattttaaatttcaaaaatggattaatgtgattttttaaaagaactttcctatagaaaatttttgtaaaaaacgcaccatttagtagtttgggaagcgtgcacgcggaaaacgatgtgctttcttcctcaaacttactggaacgaacgctgccttaacatctcaagcagacactcttaccaacatgacaacagttttttaattgataacaatatgtgatgttacttctaccttgcataacttcttggttcaagaggaatttacagcattaacatttcaataattggtagaagtacatattcatcaacttagcagcattattcaggagcactttagaagatatcttagcgaatatctatattgtatcatcacaacaccaccacatgtaagcagtaactactagttacacgtgcaatgaacacattcaaatttaaacagataagcaattttccctagaaccaaatcaaatggtaatcagggctccatttgaatcctttttaggctacttttcgtttactgctgaatataacttatccatagagacacagattcgcaaataataaaagatagatctgcctgtcataattttggtactaatcactgacaattagaacttacctaataccagtatcctaaatacaatgcatatgctgcaatgggtctgacagatggccactttgcgcagtatcactaggaacagctaaaagttatactaatggaatgtaagatctacactaaagttgtctgggatacctcatgaattgcggtgtccatagaagctgcagtacttgagtccagaaagagtgattgcccagatgagtaaaagtccattatcacagcaaaaacctcaggcttaagatagtcccaagaagtttcctctgattttgtaacagttacaaaatcggatccaaagaatactctggtaactcctgcatgtagtcaccagtcaacataatgtcaaagtaaataaaacaaatgaacactcatgacaaatttgaagaagttgttctagaaatatttactgctacgagaatatcttctgactcttagcatgattttgctgttatggcttcaaaaaggtactttatatagttaatggaaaacatggcaggataaaattatgtgttacaggccatcatgataccactaagccttaaacacttgtggtggtgtgttattttggatgattaaacaacgaaatgttgcacgttcatagcaaatgtgaaacattatgggaattaacaaccagcagcttcagatatatcatttcatccagaattaaagatattaagattattgcttttggtttgagtttcttttgccttcagacaattccaccaatgtcatcttctcacagtatggtttgccacatctttatcatttacacagctcaatgctagcattaaacgaccaagtttgcttggctctgggctctaagcaactacatttttaaggagtctctaagcaactacgttggttacttaagcaagcattttggtaacccatgtcagtgcacattgctttgtaaggcacatttcagttgcatctcacaaaagttatctacaacagctaactttgttttaataacaaaatatcaacaagaactgaaaaaggcaaatagaacacaagttaaacagaaggaatacaatatagttaaataccaactcacagaataaagttacttatagtttgtaccaaaaatggaagatgatatagcttatttgtataaagagtgtcctaggaagactcgatacattgaaagagttggccagtaagagtggtaactaatcatatatattaagaggacaaccagaggattttacaaggaaacatataaccgagatattcaaggaagctgagatggtgaattgattaacaccaacaggtaactagcggaacaggaaagaaataccgtcgattgcaaacagcgccttggccaaaggagatgtcatcgcggtccgagcattcgggaaatcagagctcccaacctccataaccggctttccaggatagaacatgagcgactgcgggttcggggtcgactgcgtctggatgaacatgcccctcttctgccctgcccatcacatcaattccaaacaaaaccacatgagttaagcaagcattagacagagaattcaaaataaaatcccatttcagccaccaaaaccatcacatcatttcctgtcatctaaaagaagtactaaaatcctgcaggacagtaactaggctagataacctcaggtcctaaaaacatcaatcctaatccaccgcaaatatgatcaagcaagctacgcaaacaaatcgttacttcgatcaagaacacaaatcttgcgctaaactagttgggtaaaaaagatccgcatctttaatcatcccacatccctaacgaagaattccacgatagaaaaaaaaataaagaaggaagaggtagaccctgacctccgaagcggctccatggggaaagagcagggctcccgtgccgcgccgccgtgcgcgcgaagggcggcgacctgaggcggtcgagggggccagaagccgccgccgccgcggatgagaggaaccgcggcgggggtctccgcatgagcagctgcctccgcaggagctgggacgcgagcgccgcgaccctccgcctcgccatggccacctcctcctctcctcgtcgtcggcgtcggcggcggcgagaggaaggctgggtctccaatggcgagagcgaggggccgaggaggaggttgtaacttgcaaggccgtggtcggcccatggatgccagtagtaggttaattgggctaaaaagcccactatgacagattctgtattttctctctttctttttctttagagggtacaactattttctctcttctaacaagacatccactatgattgtgattaattaattattaatatttttttaaaaaaataaattaatataatttctaaaataacttccttatatatttttttatataaaaggcattgttgagtactcgaagaaaacgagagagcagtggatgggaggagtgagaaacaaatacagcttaaggatgaaaacggttagaaaagatgtatttttttattagttttatgagaatggtattgagatgttttgattttttttatttatgaaaagttttgtttagtagcaatattatgcagatagaaattagaaaaaataaatcttatggtcagaaacaattgaaaactatatcttttttttacagaagctgtatcggtactatcggaaaatatccgtaccgtttttatccctagctgtattttggattataatccgctgcagattttaattttaaaattggtctactagttttctggaaaccctattgaaaagaccctgcttagctttatatcagattataattccgcagaagattttaattttactagaatttgatttactagttttctcaaaatacctttagaaaaccactttgattatacaggttctgtatttttctagaaaaagttttctttgctactgggattgcttagctgtacatcggattataatccgcagcggatttagtttcttctttttctttttccgtctcgctctctcttttcacgattgctaactggacatataaagtggtaacataaaatattcttaaagaaatcaaacttagaacttcaatatcatcgttggattatcatccagcgtcatgccgagtatatattaacaactgaattatatcacttatttacatatggattttaaaccctacaaaacggcacggaaacaaaatgataatgggatagcgatgaaaacaaaatataataaacgagtttatttaagattttttataaacactatacgaacacaggtacatctgagattgatgaaatcatcatgtgcgcaaagctatcgaaagaataattagctctaaatactagcacccgtgtctagaactttaacccaggtgaattgattccaccaaaagaaacatataaatatatcacttcattgtttaagtattatttttgtgttatgttggtacttttgctggacgttgtagatgttgaacctctagatccacactaaaaacgttagtggttggctcaccgaggcaaataccatgtttttcacgctgtagtgtgtacacagaactgcaaacgctcatagtttgctagacggtgcctagcagcgatcatttttaatgcccttaacaatatttaatcacactttgaaaacacatacactcgccgttttagaaaagcgtcctaattttatttatttacttatacagaggaagtacttctatatgttcatgtgaagatattaaagcggtataggtctaagtgtactcttcggaaaattattagctcctcccacaaattactacaataccctaatttcttttaggtgtgattaacaagctctctagttaataatacttatcgaataaagctgaggttaaaattttaaaatatttgactatgaataatttctaaaatatttatcttaaaaggtatataggttagtcttaaaaatatacttaaaaataatattttattgatatttttatttatattataataaaaaataaatgttaaattgttttttaagaccgcgtccttgtcaagaatgataaatgttgttagcccggagagagcacggacaattttgccttctagaactgattgagtttcttcatcatttcatcactcggtttggtttacatcgctgaaaacaaatgcttaatgtcttatctaaatatcttttcccttttttcatgtatcctggcttaaaagttaccaaaaaaatgcctagccttgttcgatttgaaagattcgtataggaaatctcaatttatcttgaatacacactattcatgtatttggttcataggattcaaatgaaaattttctattaaaatcatataccaatcctccaagacctttctaaaacgtaccgattccatagaagtgaaaacatccattctcttttttttagctcatggaatgaaaaaaattcatgtccatcttttatttttgcacgtgtatttatatgttattttttgtgtttttcccatcatgtgatttggaatccggaaccgaagaggctcaaaatgagtatcattttcctgggttccatacatgttttgaatctttttaatccaaaatctttcctgtaaaataatgttggcatctcagattcaccactttctgtgccatgtgccctaaacagctaaacctaaagtttagtacttctaagtaaaattagtaagaaaaggagctggtttttaataaattcaaaaattgtaatttttttcacacaatcagagaggttctgggagacacgtggaaatcacaggcaagcaattgatgtgagaatgggtcaaaaaagcaacgacctttctctctctgtttagcctttaggtcgagtaaactccaaacgtctctctcacatgtccatgcattaagcaggtgcaatgcatccagtccccactgtcaccttcatccgagatagcctaatcctccactaaaaaaatgattctctgtcgcaccaattaacaaatctaatgataaccatccatgcattggttatagtctaatactctctccgtctatggattttgagtatttgtttattctgtttgattactcgtcttatttaaaaaatttgtgcaaatataaaaaaataaaaagttgcgcttaaagtactttggataataaagtaagtcacaaaaaagtaaataataatttcaaatttttttgaataagacgagtggtcaaacggtgcaagcaaaaacttaaaattccttatattatgagacggagggagtacagtaactatactagtgaggatgatatgatagcaagaaaaaaaaagaaaaaaattgtcatatctgaattttatgtcatcagtaattcagagccaaattgcataattttatgccatgttcttttctaattcttactagttatgattttttttcctttccaagcttagacttctaaacgattatttcgtgcagaaacttcttatatgaagttttcccaaaatatttttctaaaatatttttctttactttatataagttaatttattcatttatactcttactttatctatcacaaaatcagattatctaatcaatttcgactattttagacaggaccatatacgtagtatattctaactaacaaagtagtagtgcgcccatacgcacatgcctattcccatatgcaacttgaaacaaatcgaatttcgggccctttgaatcgtaggaataaaaaaacgtaggattttgataggaatacagatgtaaaacagataggaatacagatgtaaaacagagtaatatacatgaaaaatacagaaatgaccgtttaattagaccacatgaaaaacgtaggaatcagatgagagagataaactatgattttttacaagtggttggacctcttgctaactttcctccaaaatctctataggattagccattccataggaattttaaaggatagtatatgattcaatcctttattttaaaggttttcataggaattttttctataggattgaaattctttaaatttcttacacttttcctacgaatgaaagtggcccttctttcttgaaaaatcttacaagtgctgactcgtttgattctttttctaagctgagagagagaaaggcattagtttttctgttcctgattagcggcggagtgtgccgtcctcgctttcacatccaatcaataccaagaaaaaataagagctttttttttaacgctaataatccgaagcactccctgaatccaacccatccgcggctgctgctgctgcagcagagatgacaaatcagatcgagccgggagctctggttgttcgtctctcggttcaggtcaacacctcgggagttcttgcttcggtttgaagcgaggagctctgttcttttccccgtttcttggtactggtgattcttggcttcgccgtgctggaatcggtgcagctttagggggggatttgggggaggttttgatgcgattcagagagtaaagctacatcatttcttgcatttcgcgtggttcttgggggtggattctttgcgtggttctgtcgaggtcgagctatttcgacgcgtactccagtctgaaccttctcagagatccaggttagtgtttcttggta

SEQ ID NO: 81121 - DNA, 9643 bp, Oryza sativa
ttgtcgacggcggtccattcctgccaaagccagcggagtcttaaagagcgcccaaaaagttcgaggtttgttataccaaggcctcccatgtttttttggtctacagaccctcttccagttaactaggcagtgtcccccctgtgcctgttctgaccctgtccagaggaagcccctacgaattttgtcgatctttttttcagcccattttttaagggggaaaacagtgaggtgataggtcgggagggcggagagggtagactttatcagaaccgtccgaccagtcttgtttagtaactttcctttccatgttgggagcctagctgagaacctatcgatgagaggttgaacatctgattttctgagtttcctgatgtggagtggaaatcctagataggtacaagggaagtgtttcatctgtgccgggaagggggagagaatatcctataagtcgagggtgtcacatctaatggcatagacttcgcttttggataaattggtcaccatgcctgtcgcgaggccaaaattttgaagaatcatttggaccgtatggagttcctgtttatctggtctaaggaacactacagcgtcatctgcatataaggccatattgaaacgagcagtccgcctgtggagcggttggaggagacctgcttcctgtgctgcggcaaggagcttttgcaggggatcaatcgcaagaatgaagagcatgggtgatagagggtctccctgacgtaatcctcgtccatgcaagaagctgtttcctgccttcccatttaggaggatctttgatgaggacgttgctagaatggaaataatccatccaatccatctgtctccgaattccaaatatctgagtttgtctagaagataaggccagctgatcgagtcgaaagcttttgcaatgtcgagttttagcagaatcgtgggggttttggacgattggaactcacgcaccatgttgtttacaaataggaagttgtcttggatgtttctgccttttatgaaggcactttgatttgttcaactatatttaggaattgcaagtctatgtatttatttgttttgcctcctttcttgcataatggaacaacctttatataatcaaggaagtatactgtacttaccagttaccagagtatgtgccagattaagccatccattaattagatgttgaagtaaactagatgactatattgcgatgtattctaagtccactacttataaaactgtagggtataggatttgcttatttctagtaagataagctaaacgaggatcctttaggtgatatggccaaactaagacacatatacataacgtattatcatgcatctgataggaatgcaaaacaatgctgtcctatttactttaactgcaggtatttaggctcgtcttttatttttctcaagaggcacttaacataatatacaaaatttgaagaattgcattttattttaaacttctatgagttctgccttttcttttatgattgttatccatggtgtgcctaaataattgttcgatctagaggtgatccaaagattcgtatatattagacgtaaaaataatgcagtgttttttttattttttagtctacaaatgtttgacaagaaaaggatgaaagagtgacataggcgagctctgtagcatactagcacccttccctccatgtccccgttatggcggctcgcgacttcgtcgcccctccctgcccactgacggtctccctctttgatccactccctagcacagattgcttgcctccctcttgagattaagttgactcgctcatgccactgctcttaaggtaagagaagctgagaagaggagtgtgtgggttctctttcccctgcttgattcggaagaggggtagaagatgggggggcggggagagcgcgattggagaccgtcgttggcgaggagaagcgaggaaggagggaagacgatgtggcgccgtcatgcaaggggaaggaggagagaatagggtggggaacagtggcggctagggttcggcgaaccgaggggatagggatgttatctttttcaaaaaaaaaaccctttcttttcattttctgagagtgcggtcctatattaggaatttcgtctccttcacgtaggatatactaggacacagatggccgttacgtaagaatacataagacagtaaacttacattgagggacttaagaaagattgtcaagttaagcgaggacgtttttgcaaaatttccaggaccagcgccggatgatgtggacatcagcggaattgagcacgtcgccccgaaaacgcccggagcactgtggtgcgagcacttcgcccacatctttaatacctccgtgttaacgaccaaatttggtaagatatgaaccaggttcgacattggaatcgaagcggattcggcgaagaaatagactcgaagaacagagtatgcatcggttgcgaaggcatttgttggcgtttgcatcggcagagatggatcggacagaggataactgataaagccgatggggtcggtacagccgattctgataaagatggcttcggggctgtttctagaatcgatcaatgtgcttcatgaggattgccacgatagagatagagctctgaacaaggcaattgtatctattaattaggatatttcgtgtaattttcttagagatatgtttgggcaaaagtctgccgcaaagacttatgatatcttagagtttgttagagataagagtcgtgtccggcaaggacatattttgtatcttgggtataaatatgacccgaactcaatgtaatcaacaacaacagttcagtaacactttcagtgcatcaccaccctttttactttcgttctatttcgacgagttcttactttcgggttgagctgcatcgattacgatcttcaactagaggtaaacttgtcatggcgccttgcgttctcgggattagtgcttccatctttatgacactctaatcttgtttatgtgattcgtcaagttatcatatacacgttgtaatctccgctagttgcgatctataacttgtcatcggttagaaagtaaccgatagagttatgttttgttattaatttagattatatcgtgtatctaccatctcttataggttttcatcatcttgcctagatcctatatttatatttacgcttaatgctgcatcggttgagttcgatctattaagtaatatctataactataatatctggcttgttttatgatcatcgagagatatagtatcggggtttcagccgatcttacctgatctagcttctttatatctcacatgcttgattgatatactagatctgccttttagattaagatcttattgcattcaagtatattaggctccttgtttgatatattctgcctgttctaatatcctagtttaaagtggtatcagagtattagccgatacatactggatctatttaatcggctatgctataaacgtctatataatcattgctttaatatatatttcgacttaagtgatttatactgtctcggcatagcgaccgatctatcccaatcacttagtttaaatatatatcgaaggaaggattatatgtcattaatatctacagccgattgagtagatttagttttattttatttattcatgactaccgatcgattccaatatgacatcggctcaaagataaatgatatgtcatcggcaactagccgatcagctatcatttatgaatttaaccacggtttttcttgtttttctttcttgttgattgtaggatcaaatcaactggcacgctcacgaacctaaaagcaagattttggacctgcacagaagttaagcagatcttccaggccagtgtgcgtttttcgcatcaacacgcttttggcacgtccggtgggactcaagttgcgacaacgtttcctcatggcagagaatccaccacagtcaccagcaacgggaggcaaaactaaacctccgttcactaagccaccgcccgagcaaccgtctgaggttaatgaagggaacatcgtcccggtcactatagacaaattatcactagaacaaaggaaggagtttgaacaaatgatgaagagtgcttaggagcaattcatgaattcattcggggaaacccgccagggaaaagttattcaaaagtacaaggtgaaggtggttgctgccgatgaacctggaacaagctcatccaaaggtggtaaagctaaagggactaaaggtgctgcagatggctcaggtgaaaaggtgaggaacctcgagatggtgaggttgaggatgtggatgaagatggtgatgaggagcaagagcccttgaaattcaataatttccaagatcatgttgactatgctttcaacatgctttgatcaaccaatcaggggtccttgtcaatactttaacgaatatggttaagtctgtggttgatggcacgatagttgagcatcaaaacacggtaccagtctttctaccaaatggcgtatttccacagtataggagtttggtgactggtaaccagcaacccgtatccaatgcaccactggtctagccgatggcatcagtttcggctccagcacctggtgcttcatcatcggcacaaagacaggtggttaatcctcatgtcttgactagagagcagcctcagcatgctgggcagaatattaataggctgactcaagagcagattgcggcaatgtttgggccaactcagcagattgttgaaccaattcagcatacaccaatcaggcagcatgtggtccagccgattgggcagcaaatagttcagccgatactgactgggtagagaacaccagttaatcaacaacatcagccggttggagcccagttaggttggagcccagtttgttactgtacagcagatatataacatacaacatcctcctcagaactaccttggaggtaatctgaacttgcagcatccacctcgctcacctcagattcaatatcaagaaggaggatcaccttagccccagtttctgccccaattcaatcaatttgatctagtacaacagtagatgcaaggagtaccccagcagaagccatgggctgatatgattgcagatgtcatgagggagcagtttggacttaagccgaaggacactggaaacttatatcggcacccttaccttgagtggtttgaaagagttccattgcctaaccgatataaggtccctgatttctcaaaaattttagggcaagataatgtgtcaacttacgagcacgtcagccgattcttggctcagtgtggagagacatcggctgttgatgctttgagggttagattgtttcctttgtctttatctggatcaacattcacatggttctccgcattgccctataattctgttcaaggttgggccgatttagaaaaacagtttcataattacttctacagtggaacctatgagatgaagctttctgatttgacaacggttagacagaggcatgatgaaactgtacaggattatattcagagattcggagagatgaggaatagatgttacagtttggctttgaatgactctcagctagccgatctcacttttcagcgtttgatagctccaatcaaggaaaaattttcatctcagcagtttgaaagcttgtctcaccttgcacagaaggtaaccttgcataagcaaaggtttgcaaatgctaagaaaaacttcaagaagattaatcatgtgtatccttataggtatgattctgaagaggaggataactccgaggtagcagcagccgagtgggccaggagcaaaaagatcatagcatgctcatgggtgaagagttctaggaaagaagaaaggtttgattttgataccactaaggctgacaagattttcgatttgctacttcgggagaagcagattcagcttcctgctggtcatgtgattccatcggctgacgagttagggaaaaggaagtattgcaagtggcataattctaattctcatgctaccaacgattgcaaggttttcaggcagcatatccaattggctattgaaggtggaaaaatcaaattcgatgactcgaagaagccgatgaaggttgatggcaatcatttccctatcaatattgtgcacacatatgggagagcagccaatggaggaaagaatcggagttctcgattgaattcagccaagattattaataaatatcaaatgaagcatgacaagcagcaggaaaagtactatgcagaagatgatggtgggtttgatcctcattgggattgtgaattcttcaggttctgctggaatgaggggatgaggctaccattgattgaagattgccctggatgcagtggcagggcagggagttcaagccgatcttacagtagaggaagtcggctgagtcagaagagggtttctgttcatcagaggttgggcccggtgcaccaggatcattatcaggatgaagatgaaggcaggaaatcgcagtggtgtccttctggtattttcaccaaaaatcagaagagaagggttcaaagaatgaggaacagagaacatttttaggaggtacaacaagagatcaaccatcggctgaagaagacaaaacccagacaggagtggcgtgctaagagcacagttacagcagccgatgaagatgaagctgacaaggcaagaagattgatcaagggtaaggctactgcatccacatcggtaaacatgatttttatgttacctgcagaattcgaagcaagacaagccgatgttgatgatgtggaagaggcctctgctagattaattttgtcaccagagccagcaatctttaagaagccaaaggggacataaaatcggcaccttaagccattgtatgtcaatggatttgtcaacgggaagccgatgtccaggatgatggttgacgatggggcttctgtgaatttgatgtcgtatgctacattcaggaagctgggtagaaatgcagacgatctcatcaagacaaacatgattctcaaagattttggtggcaatccatcggagaccaaaggagttttgaatgtggaattgacaatcgcagcaaaactgttcctaccacgttttttgtcatcgatgggaaggggtcctatagcctgttgcttggaagggattggattcatgcaaattgttgtattccttcaaccatgcaccagtgcttgattcaatggcaaggtgacaagattgagatcgtgccagccaacaggtcagttaacgatgctagcgctgatttacctctttgggagatagatggtattgattgtttgtctagaaagatttgggatggagattttctaaaagtgtccgattgtgatatacagccaattgaaaacggagagcccaaattattactttgagggcgtcgtggagggttcaaatgtctacaccaaggacacggtagatgatctcgataacaagcaagggcagggtttcatgtcggccgatgatttggaagaaatcgacataggtccaggagataggccaaggctgacattcattagtaagaatttaacagcagaattcagaaccaagttaatagagcttttgaaggaatatagagattgctttgcttgggagtattatgagatgccaggactcagccgatcaattgttgaacatcggcttcctattaaaccaggagttaaaccatatcagcaaccgcatagaagatgtaaagccgatatgtatgatgctatcaaggctgaagttacacgtgaagttacacgtttatatgatgctggttttattcggccatgtcgatatgccgagtgggtttccaacatagtcccggtcatcaagaagaatagcaagcttagggtgtgcattgattttcgcgatttaaataaagctactccataggatgaatacccaatgccgattgccaatcaattgattgatgcagcttcaggacataagattataagttttatggatagcaatgctggttacaatcagatttttatggccgaagaggatatccataagaccgctttcaggtgccctggtgcaatcggtttgtttgagtggattgtgatgtgtaacatcctgaaaattttgaatctggaatacggaatttaaaaattaagaataatcaaaaatctttttaaaaccttttttgcatgttgggatttattatgcatttgtgtgtatttaggttgtgtgccaaagatctcgattaaatcttatctcctagagggacgccctcagtccaacgtcctttccttccattatcttcacggtctgatttattaagtgcttcggtactaaacaaatcacagacctgaatatataacccgaaaatcttttcttatgtcgcaatgcgacatatctttctcaattcttaccgtccggttatttcaaaccttttattattccgactcgataattccctcgaatacctataaacgatcgacgtatttatttatcgcacgttgattcgaatatcctcaaatccattcctaccgcgatgactggatttgtatgccacacgtcacccctagaatcctcccttcgctatcatcgttcgttcgtgcgagcactctcaaataatcctacgacgacctataaatttgtttgtcgggcgttaagcctaaactcctttttggcatcacggtgcatccatccaaacaaatcaagtctcgtattacaatccatttatcccgcccttgtgcattctcggaatatctataccgacccaaatccagttattgtccaagctacaatacaccatataatccaatccacatttacagtccaagtatatttctagtccaaacacagagccaaaatcaatatccatactctacagtccaaatgcacagcacattatacagtcccatttacaagttccaagtacagactaccaaagtacaaatcccaggaaaatactaagaactcctattacaattgggccattttcctctctctcccagcccaacgaacaacccagcataagtctattttaccttcccagagacgtagcagcccacccctgttatctttctcaagccaacccactgaaagtctactttgcctcccctgctcaaaacaacaggcatgcatgcacaagaattgctcgatgaaatgcctacaagcccaacagtagtttgcaaccacttttgccgggcacacaacaggaaattgcaccaaccatcaaatgtctgggacccccctcaccaacatgcaaaaccaacacacatacacccatacccccattccacataacactctccaaacacatgcaaacacagtgaggagggctcacaccgaaaaataacaccaagttcacagaggggaactcaccttgcctcccatgcagacaaccacaacaccaacaaaaattttcacaatttgaccctttgcaaaaactatttttacaaatgaaccgtcaccaaaacttatttcaaaaataacacttggcgttgaatttagacacctcagcgccaaatagcgtggcgctgaatatgtgttggcacgctctccaaacacatgcaaacacagtgaggagggctcacaccgaaaaataacaccaagttcacagaggggaactcaccttgcctcccatgcagacaaccacaacaccagcaaaaaatttcacaatttgaccctttgcaaaaactatttttacaaaagaaccgtcaccaaaacttatttcaaaaataacc

SEQ ID NO: 81122 - DNA, 76425 bp, Oryza sativa
  unsure (1)..(76425): unsure at all n locations
ggacggggacggggacggggagaggagtcgcggagcgacggacggaccatatgggccggccgctacgcgacggccgacgcggtggggccgcgcgggccgagcccgacatcacttcttttgtaccatttccactgtcccgtgttaaacgtagcagtgggtttcagttatcaacgttggaccgtcggttttgaaacaaaattataaataataattttattgttattacatgataaaacatgaatattactttatacgtgtcttaatttttaaattttttttaaataaaacagatggtcaaatgttggacacggaaacttatggctacacggagggagtactacgtatatccgtcctaaaatatactattagtacgcataccttcgtttcattttaaatgtagttatgggtatccgtgtctaacgtttgacctaaaaatttatgaaaaaattaaaaaaatagtcacacataaaatattatttatgttttgtcatctaataacaataaaaatattgatcataattttttttaaataagatggacggttaaacgttggacataatacaaactacaatttttctaggacgaatgtagaattggttgggacatttttagtattaggaaagtcgtccagaatcgtagcatataggttattactatatgattaacaagtacacatgaaacgagaaaagtttttactatatgattaattacgtattaattattacaattcttgaaaatgagtttattttatgctttagaaaacttgaatatatatattttttaaaaaataatacaccgtttagtactctggaaaacatgttaaaaacgagaaagctgtcgggcaaaaatgctcaaacaaacataccctaaaagagacatatggatgccagagacaaatctatatcctcgttaaattcctgaaaaaaaagtcaagaataatatttataggttctgaaaaacttaaattttgattaacgaagtcatgaacatacacacacacgctactgttatatatgagtatttctgcaagactgaactaacatatcttgagattgacgaagttaccacgaacgtcttgttttcgatggatctatcgcatattactgaaagaataattagccataaatacaagcacccgtatgaatgtggatgaactagtttcaccacaagaaacctaaccagttgagttagggcaagggcaataaaaaagacgactgcttactctaatatttatacacgtcatttggaggtaacttaatagataataaatataatagttgtctcttcacatttactgcagcacacatatcaataattatttaattacttctctctcactccttcccagcttttctctttcctccaagccaatcagggaagattattcatgctaatttcttgttccgtcgatggtgctgtcgataggaaggctccaagccagcgctaggtgcattggcgcccgtgcatgatcgtcgacagattaatcgacgatgtttctctctcttggtactctctctccgccacgtaggtataaaatccaacgtaagcttactattaaccggtaatttcaagttattgtacttgcccttacactcacttcgtgttgggtagtttggtttgattgcaatcggagtgagtgcaacaattcacagcttgctgggtgtaatgtgtgtacggtgtgcaatcaggggggctgtgtggagtagaaccaaagtccaagttgtgttgagagagaactgaatggaacagacaaattaagagatgggggtgcaggatcttctcgccaaactgaacattggatggtccgattttatcacggaatttgtgcaaagctattgccaattacagtgcattattttgtgaagggactgatgaagaaaatgattgtatgttgtctacacgttgaaacatttaaagagtaaaaaaggagagttcggcatgaccgtggacatgattaagaaccacaccctgcaccctgcagagaatgacaagcttgtcaacaccgtatcatgacatgaccagttgcaaaagagaaaatgatttttttttacggttgaaagacaaaatgaaaaccactcaaaacctatacgacaaaaggcattacacacaatttcctttctattgggtgaagaaaattggtataactaaaggaacaatctatatgatgtggtgtaactatagagatatataagtgggccgacccgtgagtctacttatatgtcaaataagaagtaacactcaagtttttacgtcatggtcctagcttattgcacctaaagatgtaggtgggtagatacataaatctatttataggtcaaattacccacaaatggattcgcgggttacccactaattttacatgcggattcgtgggttggtccacttgcaaccatagacgtaactagtggagttgtaagtacatgactccacacacactaattcaagttagaagaatataatgcatatatgattgcactttcaataaaacttagcgagactaaggactagcttttaatacgaatttgttgagataaaggtttaccgatggtgttcgtctcttcgaacgtattgccgtgttggtttttccctgtttgggtatgtgttggtggcatattttacatgtatgtgctaatgtgcatgtagtatgagcacacagtacggtgcgtgcgcgcatgacagccatcgtttcacttatactgattatatacataaaggcttatcagcaaccaacatatactttgttaatagaacttctatatacatatgtatagcaatttaaagcaaatgctggaaataaaatacgataaaagccctaaaatcaactctaaaatcaaaatttaaaactaattttttattcggttcataaccgtcttaggataaacgataggtgtatgtcatgtgtaatcgaaagagaatggtgcaaaggaaatcaatgaaaatgatgatagagttatgggtgttacccatcaccaaagattaagggcccctttgaatcgtaggaatgaaaaaatggaggaataggaaaaagtaacgtaggattctaacaggaatgtaaatgaaaaacagaggattgcagaacgcaggaaaaacacaggaatgaccgtttgattgaaccgcaggaaaaacacatgaatggaatgagagagatagactcaaaggaatgtttccaagtggttggagctcttgctaaatttcctccaaaatctctataggattgcccattccataggaattttaaaggatatgataggattcaattctttatttcaaagggcttcataggaaattttcctatatgtttcaaatcctctaaaaatcttatgtttttacttcaaatcaaaggggccctaaattctgctgtccatgaatacatgttttgaatatgatttcagtagggcatgtgtagtgctttgtgcatgatgaaaaaaaaaaggaaagaagagaaagatagtgatacaaagctttcaccatctggaaaaaagagtggtacagctgggcctggccgcctccccacctcacaagtaattctgccgcggtaaagatctgtttcccccaccgcctgcgtgccgtagcgtgcgttgccgctacgaaagtccccgcgagaatgcaaagatatcgcgaggggagagagagaaagagacgagccagaagcccagaattacggcacgcatcggccgaaactacgggcgccgtcgtcaccggccggcacacaattaaagtcgtcaaaaatatccccgctaactccggtcggtcgaaccggccggccggctggccggcagcgtcgccggcgaccggccgtacgtgtgcagccgttgttgtgtcgcgtcagtctcacgtggtactacctgctcttccttccagtatcttactccgtactcccttaaaaactcaacctgggatattaggacaataaatctgaagactcgtgttgatattcgttgccaaagaatacatcacattctattttagattaagcttttgtgggacggatgaagtatgcgtaaagctgagcaagcaaaacaattgaacagattgctcgacgaggacattcgcgtgatccacggaatcgtgaagagaatgaccgcttatgtctatcacggctggcatgaaccgcgttctaacgtataacaacctactttatttgaaaaaacaaattcaattctgatgatgagtttgaggagttaaaaaagcttgaggctcgcaagcagctcaagcttgacttgtcccagctcgattcgagctcgactcgagctacaaatgagccgaaccagagcctaagcaaaaactcgcgagctttaccgaaccgagctcgaacctctactaagcaaatgtgtatagttcaaaatgtttattcgctttattgatttaataaactaatatatcatatatattagtatctatttacacagcaaattagcatgtgttagcgtaatatatttatcttagtcattttctactcttttattagtgcgatcaaatagaaataattatacttataaaaaatttatcattaatatatatattatattattaatggctgaggtcgagctcgaaccgagcttgcctaaaagctcaaaggtgtaataggcttggctaaagcttgtgtcgagctcggcttgttgacagccctagttgccaccagctgccagagccaaataactcttgttttgcacgtttcgatgtctccttcgtcttcttcggagccgtgctgctcggcgccaacaacgatttcgtcttcacgaattgttaccccgctaggtagggctccctccatggatggaatgaggtgcaccgcaactggccgaggttctaggactagctccgtggtgatggcggtgaccgctcctctctgtcgtcccctcgcctttttctatggctaccaaccgttgatctgccatcatcgccagcgcggcaagctctaggcgagtcagagtcagcgcctccccgtgcagtggctccctctccctgttgttgtcgcctatctccactaccttctcaacatggttccccccgctctccttgctggggctgggacttctccctttcctttgcaggagccgatggagccatcggaaggggaggagggagggatagaagaggggaggagagtgaggggagagaagaggaagaaggtgagatgaagaggaagtcgctgatatgtggatctcacctgttgactcaacgagtcaatcgtgatcaacctatcatgtctgcaaaacccactttctaaaatcatcggatcagtcaatttgtattggatttgaaagacgggagatgtgttatatggatgcaattcaatgaggaggagatcagagagataaaaatagaatggaataagttcatctagggttccttaacttgtcaacaaatccgattttcgtccctcaatcgaaaaactagacacaacgggtccctcaactatcaaaaccggtgcagatgaggtcccttggcggttttgagggtggttttggctgacgtggctaatttgactcgatcttcatcttacatggcactgacatgacgcttaagtggcaatttgatccgaaaaaataataaaaccagtgggaactacatgtcagttccacacacaaaataataaaaaaagagggcccacatatcattctcacccctcttcttcctcttctctccccttctccctctccatctctctcccctatcctctctctaggcgcgacggagaggcagtggcgcacggcggccggcgggagaggagggagcggcacggcggcggaggcatggctccggcggctgtgggcggaagaggaaggggatgtggagcttcttttctctctctcggtctctcccctctccacgccattgatctctccctctcctacttaccgcagccatggcggaggacgccccagcaacgtcgctgccgccgccgccgaggggagccagcacgcgtcggctgtcgcggagggaggctccgccgccgctcccgcggcactagccaccaaggccgcggaggcgctgctcccgtcgctcagcatctggccgctgtcgcagacattgatttgattccaagatttttttttttgagcaagggtcaagacccccatttcttttactagaaatgatcataccagtacaggttcagccaaaagcggcaagcgatttgattcgaagatagtatcagcttagctagcagtggctagctagccatgagtagtagtggcaaggagaagaagcagatggaccggttcatcgtgatccccttctcctccacctgccaaatgctccagcgtggacgtcgttgatgacagcggcaagagcggcaagaagccccaaggttcgtcgtttggagtcttggatgcttgttcttcacttctgctcgatcttgtcgattggtttttgcggggtgatttaggagtttggtgttagtgatgctgtgtgcgtgtctaggcggcggcagtggcgagggcggcggcgcggcggagaacaaacccaagggggagtcgctggtggcgaggcttctccaccactgccagcacatggcgcacatcggctgggacggcagcaccagcaccaccaccagcctccgctcctggaaccacgccgcgccgccgtacgtcgtcgtcctcctcctccaccaccgcgtccacctcgttagccttggcggcgccggcgacatcaagaaggagtcggcaccgacggggcctgggttgtgcagctcctgtcctgccgtctgtcgtagccagggccaactccggccgtcccttcctcttccgcccacagctgccggagccgtgcctccgccgccgcgccgctccctcctctcccgtcggccgccgtgcgccgctgcctctccgtcgcgcctggagaggggataggggagagagatgaagagagggagatagagggagaggaggaagaagagggggtgacaatgacaatgacatgtggggcccaccattttttttattaatttatgtgtgaaactgacatgtggatcccacgggtttattattttctcgggtcgaattgccacgtaagcaccacgtcagatgaagaccgagtcaaattagccacgtaggcatcatgtcagccaaaaccaccctcaaaaccgccgagggacctcatttgcactggttttgatagttgagggatccgttgtgtctggttttccggttgagggacgaaaatcggattcgttgacaagttaagagacctcagacgaacttattccaaatacaattattcgttaaaaatgtcctgggcctatatgggcctagaatatgcttgtgctttgaaaatatgggcctacaatatgcttgtgcattgcaaggcctacagatcgttgccgttaagcccatgagttcaatcggctgaagaaaactcgaatgcaactagaatccttaaatgacccagcatccattttgagcgttgttgctgtaggttttttaaagtaaatttcataaaaccctatatattaatctattattatatggttcaagttacacagaatagaacttttaacatgtgacacatagtcttaggtattatggtttgatgaaatcataatcatgatcattttgactttgatctaccacattcttaagttttacaatcacattttaaacttatattacaaccactttgttaaattttgatataggagtgttaaattttgatataggagtaagccaaaatggttagtggtgtgatttttgttaaactttaggatcataatacccagggttatgaaccacgtgtctaaatccatatggttttgtataacttgaaccacaacagaccataatactccctccgtcccatattataagggattttaagtggatgtgactcattctggtagtgttcagattcgtagtactaggataagtcatatccacctagaatcccttataatatggtgcagatggagtaggtaggattttataaaatttaattattgttttccttgaaaatatgtagccagttgtgatatttcttcatataagcatgtatgagcttatatgggtgggcagaagatctcgagggttgtatttaagatttacactataacatttaaaaataaaggatttattttattgcactgattttgttctagttcaacaatttgccatcggttttatctccctgtataatatgtcattgagtttatcaaatttttttttacaatatgtcactggggtggatactttaaaaaataaatctcaaaatgtccttcaagttacaagaggttataattaattgacctactagaagtttcaagaaaatgaaaatttttacgtaacctccttacataatatagaaatgtgtgtatatttgaaaattttcattttgcatgtattaacttttaaaaagaatatataatttatgttttgtatgctaatacaatactcttatgttaatgttcttttatgtacatcatcattaaatgctatacattatttttctgatgcagctatatgttgtgtatttgattcctcttttatatgctacataaaaatagtttctttaaacgaaacatgaaagaaaattttacacacaaacttctatattttgtaagaaggttaagcacacaaaaactacctttttttgaaaactttttagtggttcaaacaattgtcaattcttgtatgacttgaaggacattttagtcatttcttaaaattatctaccacccaaatgtcatgttgtaaaaaaaaccaacaaagttcatgggatattacatagggagacaaaatcgatgataaatcgttgaagtaggataaattcagtggcttaaaatagattttatcttaaaaatatatattttgtgtcatttataaaaaggatgatgtatttgttgaaaatatcagaaaaaataaaatgaagcatatggaaacgaacccaacagctgttgaataggtgcaaaacctataaccagcgcaattgggcaattagtatatttttacgcttagattttggatagctacttccaaaagaaaatatggacataaaagaatggggcgttaattgattacattttagtcacatcacgctcaaagccccggcccaaacaaagaaattttccgttgattaaacatactgtactctataaaaccggatgttaggcttgattagtccctggccttccatttaatccccaaaaccttcacgtcacccttgcctgtaaaacgcttaatgaatcatatccttttgttaatcaagctgatcgagagatgggacatggaagacatgcacgcatgagctagactcctagagctattaataattttgttttggtttactacctcttgttccatattaattgatgttttaaacaagattaaggtcaaacttttataactttaaccatcaataactttaaaaatatttagtttaaaggaactagaacaacatatatatatatatatatatatatatatatatatatatatatatatatatatatatatatgtcttttaaagcatgcatttatttattatatatattataatagaaaaataatgtcaaagatatatcttgtagaccatatcattgtctaaaacgtcaattaaaatgaaaccgaagggagtaatttgtgctaattcatctcagccacacgtgcattgattgtacaagtcatcacagccgaccatgatgtcatcggatgttcggtagtattccctctctctatagtagtataaccatgttaacacggttatcatgggatataaaaacttgtcaactttttggattatgataaagacaagagatggtaagtgtagtatatgtatagttaatttagtgggaagtcaccttttataattactatattgttatatttgtcataaattttgaatttgaagtagttgttacctccgttagaataattgtatttctaatatttaaattttgtaaaaagaatatttctaatgagacaagacctaacaaattaattttatgaagatatatatgctgtcgcctagcctcccatctctctatccaaatctcctagccctcattttaatcaagttttacatataaaaagtatgcatgcggtgtggatattaaatagggttattatagtcatttgtgtgttgctaatctgtctctaatttttttaaatataattattttgagacgtatgtagtatatatattttaggacgagggaatgcattatttttgactcaagatgatcctttctgagtagggctgtgtttagattcaaactttttttcttcaaactttaaacttttctgtcacattaaatgtttggacacatgcatggagcattaaatgtggacgaaaaaaaacaattgcatagtttgcatgtaaatcgtgagacgaatcttttgagcctaattacgccatgatttgataaagtggtgctaaagtaaacatttgctaatgacaaattaattaggcttaatagattcgtctcacagtttacaggcgaaatctataatttattttgttattagtctagtttaatattttaaatgtgtgtccgtatacttaaaatttttttggcacactgcttgcccgacagcaaggtacctgtcagcttttgcaatggttggttcaggtctctcaggttcagcttttgaattgatagtggcaagaccatgtaagacactgggagttcttcttttttgcactgtagctgtcttgcaattttatcgtttctccactaggcttgtgtgaagagttatcatggtgcttttggagaagtttaaatgtagtcctgtagcatatgcgaaaagctccagtcctttctttaggacgctagcatctctttccgttgcacggcagatgataaatgataagggtgtcatcagcatactgtatggtggcacaggactgctgtggtagattgcttgaattcttcattttgtctcatgagttgttgcagcacattagaaactaaaatgaacaagcagggagagatggagtccttttggcgcaactgaattttttacaatttgatccttttaaaaaacttatttcgcagatagacccctaaaaaaattatcccaaaattaaaaatggcgtggagggggggggggggcagctccagccacattggcgtgctccccctgccaccttagcgccgccctgctacggtggcaggaggacggcgcttctcgttggacgacgacgccagtgcctttggcattccaaaaaggcatttctagaataagttttttcaggagtttatttatgaaataagtttttcaaaaggaacaaattgtgaaaaatccggcttggcgcaggcccttcttgcggttaatccatttttccatgtattccatttaggaggtactgctgattttgatgtctgcagtatgtttgcaatccaagtttgccaaatttgtgggatgccgtgagctttaaggatcaattgaagctgtcccaacatcttttgtcctagcaggtttgtagtagctcagtggcatagatgaagttttcagagatatttcttcctttgataaagcccaattgatcttgatgaatcgggttggaatgatgcttttggaacccctgttagccaaaatgcatgcaatcttgaatctatcagatagctactttcttttctgaaacttaattaccttttcaaatagccaccctgtagtacagaaaattccaatgatagacggaaaacttttaatttcatccattatttccctagctatcaacgtatagacggccgggtaaggtcgttcatgcagtttacaagactcctatacgtagatccaattcgatcttatccatatatttgtgactcagatgaatagtcgtttgtcaatttgaatttatagaaaactttagatacatatcatatcactatcacatatcgaactatttctcagagcacatgctacacacatgcacatttaatggataagatatgttcacttcatactctacaaggtcctttgtttgtgcacattgcagggagatatctctactgtcttaaaagcacaatcatcatcttccctcccatcctaatctcatgtatatagaaaaccgctcactagatgtttggctattccccaacgcccgcgtcgctcgccccagggcgacacgggcggcgacaccgcgcgcgccgccacaaacttctcctcctcccctccgcctcgccgccgcccgagcagccgccggcaaagctgcgcggcggcaaggacggcggcggcgggaccttctccctctctcgagaagcgcggctagggcaccggcgggacctgagcaaagcggacgacggcgacagtgtccggcgccatctgggccggatgtggcggatccggctccgccggaggtggatctggccctatcgcggccagatcaggaggggcgtgccgctcttggcaggaggcggcgtgggaggcggcgaccgcgaccgttggtgggagggacgacggatccggccactctggcggcggatccagtccccctggatggctgcggccggcgggcggaggtggccgacgccgaggaggtttgtggcggaaggcagtggtgacggcgaccgacggagtcgagagggcggtgacagcagtcgacggagacgcgtaggcggcggcagcagctggtcggcgggaccggcgacggcgtgcatggcgcggcgcgcgcgagatccggtggtgctggaggcggggtgggagatggtggcagggcacggtggctgtgctggcggcggggtgggggctggtggcggggctgagtggtggcggcggtggagcctggtggtgatggcggcagcggagcccaagctgcggtgggcagccaacgccgcacgacagctgggcgtctgccttcccccgggcaagatgcggtcccctccaccggatttggggcgagagcatcatgcttcggtggacgttctagtgccgcatcgttttggacggcgggtgcactgtggcggatgggtcaacagcacggtgcggagggtggcatggcgccggcgaagcggtctggtggtccgaggtgacacggacaacggattcgtggcggagccagcggttactctgtcagggggagccacggtcctctcgacgttcaccttcctagacatatgtcctcttgcgacggcgactttgtcggcaaaagttggccacgtcgggcaggctagtgtgggggagagggcatccattcttctctctcaccctctccccatccaacccaactgcgtggatggagccggtgtgtgtcgaggttcgagcttccccatggcgattgactggcggcgtggcgccggtgcggtggccgtgcgtcgaaggttttcgctggtggtggctgcggagcgtgtaggagttcagttcttgggagagacaaattttgggcgaaagctctgccttcgggccggcaacaacgatgcctgtgggtgccgttttttcctcttggggtgttgccgcttttcttgtctctcccaattactttcttcatgtgaaaaccttgtcctggccctctgggacaggcgacagcggcacctttggtgtcgtacccttttcgaaggtgtcgtctcgaagaccttcagtttcgctcgtgcagtgggttttgttgtagatgcgcggtgtggttgtattttctttttctggtctgtggtcttccaggactatagattgtatttttctcctgttttatcaatatatgaaactcgcgctgtcttgtgtggttcgtttaaaaaaaatagaaaaccgctcaaaaaaaatgaagctgctataattaacttgcgatagatttttgttctaaatcattcaatttttgggccgtttgatatgctgagatttgtgtttgacataggaaaaaagtttcacgcattgtgattgctggaatcaaacccttgacccaacaattgcatgcgcacatacttcccactgagctatcttggattttgtaatttatgcttcacctggatcctagttacgtggtccgacagtttcttggagaattttctatcgattgttacagaggtagttccaaaaataatgttgactaaccgataaaaaaaatatgtgagaagaaaaaaaattaaaccacgttgatcagacatcgtcctagtgtgacgcacagtcgatgactaagtacgtactacatctattatgatgccattaattttttgataaccatattcatcttattcaatttttttttaaatatgaaagaattaagtcatgcttaaaaaatatttaacagtaaattaagtcacaataaaataaatggtaattacataattttttttaatataacgaatgattaaacatattttaaaaaatcaacggcatcgtatattaaaaacggagatatcgtataaaaatgtgtttgcctagtcatactcctcgaaagaaattaaagttctgtttcgacatgttcatatcctgaaatccataggattaatccctgccgttcgaattgcacgtcgatctccacaggacagccactcacatactccctctgtcaaaaaaaaaaaaaaacctgggtttgcgtgtccaactttgactgtccgtcttatatgaaatttttataattcgtatttttattattgttagatgataaaatatgattaatattttatgcgtgacttatctttttaatttttttcataattttttcaaataagacggacagttaaacattaagcacggaaaccagagtttgtcttttttttttattttttttggagggagggagtaggcgtgcgcactcgagttgcagagttctctcatcatctgatcccatggaagtgatcactgatcatccactggatggtgtggttgcacatcatgaacagaaacggcgacgtgatcacctgaacagaacggaggtgatggaaaacgacaattcaaggacgctctgttgattttcagctgatttctgcgccaatccgaaatggatcttgagcgctcgaggttatcccacctttacctcttattttctttaatatactttatccgtcccataatatatcaatctaataccgaataaaatcttagtataacgaattttattaacagatctagataggagggtgtccagattcatcgtactattaaatgtcagtattaagttggcactcccttcgtcccatagtataagagatttttgagggataagacactttctagtactataaatatatataaagagcttgtctagatttgtagtaatatgaagtgtcccatccctctaaaatctcttatattttaagatggatggagtatattataggacggaagagtataaaaaaatataacaaacataaaagtatactaagacataaatttatatatgcggaatcggtagccaagtcttaattttgttcaactttagatgacgaaatatctatataattacctgccacgataaaaaaaatggtttctctgtttcctttttgttttttatttttgaaaattgaaaaagaactctacggaagcaaatagtgcgtgtggggccaggctgcaggcagcaagaagtggcgcatgatcgatcagcctgtccaggtgaagccttgtcgtacgtgcgtgtcggtggttggagtttctgcccattatcaggtggtaataatggcgaatttatattagttatatctaactattaactgatatatttcgccagtccctgaatatttgacgcagttggttttttaaaacatatttaaccgttcgtcttatttaaaataattaagtaattattaattctttttctatcatttaatttattgttaaatatacttttatatatacatatagttttacatatttcacaaatgtttttgaataagatgaatggttaaatatattttaaaaaatcaacgacatcaaatgtttagggacggagggagtacttattaatatcatataaattagcttaaattgtataatttactagggatcatatgacgcttgataggattaatattgtaggctagtccatatggaaaataatccgggatcaaaccaacgacttacatggattaattattatctgtcctaacatgactatgaaagcaatgccgtccaggtggtggggccagcctcaacttcaatggttaggttagtgctctccttccacggattgaatgtgaaccattgcactactgctagacatcactatgcaattgtttgctaggataactttaattaccatatttaaagtgtatcggtttagtgtaaaattttaatacctatatatatatttctcgtactttctgaaagattgaaaacttctagtactttatcatgactatgcaagcaatcgcagtacctactacctaaacatctgatcacatgccatctaaggtcttattggttatacatgtattctacctgtaattatccccatttcataaagtctctaagagaaagacaaattaatttgaagactaaagagagagaattttcatgaagagtgtaatcgttaatgagaggaacacgtatactcatagtaaatggaaaattcaagtacgcatataacttaaccacgccttatctctttcttaatttcaactggcatttaataagtgtacagtaaaaatgacctaaattaggaatggcagtgagggaaatttgcaacaattacgtccttgagctgaaaatgctagaccgtttgcaatatctcaatattaaacttagtttgatttttaggcacaatgacggctttactagtatcctttggcttaatatatgtgccaaatttctcattaccaattacttaaacttactttttaggcacaatgacggtttacttctacctttgtcttattgataatatatatgtgccaaaattcccattatcacttgtagagaaaccatctttggtcggtcgacccaaatccacagtagtcccggttccattaaaaaccggaattaaaaataatttttagtcccggtttataagaggaagatctttagtcccggttgttgttaccaaccgggactaaaaatcatctttagtcctgattggtaactccaaccgggactaaagttcatctttagtcccggttgattccatgtcagaccgtatcagggctcgaggatctttagtcccggttataacactacaccatgacactagattaccaacagacatctgtcggtaaagataaacaattattgatagactatttgttggtaaaggcttttggtaaattatatgtcagcaatactatgtaataagacatgttatatgttagcaattccaaatatttattgggtcaaaataactgtcagcaatattattaagagtggaaaccaattatatgtcaggaaaacttaatgataacctatctgtcagcaatgtttcgtccgttggatgttgatcccacggttaggatagagcgaggtgatcggtgcgcagtaaaataaaaaaagaagcgcaaaaaaatccgcgcaaaaaaaaaaaccacgccgaaaagaaaatccaccccaaaaaggaaaaccctaggctcgcaccgcgcgccgccatttctcccccttccaccgcgcaccgcctcctccgccaaatccaccgccgcggcgcgcggcctcctcctccgccgcggcgtgccgccacctcgctcctctctccccatccaccgcgctgccggagtcgacctcgcgcccgcccaggtttgtacgggctagggtttggggggcgcccgtccagatctgggggattgacttgggtgttggggttggtgttggttgcaggtggtggtgtgtgccgggtagaggaggaggaggaagcgagggcgtcggacttgtgcgtgcgcaggtccaggggcaggacgacattcgacgcggtcgccgacgaggtctcctagttcactctgcttgttgttgctgaatgggtagtgattatcaatactgatggactgcatttctcttgcagtttttccccttttgcctttgatttcttcggccctttcctttcaagttttgatacaaagaattcagaaactcatactatatgatgggtagtttcctctgtttagtcctgtatcttggaactcatactttatgatcaaagaattcagaaaaggatcatgtaactatccagtctagtatggactgtagttgtttctaactgctttccatagaaacttttgcaccctttgtggtataaagaattagaacaaatcataagattcttaagctgctaaggttaagtatcatgaccttcactagtaaatcataagattcctcctagttcactctgcttgatgttcaacagacctcatgatgcatgtgccccggaaatatattgctctcatatttgtaggattagatattcagtaaagttccagagtttcgctctgttttttatagtacaatgggtgcttttttgtctaaactgtgtgctggtaaatataaacgataaaaccatccagaactgagaaaacctagcagccgctggtgttgtgtttaattacatattgcagatgtatacacctctgcatttctaagtttgtattcctgcagttataaactcataatccgcttatactctgcaaacacatatatgaggtaagttcagtctggctgcagttaattaagattaaggttgaaaatacggtgaactcattttggtattgatctgtgaccatgagttcatgttgaatcctatatatgcttaatttagcacatctgttgttgtctgcatagtggtcttcatggcatatgctaattctggaagtgccaccgataaggtgtggccttgctctgttcatttgtcgaaattaagaactttgattctaaatgcatgctatttgttagaggctgtgtgtggctacaagtttctatatgtcctttgggcctaacagaggcattaatatctgttttgctttttggatcacttctcattccctgaattttgtcttctgacttttcagaagcctgagttctgaaaagggcatactagaaaacatctgttgctgctctttctgctagatggagtacataattttttttatgttatgttagcttgaatattgacctggcctcaagttgctatgttagctctgaattttcctagcttaacactgctaagtcacaagtgcggcattacaaacatttcagtaactgatatttataggattagatgttcaattaagtttcaggattttgctttgtttttaatgaagcatgatctgattttttttaccaattcatataattagatggctgagatttgttgtttcatgtaatgcatgcaaaatgtttgacttagaatttttcttgtagacaactcagggacagatggagtagtagttggaggtccaatattatagcctaggacacgaacaaatgcagaaaatggaggtgttgatgctaatgatcctcgaaatatgcccttagctggtgaaggtatttcattcgacatttgcatgtatcgttaataagattaaggtatatgaatatatcaagttcttatcatctcttttcatatgtaagcagaaaatgttccaggtgttaataatgtacagctacaaaagaaggtacacaagaagacagcaaagactaaccagcgagcaggtacttaatttgtacatgatgcaacatgtttttgtgtatatattgcctctctgacttaatttgccatgccttgcatctatatccatcatcatgatatatacccaatagttagtgtgcactttataagctgaacaattggtattgttttgttagaaaggataaccaatgcttgtagcctaaaacatctttcagatttactaactccgaaggcagtatctctactagttgcaaatcagatccttaatgcatttgtgcttttttacaacatagaagttctattgtttcctttctcatatatgtactgattactgactcatcaatagggtctttgaaggtgctctcttggtagttttacaggctacaattttctttctgacagggtctttgaattagccatttgctcttcactaaatttatctgttatgctattctaattgccatggactatatatattcttctgtggttctctgtacactagatatgtttactctgtacactactgatgattattcatttcatttactctgtccattattttgcaggcaaccataaaaagggctagcagaggtgctgtaaaaaaaatcaagaacctacaagaaccataaaagagatgatttgttttgtttttgggacctcaatacacctacaagaaccttagttacatctaaattatgtaattattgctatgtacttgaactcttatgtaatagctatttgagctgatggataactgctatataggaatactgctacttgatgggtgaacaatagttacatgatgatatgtcagaatgcatttgtgaacaatagttatgaatagttgaatattgtgttatgcatgtgtgtaacttactgaaaggtgataatccgtgttgcaaaatttggagtgatattcatccatatatatgctgcaaatttaatttgaggtatggttcataaaatggatgattggtaattagtatattttttgtgtggattactgactgattgcttgttagttcttgtgcttgccatcaatacattaattgtcggtaaatctataacacagtgacatgctatctgttgggaatcttcttaagtgtcggtaaaagtctgtctgttggtaaaactatctgtcggtaaatatgtagcaacactatcggtctatctgtcggcacagatttatctgtcgggaaagacttttgccggcagcacttggcctgacagaccttatctgtcgggaaacgttttgctgacaaataatttggcagcatatagggcctttcctgacagatatgtagtaagcaaacttggggcatggtgtagtgttagtaacaccaaccgggactaaaaacctatttttagttccggttgatgttactaaccgggaaaaaaaaaattaaaaacacactatataatccctattaccgatcctcttttcccgtccacacaacaaactcatccctctatctctttctccctctccaacttcttatctcttccttatctctaactcctaccttctctttcctttttttttccttccattcgtcacagcgaagcagacggcggccgacgaggcggcgcgggggtccgcgcggaggcggccagcgcggaggctcggggggccgcgcggaggcggcctgcgcggcggcgcgggggatcgcccggtggcaggcgaagggccgctcggcggcggccggcgcggcggcacgggggcccgtgcggctgcggcgaccggccggcgcggagggaaggaggggaggcggcagtggccggccggccggcttttcttttttttcttttttttacaatttatgatttatcctgtgatgtatttgatttgtgtgtgatgggaatctgtgatgtattttttagaatttgtgatgtaattttttacaaggaagatgttaaaataaaactatctacatcctaaaaatataacaatttgtatcaaatagaaaacattctagtgctacaaatttatccagattcataatactagtatatatgttctatctgatattatgttgatgtattataagacaggggaagtacacaccatccattttcacagggaaaatgagaagggagagaaacttaggagaagaagagaatactaatagtttgatggctaaaataaaaaaaagatgaaatggtattaagagatctagtaggcgctataacctaaaaagatactcccttcgtaaaaaaaaaaatccaacttaggagttggatgtgacacaatatagtacaacgaatctagattgtgtcccatctaactcttaagttggtttttttgatagagggagtagacatctaaaagctaaaaatttaaaaaaaatgacgggggagtaatgaactaatgcatgtatcacttgtgtacttgtgtgaagttacgacaaccaaattagggtgacgtgtcaatgataagaacaatgcattatcttcatcagtcacctttcctagacgtgccaatttttctaatgttatgtgtacatagacctaattaaatacttatttatttaagttgctaaatttgtggacttttaattggcattgatttgtcgatcgtgtcactagcttccatgtacgattgaaggcttattaaaagtcacgtcaaattatatgaaaattgttgaataggaggagatggcgaaggcggcgaacacgatcgcggcgaggaaggccgagaaaggaatcgaaggtacgcataccttcttttctccatctactcttcttcttctcgcgaagagtgaagttctgataatatgttgaatagggaattgagattgtgggagcgagagaatagttgtgtactttattaatcaatgcgattatacaggaatgggtggccaccatagacgtgatggttgggaaccatcgtgcccgttgtcaaggagcgccgagaaggcgaggggtacgacacaactgttgtgcgcaaccttcggttaccgatcccatcttttatatagatgtgatcatctatttatttcataacaataataagcggtgaagctaattactaagaaactgtctggttggccattaccgtattttataacaatctgtgattagatattttgacatgcgtgtttgcgttgttgccacaaacatgacaatattacgtttctgtaatataggtcccatatatatgttagtgacttataaaatgtggcatatatcttttattttactggctcaagtgtgatcaggattttgattgcctcacttttgacaagctcgaaaaaaagtatgacaaacctacgaaaccttagttatgaattatacaacccttaaaaccttaaaaccggtaactactagctccgtttaattttttaagatgttttgatttctttccgtatacaaaattaagtttacaataacatagtaacattttttctaaaaaaatcaaaattattcgatgttagattaaaaataatcgcaatatcttataatataaaatgaagcgagtactactcatatgaaattttatgttttctaattaaaaatatgattgatctatgttttctaataaaattaattataataacaattactccatccatcccaaaaaaaaaaacaaaccctggattttcgtaccaacatttgactgtccgtcttatatgaaagttttttataattagtatttttattgttgttagatgataaaacatgattaatactttatgcgtgacttacctttttatttttttttatatttttttcaaataagacgaacggtcaaacgtggtacacggaaaccagggtttgtcttttttagacggagggagtagattgtaaaaacaaaccctgagatgaactcggttaattaacaaatatggaaccagaatccttctaagcttaaggctcaataaatataatttacataattttatttttatcttctaatttgtaaaattttatagtacaattttaatagatatcttaggtcaggagaggggctccagcttcttgtatccacgcgccccgaacagatcgatcaatttagcagctgacagaacaactctcgatttgtcaggcaagtgtttggatcaataaaaacgttagccactgacttcacacgctaaatcaggagaaagcgtgcacgacagcacgagagatatagctagaattcattttaattatattaatacatacttcctctgttttataatataaaactttttagcattacctaaatacatataatgaatttaaacacatacatatgtctagattcattatcatttaaataaatgtgtgcaatgctaaaaagtcttacattgtgaaacggaggaagtaatatactaggtatactcacgcaaacgcacgcgattaacctagctagctagcactgacaattaataaaacagttagagcaagttggcacaggcactactgtttaattgtattttatacggctaaattagttggacgaggtgtattgcgtgagtgatatctgcttccagcttcccagcaattcgccagcacgtacgtttttatataagccatggctttagaaaagattatctatatgtgcgcatctacaattattaaattaagcacattcaatttagttagagcgaaaaaattcagtggtcctgtaggcatatgctaaaatgttggaatttttttttcatatcatgatttacgcatattagatatccatccgcagaatagacgtacacgtaactgaataaataaaacttacattatatatatatacctaaaattgtttttaagtgtttttggtaaatatacatttaagttaattttattgaactagacatatgatgggatcgatctaacttcgattttaatctattcactgtggtactgcctgcatggtactgcctgcattccatattactactccataagccttttttaagtttatcccaagtcaaactttttctctaaggtataaccaagtttttttaaaaaaaaggaatatttttaatataaaataaatatactataaagacgtatttaataaaacttattaatttgatcttatagacgttactacgccttttataaaactcattctaaacgtgaagaagtttaatttaggacatacctaaaacaatttttatgatacggaatggaacaatttttagctgcactgtaggtgctctctccagtcaaagacaacagtgtttcagttgacacttgatcactggtggagaaaccatatttcgtcggtcgggctaattccacaatagtcccggttgcaacaaaaaccgggactaaagatgatctttagtcctgattaaaaagggtaacgggcatatttgatctttagtcccggttcaaatgctgtcagggcctgtcaggcccccccgggatctttagtcccgatcgtaactttagtcccggttggtaataccaaccgggactaaagatctcggcgatctttagccccggttcataacaccaaccgggcctaaagtcccacccctatatatatatatgtcttcttcctcctccagcccgagcaagcttcaaaatttctttaaaaaagaggggaggtcatgccaaaatttctagtgaatttattttggtgattatatacaaatcggaggtgcctaaaaggttagcaacttcatactaaaatgttttttttttcatattacatttggagctatgttttgcacacttttttgtctccaaaattttgttgttagttgataagagagaaaatttgtgtggagaagaaagaatatatagaaatttagtttatttgctaaagaatgttttataaaatagttgagaaggaaaatatagtgaaagttaatattgaatgatagaaaacaaagtaaaatgaaaaattaaaataagtacaacacattaatattagtttaaaactttataaatagtaaatatataattattcggtgtaatatttcataatatttgtatgaataatgatatgtcattattgtgtgagtgttgaaagagtttgtaattattttataattattgtatgactgtcattattgtacgaataattatgtgtgtatgattttttttcatatcatgtagatggatcggcaatggatgtacgctgaccggcggtccaaagagtttattgacggcgtgcattattttttgagagtggccgaagctaacaggcaaaagggttttacttgtttttcatgcaataagtgtaagaatcagaaggagtattctgcatccaggactattcatttccacttgtttgagtcggggttcatgccaaactataattgttggacatcccacggagagcaaggcgttgaaatggaagaagatgaagtggaagacgacaatattccggactttgctcagtacgctggatttgaaggaaatcaaacgggcgaggaggaaagggatgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaagaagagaattcctgctaaggtgatgtggtatttccctataataccaaggctaaggcgtttgttcaggaacaaggggaatgctagaatgatgcgatggcacgctgaagagcgtcaacaggacgggatgctgagacaccccgccgatggttcgcagtggtgaaacatcgacagaaaatttaaagactttggaaaggacgcacgaaacatacggtttggtttaagtacggatggcatgaatccttttggagagatgagcagcggccatagcacttggcccgttacgatgtgtatctacaacctccccccgtggctatgcatgaagaggaagtacataataatgccgcttataattcaaggcccaaagcaacctggtaacgacatcgatgtgtacctaagaccactggtcgaagatcttaaactgttgtggaagaaggaaggtgtccctgtgtgggatgaggacaaacaggaggagtttaacctacgagcgctgctgttcataaccatcaacgattggcctgcacttagcaacctatccgggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctcactaagaatcttgcgtaaaccttcttagcttcctaggtgtatatggaaagtcgaaagatacactggaagcacgtaatgatctgaagcatatggaacaacgcggtgaccttcacccggaaccaaaggagaaaggaagccattacttgagtccagccagctacactcttagcaaggcagagaagaaaagtatgtttgaatgcttggagagcatcaaggtaccgtctggatactccacgaatataaagcgaataataagcacgaaggagaagaagttcacaaatctaaagtctcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattaaaagccctgcagaatgatgtggtgcaatgtcttgtcagctttgagttgatatttccaccttcatttttcaatataatgacgcatctgctttgtcaccttgtcaaagagatcggtattctcggtcctttgtacctacacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactggccttcctggcgaggagaccatctggctcgatcgcgacattccagggatatgaaatcaatgggtacacattctacacgagggcccaagacatgaagagcacgaaccagaacagtgctgttcgtatcgatgccatgggacacgatggtacaactggcacgtattacagtgccatcgaggatatatgggaacttgactatggacctctcaaggtccctctgttccggtgccaatgggttaggttggctggtggaggcgtaacgattgatgacggtgggatgacaacagttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctctctctctatctcgatctcgatctctctctctctctccacggccgacgaccggcttcgacgcggcggccgctgccgacaacgccatcgccactgccacgaacgccgcccccgcctcgagctcgccacgccgccgcgccacgccgccgggccactacgccacgccgccgcgacgccacgccgtcgccactgcgactccgccgccaccgcctcgagctcgctatgccacgccgccgccgccgcgcgccgccgccgcgccccacgccgccgggccccgacgccgccgccgcgcccgcacgccgccgggccccacgccgccgcgcccccacaccgccgcgccagcacgccgccgggccggcccacggcgccccgacgccgccgccacaccgccacgccactgccgcgcgcgcccaacattgccgaacgtgattgaaacgtgaccgaacgtgaacgaacgtgacacgatacgtggacgacctttgaacgaacgctgaacgaacgtgaacgaaacgttaacgaacgcgaacgaacgtaacgaaacgttaacgaacgcgaatgaacgtggacgaaacgttaacgaacgcgaacgaacgtgaacgaaatgttaacgaacgcgaacgagcgtgaacgaaacgcttacgaacgtgaatgaaacgcttacgaatgcgaacgagagcgtgaacgaaatgattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgtagagggaagcagccagtactggaacgaaggagaggggaacgaggatccaaaccagtacttgaacgaggaggggaacgtggagagggatgcggaggggaacgaggaggggaacgatgaggaggaggctagtggaagtcatccctctgctggacagaagagggcacgcggacaacgaggtgccgcgaagaagatagagggtcagcacatcataactgaggtggacaaagacggccgacctagtgccccgacagaagcagctaagaattttgtacgccacagcggttgggttgtgagggacaacgtgcctgtcagcatggtgtactggcgcagaacaagggcacgcggggataatgacagctttgtctaggactcagagaaagagatgttgtgaaccacaatgctcgagacgttcacgctacccgcaggtacggagaacataatgaaacagtggactctgaagaaaatggcaaaacagttccagagcttcaagggagatctctacaagaaatacatcctgaagggattaacaccgagcttcgacgtattcccaaagctaagggatcattgggacgagttcgttgcttacaagacagggcaacaagggcaagtgatgatggccagaaacaaagaaaatgccgccaagaagaagtaccatcaccacttggggtcaggcggatatagcgtcgcgatgccgaagtgggaggagatggaggctagcttgcttgagaggggtatcgaaccggccaccgctaattggctggaacgatcgaagttctggtactatgctcacggtggaacgcttaacccagttgatggctcccttgtcttcagcgatcagatacgcgaggctgccagtcgactaacggacgcagtggtagcctcttctcagggaacattccgacccgacagagagagattccgacccgacagagagaaggatgagctgtcactcgccctatagactcccgagcatccaagacgaacacgagggaaaggcgtgattccctggaagattggatttaaggaggacatccacacatacaggagtcggatgaggagcaagagagataccgaggcgaagattgcagatcttgagtacagggtatcgagctacgagctcagcatgcaagaggaggtggcaaggaaggtggatgaacgtatggccgcacatcggtcctaggatccccagccgtacattctgtaacaccctgaaaattcgaccaacaaaaatcaaaattccaaaaatataggccttcaaaaaactttttaaataaattgcatcatgccgattttattcgattattttattggattttgatttcggagtttataaatcgcgaataatggataattagttaggaataaaccctaaaaagtaaattgacaaagtaaataattaaagtgcaatttaaaataagatttggtgaggatagaaatgtgtaaaatattattacgaccatatttatatccatcaaatttaaaaaaaaaagcaatgggatgagaattaactctaattaaattcaagtaaattacaataaaaatatataaaacatggaataaattaatctagaatgaatccatggattggaatggcacaaaaattgagtatacttcatttatgcaaaatttgggaattaaagaatcaaatttaaataataaatgggccaaaatcgggttaattagaaaacggcactgttcattgcacctaaagtgttcgacgaggtcccctagccctaaccctgccccgctgccgcgccgatgccgccccaagccccgtgccgcccctgctgtgccgcgccaacgtcgtcgcgccatcgccatcgccgcccgtccatcgcgtcgccgctgtcgcgccgcgcgccgtcgccatcgctgcgggtcgccgtcgtcccgcgcctcgtgccgcccgccgtcgcatcgccgctgccgcccgtcgcgtcatcccgagccccgtgccgccgcctcgcgccccgcgcccgtgccgtcgcgcgtcgctcgccgccgtcccgtcgcgccgtcccatcgccgctactgccgcccgccgtcgcgtcgccgctgccgagccgtcgccgtcgctgttccgcgccccgcgccgcgccgcgcgccgtcgccaccgcagtcacatcgcgcgtcgcctcgcgccgcacgcccccacctcgcgccccgcgtcgccttcgcgtctcccctctcccctctcccccttatctcttcccctcccctatataagccccactattcccactctttccctccatccttacctcctctcatctacccactccaccacgccgccgcctccacgccgccgcgccgtcgcatagagccgccgcgccgccgccacgaagccgccgcgccgcgccgcgccttgcgccgccgtcgctgccgtcgccgtcgccgccatcggtaagccgcccccccccctgcgtccatcgtcgtcgccgcccgggagggcaagaagccgagagagagagggagaaaggagccgggagggagagaagagagggaaaaagaaagagaggagaggaaaaagggagagagagagaaaaagaaaggaaaagggaaaagagaaaagaaaagaaaagaaagagggagagaaaggaaaggaaaaatttagggggaaatttaaaatatttaaaaatattagaatttaatcataggcttaatgaaaatatagctagataaattcttgctatttaaatacctaaaatactagcatttaattataggatcaattatttaagaactaaacaattagatgaattcttatagattattatagattatttttagtaaactctataagagattaattcgcggtagtgatctagatgtaattaaggactagataattagataaagtcttaggacatgactttaaatcacaaaatttcttaagaaacacaaatattttaggtagaagaataattccacttcgcgaataaagtagcctatatagaattcacctcccgcgctcgtttctcaattcggtcattatttggattttgtttgaattctaatcgaattcaaattgttcttacgcacgtaactatagagaccgagggagccgcggatccggatgaagaccaagacccacaagacctagagcaaggcaagtcatcactattccttgaacatgttgatcccaattgcaaaattgttttgtttacaaataaaattgcatgcaatgatgaacatcctacttgtgattatgccatgccttgattattgtttacccttaaatccttgtaaccatgatttacgtaaaagtccctagtcaactatgataaatgcttagaaatgctactctagatttatgcatactcatatttatcaaatgctatatgcttgggcaattatctttgggaaggtaattgagatgcggcatgtggagacatgagcgccacattgccatgatattgatgacatgatttgtgaaaggaaaatgaaactaaacaaatgatttcgactggggcggatggaggatttgggtggtatccggaaaaaggctagtgccatccctggtcaattaaggaccgagccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacggttggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttgaactacccaggaggagacggtgagacgcatctacgagacacaagccacgccatcatactatggcgcaagcggtacatcatccttcctgggtgacaagcggcgtctcgtgcaccatctcctccggctccgccatctcctcctgcaccatctcttccggttcctccgccacgtcctcctgaaccatctcatccggctcctccgccacctcctgctgcaccatttcctccgactcctccgcctcctccgcctccaccatgtcggcttgcacctcccaagacaaggtctcgccaagctccaccgcctgcccacacaagggcaacgaagaaggcgaaagttgacgccaccaaaaacaaggagccaccgtacgattgcagtcaagaggagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccattggtgaccggtgaagattttggcataacagaattcattgcagacaccggtctaactgtggatcagttggttcgaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcgaagggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacagagagtgagtttttattgtcgttcgaacaaatttcgttcccatacatatagcatgtacattttcgatcatatatatatatctcatctcacgcatattccagattccactgggtcctgttattcttcgacttggacgcatgcagagtcactgtgtacgactcaatgaataaagaggagaagatttttgacaaggtcttcaaactaatagacaggtaatataatgccatctattccaaagtcgcggggaatctattgctattatgttgatctcaggtaataattaatcatagcttgcaactgcatatgtagggcttgggatcggttccgttaattggtccgcgggacttggaaataaaaacttggacggaggtttcattttccagtgaatacatgcatgatccaaaattatattgaattaatctctaattacagttaatataaagagtatattaaatctctcatcgtttctcatgtagtgtgtaaagcaggaccagggaactaacttatgcggctactacgtatgcgagtatgcccactgcttatcaaaccaaatatgcacaacacgagagcttgatgtacgtatacataaaccattcaaaagttcattgcgtatcgatttgttaagttgtttattaatttcatgtattgatacgtcattatttttcgaatgatagcgtattcacatgagggataatcttccacacaaggattttatcacggctgttcaagaacagccgatgggattcttcaacgaagaagtccttaatcccgacggtgaattctactacgacgaatcgacaattcataacgtcggtccttcctcttctgacatagcgccggcgtcgaagtcgtagctatatatagctaccgagcaaaagaattgtactatatacgcatgtatatatatttatatatgtacacatttacttttgtgttaatatatattttggtaacatatatatatgcacataaaatgttaagtgctttaaattatacatatgtgtatgtaatatatgatttacacacacacacacacatatatatatatatatatatgtatatatatatatatatatgtatatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtcgtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgatttatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatggggagcctaaagagtctacaactcgtccataactttagccagtaggaacagtacaactgaatggtatttctttaattttgtcttccttttctgatattaattttatcggaatatattcagggccatatagtctttgaatagtcatgtttttttatttaccaatcactttttaatatcgagattaatatcaaacattcacatatactcttttttgggtgaaacaaatagtatttaattagagctccctttaaaacatagaaataggaaaaaaaaacataggaaccaagtgacatagattttaaattcctacaggaagataaaccatatgaaagtactttaaggtcccgttcgtttctccaactcatgagttggatgaaaaagaagatttatgtgacacatttttcaaactgctaaacaatacgtttcgtacaaaaactttctatatgaaagttgttctaaaatatcagattaatccatttttcaagtttgtaataattaaaacacaattaatcacgcgttattaccaccttgttttacgtgaaatacttaatcattatcttcatcttcatcttcatgagattcaaacaccatctaaatattggtgtttgattggaacacataagaaacataggattgcaagagacaaaagattgaaaacatgaactaggacctcttggccttgtttctctgaaatcaccatataattgtccatttcatataaatttcaaagaaagtgataggatttaatcctttgtttcaaaggctctcataggaattattttataggattaagaatcctccacttcaaagcggccttcaaattgcactttgatgaatctctaccaatgttaaaaaaatctaacggcctagagaagcacaaagcatatctagatgaattgtggaatgcagaaaaaaaaactatccctagagaattattacagtgtttgtagaatgaataattatgaattacaaaattatagtttggttaaaaacaagaaaactactgagaagcacaaccttaaaaacaaaaatctccatctaaggttgatcagaggatgcataactattgtttgtaccaacatcttacaagttgtatgttgtagttatctttctcaagccataaaaatataatcttcgaaacaagtaagtaaggaagccgtgaagacaattccaggtggtggcaatagtaaaaaaaatatagacatatgagaaacacaatcatatgatgctgaaggttcaatatcacattaaaaaactacatatttaacaaaactacagatttgaagtgttgtatcacaaaactacatatttaacaacaaatttatcatggaactacaaatttaaggtagagtttcacaaaactacatatttaatactatctctgttttttaatagatgacgccgttgactgtttgtcacacgttttaccattcgtcttattaaaaaaattacataattataatttattttattgtgagttgttttatcactcaaagtactttaagcatgatttatatatcttatacatttgcataaatttttgaataagacgaataatccaacatgtgtttaaaagtcaacaatgtcatttattaaaatacggagggggtattaaagttatcacaaaacttcatattgtaaagtttcaatcactagcactgtcgttctgttggacattgtagttttgtaattaaattgggactgaaactatagtattgggataaatttgctacttaatctactgttttgtgaaactttatcttaaagttgtagttctatgataattttttttttgttaaatctatagttttgtgatacaccactttaaagttttgtaaaattttctcatatcacaaattaagaagacaatttgaactagtgatatggttcacaccagtttttcacgaaccatttctggttcactttgtttgtgcactgtcgatggttatgacccctacaattatttctatttattctaaaatgtttcaaatttcagaatacggcgagaagcatccttgatatggcatggaattgtaggggtatgactttattcatcgggttatatatatacaaatataagtatggttttagcatatcaataaattcgtaactcagagatatcgctaatctcgacatggcgatcaacgtgttaagacgacgcacttgcagtttgtgagtgtgtatacatgttgagtcgtaatcgaaatcgaaaagaaaaaggaaagaaaacaattgacgcttactgtcatcacagccattactgaagtaccgatcatgctttctactcattcggagagatcacaaacttttatcgcatcaatcatcatcaaccgatcgagctaatcaccatcaagttaaaaagcgagaggacaataggaggcatcaacaccacaataacaacacaaaagaattaaaaagcgacctctcaaacatgagcaaaatctttttctgtccccttctttttcaggtcatgcaaaagtaaataaatagaatacttcttccgcattagtttaaacttgtatctttttttaagcgcagtaattataggcatacaaatttcttcaccataatataatcatctaaaaccaatttatggcaaaaggaaaaagctagaattaaccgtgccaattattagagaacgcaggtggaagccttaaataggcaagcagtcaggcatttagcagcgcgctgcgcgcagcagtgaagccatagcccaaagccacaagctaaaaattcgtagttgtttttttaataacatcactattaaatatgtattttacgatacggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataacaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcgcggcggatgggaggggaggagggaatggcggcggggaggaagaagcgggtggggaggtacgaggttgggcggaccatcgggcaggggacgttcgccaaggtcaagttcgccgtggacgccgacaccggcgccgccgtcgccatgaaggtgctcgacaaggacaccatcctcaaccaccgcatgctccaccaggtaattcccccgcttctcctttcccgctaccctccacatccgcccccgccagtgcacgagtccaaatcaaactcctcgcactcccccctttgctttgatccgggcgattctttttacacttttttttatttgggtgctctccgctgctgctttgctgtttgccaaatggtgagcagccgcgcatcgacgagggcggatggagaatttccgaatatacctcgacagcaatgcgcaccactggttaattcgtgcgagttgcgcgcagctcttgccgtttgatgattaagaataaggaattaactggagagccttaaatttcttgttctcccaaaggggaaaataccttttttttaaaaaaaaaaaagaaaagaaagaaaaacttaattcgagcggtttgtttggtgtttcatctcgtttgggctgacagaagctcagttgcagaattgaaatggttgggtgttgaaagtgattttaccaaaatttggtctgttgtagcttaattcgatttgcggtgtttgcagaaatgctacaaatagttggttcatatggttatccaacgacatcttttgaggatgcatcttgttgcaaagtgctcaagttctctaattatagtggtgtaaatcttttcctaagcttcctgatttgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttgtttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaatatttacttgccatctgtcctatataacttttcattattaacaaaactcctatgttggctatcttaacttcctgtgtcactactttgttaccattactatgattttgtaggttctagctggaaagacgaagatatacataatcttggagcttatcactggaggcgaattgttcgataaaatagtaaggagtctattatatacactaccgaaataacgatgagctgctgttctacttgaactaaaaaaatataagaattgtgccaatctggcagtgtctccatatgtaaattctttttatcacccatatataccagaaactttctgttcagtaaattataggcccattatataatcccaataggcaatataaagaaaggaacatttttttattattgtgcattttcttaaaatatgaacctatgcgatcaaatatctgtaggctcgccaagggaagcttcgtgaaaatgaagcaaggaagtacttccagcagcttattgatgccatcaattattgccatagcaaaggagtatatcatagagatttgaaggtccgttactgataagagacacttggctatcatttgtcctattcactaggtgcaatatctcatgcttaccctttttttgggcatgttatgtagcctgaaaacctgcttcttgactcacgtggaaacttgaaagtttctgattttggacttagcactttggcccagaaagtaagctcagtaattgcttttaatgatgctgtatttctatcctagaagtgttctgattgggatttcttttttgagggatttcagggagtaggccttcttcacacaacttgtggaacaccaaattatgttgctcctgaggtatgatgctctctctctctctatctctcaatgcatggtaaattgaactgtacgaaatgttttttttttggcaaggagctaattgattagctacactacatgcaagaaatatgtctgcaaaattagacgagttactcgggatgcaattcaattttcctagattttctttatagatcatatttgtatgtatgatacaaatgtctgttagactagaaagagattacctatttctttgtttctctacctgtctcgcagttatttggttggttagttctcttcagggttctaaacctcatttttatgcatatttctgccatcatcactaaataaatatctctagctgtcttatttcaccatgttcaagctattgtgattttaattgtctgaactagttcataaaattgtgatatgggcatttcaagccatttccttagacaagattaggggcatttttttagtacatatatgatatgcgctttaccatgtgtcaatgttttaggtgcttagcaacaatggttatgatggatctgcagcagatgtttggtcatgtggtgttattctctatgttttgatggctggataccttccttttgaggaagatgatcttccaacactgtatgataaggtattggcttcattactaatgtgtgcagcataagtctttctttccctaaattgttgatgtgaacacctacataatcgttctactcagatgagattgaaacctgatatgtttactcctacattaaaagattactgcaggtcagttttcatgcccttattggttctctccaggtgctacatcgcttatccacagaatactcgacccaaatccaaaaactgtaagtacacacactaggttgtttcattgcatcttcaagaaacaaatcatcctttatagtaaagtttacctcaagcttccaaagtactcttgtcaccaatttaatacttcagtctcagtctgcatggctgcagaaattatgtgagagaatgcagaaaacaaagactaatttcttcatatcagtgctgccatatatgttacagaaatactgtatacaactatacatgaccagtgacagaatcttgctagaatcaaatctaataagtctaacgcatagatcttcaaccagcatagagtgtttgcttttgcaaattgccgtctccagtttcttaggcctttttcactattttgcagcgtatcactattgaacagataagggaagacacatggtttaagaagacttatgtagccattaaacgtggtgaagatgaaaatgttgatctggatgatgtacaggctgtttttgacaatattgaggtttgtgtatgccattggtatattgccaattgtctgtcacctatttgcttctatagttatatttatacaacttttctggcttcaggacaagtacgtttctgagcaagtgactcataatgatggtggccctcttgtgatgaatgccttcgagatgattacattatctcaaggtttggatctttcagcattatttgatagacagcaggtaatttcatagttccactcttccttttagttggtaacactcttggtatggttgaccattttgctgttggagaaccattagcgcaatgaaatttgaaacgctgatgggtttatagtgtacggagatctggcatgtcagcttatttcatttacttacaaggctgtgaggcactgggtttagtgacggttggtcgctcaggggtttctatcttgtttataataaatgacttaaacgaacatccatttcaattggcgttagtattatgtggaactatattctagccactgtatatggattaaccgactgtagatcgatcccattgtctattctcttttcttatcgcttagtgtactggttggtggcagacggcttctgttttttgccaaatttgaatggaaatggaaaccctgcataaaaggagaaaaaaacatctgattgcttgcttcttagctaatctccatggtttaaattgcacctgtttagtttgtgaagtatttgaccacaccaaccatatattcattctagttgcaatgttctcgtatagcagaaagaagaacccacttttcaatgtttgtgctcttacattagatcttcctagacatgtttagtatgtatttttttattttacgtggaccatacgtcatagtgtgccacacgtcatgaataactttggtgtttgctttatgcattaactgcagtcctcatgaataacttatgttgtctgatgcaactttcatcacatggagtgctcatgttgcaataatgatgggttttatatttgtaggagtttgtcaaacgtcaaactcgttttgtctcaaggaaaccagcaaagactatagtagctacaattgaagttgttgctgagactatgggtcttaaggtccactctcagaattacaaggtaattacaaaacattttcttcaacaagcaactcatttcttactcttgatgtaatgatacttattgctaactcttttctgcagttgcgtcttgaaggtgtatcttcaaacagaatgagcccgtttgctgttgttctacaggtagtcttacattgccctttgttggggaacaacattttgctgtttgtcattcacaaactacatttttcatgctgtcttatgctttgaaatgcatcattcgcaggttttcgaagttgctccttctctgttcatggttgatgttcgaaaggttgctggtgacacactggaataccacagggtctgtctttccacatatcgtcttgtatcctaatcgaatatagtagcatgattgcctagactagttcataaatctaaaaaaatgactgacactgcctgactgacactgataactttcacacaatgtgtcaaaatgctcattcgaaggtgcaacatccaacttttcgtccatccggaacgattgctaactcagatttacactcattgcagttctacaagaacttgtgcaacaagatggaaagcataatctggagaccgattgaagtttcagcgaaatccgcactgctgaggacagccacatgctagcctggcgctaacgcagctgcaactcctgcatcagtgggattttcaggttttcaggttgtcaactcctagcccgtccaccgaagttgctcttgcaggcgctgcatgtaccacatagctgagtcagttcttcagtagatcagtgtaccattctagtttcatgcaccagatgttttggtagtattgttaatatagaactgtagatagtccatatagcggccaattgtgcagtctgtatgtaacatggatatagataggtttcttgtgtagtagtagtaaataagctggttattttgctgccatgaaactggaatgacttgtgaacgtcgaaatgctctcgtgtatgtcggatcttcttcacttagccgttctcaaggatgagagcaattaatcttgtgatataatcctatatgtatttccagggcagaaatggaaaagaaaagggaaacctgcctaccacaacttttaagcctttgatctattgattataatctgaagttaattttgattttttttaatttgattcgtaagaataatcttaggtatatttcgcatctcctttacttgcccttttgactttcttggaaaaaagatatagcaaccaaagtgaggaagaaaacccttggtatcagtttgaaatcaaattctaaaattcaaaatcaaaatcagctttcgacgaaactagtttaactcgtttcgtccagcaacagttaaactagtactcctagcagtctagcagattagcatccatggaaaaaaaaaacccatctttgagtcccatcatgcaagccaggtacatagaatggtaagaagccttaaactaatccttccaatccataatcaaattagtggctgttaccaaattgtcatgaaatttctacctctccatgaccacatcaaccagaaactaatcccatgcatcttttatcatataaactaattgccactcaaatactgcaaccatggaaaaaaaaatcctatcttttgtgtcacatcattcaaggcgggtagccaggtacacagaacggtaaaagaagcctttaactaatccttccaatccataatcaaattagtggctgttaaattgtacttccttcgtcccaaaatataaaaactcagattcgtaatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaagagaggaagcctggtaataataattccaatgcagaccaaaatcagagtcctttttattattccaagagacgaaatggtggtttcgtcacgccagtgacgtagtgggttagcgttgggaatcaaaagccaagtgcatgcatttaacccaatggtgagtgcagggttggagatgtgccagcccataggtaggaagggtgagatgaactagacgaccagagttttagcaaagaccagcaaaaattttctttggaattttgagaggacgacgaatccggcagcgaaacttcatgctctggaaaagttggttcagacagagaccccctccaagattgtccggcttgaagcagctcgtttggaacaaaggatctttcgaatgatggctcctttgaaatataggaatttcacgtggaatttccaggtctttatctttcaaacattgggtcgtttggaatacacgaatttcatgtgtattttatgggggttctaatcttttgaacggctcatttaggatgcatagaatttgtaggagtttcacatgaaggctgtgttttcacgtcagaattgaaagtttggttgaaattggaacgatgtgatggaaaagttggaagtttatgtgtatagggaagttttgatgtgatgaaaaagttagaagtttgaagaaatattttggaactaaacacggtggaattttgcacggatttcattctcagaagggtttgaagagtaaggcggtcagcttcagtaaaattctcaaccaggtgccactgtaagaaaatccaggaaactaattaagcatcactggaagatcttgatctcagtgaaaccaagcagccgcttcaaatccatcaggaaaacaaagcaggcacaacaacacaggcaaaaccgtaagtttcgagctccacttcaaacagagaatcgacttgcatactgtcatactgatacagcacaattgcacaaacaagtgatgacatgattagaactcaaatcacacatcaaagtttaactgaaacaccacattttatttaatctgggaaggttacaaagattacagcattcaacaatctgccagcaaaaccagggatccggagtagaaaaacaaccacacagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccaatgaagttgaactggagattgaggccctccaacgatgccgacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgaccacggccaagctggcatcggtgaaacctgggcaatccttgatggtgagggatcggagagacttgcacaggggaagctgcgcgggagcagagcagatgtccttgatcccgttgcacttgaccagtgagagggccttaaacttcgggctgcagttgaggaggaaggccagaatgcccatgagagtaaccttgttgcattcctcaatctgcaaactctccaagacctttgccgattccgcgaaatccttgagacggccatccgagacctgaccgcatttcttgaggttgagctgcttcaagctcgggcagaacttggcaatcgatgcgagcgcaagatcagtgactcccgggcaggagctgacactcatgaacctgagcttctgcaggccaagggcgttggccatcacccaaaaacccctctcgccaaccgcgggaaggcgagcgagggtgagatcggtgatcgccttcccgtagtacccaatcaccgaaagagaagcatcggtgatgctcaatccctggaggcgaaccttggcaagcgatgcggccgcggagcagacaaggccggagacaccctggtcaccgacatgcgcgcaattcttgatgttcaccgactgcagcttcgcgcagcaccggccaatcgccttgaggccctcgtcagcaacaccggggcatgcctcgacggtcaccaccttcaagtccgggcaaccctgagcaattgcagcgaggcccttgtcggtgatcagcgggcagccggtgatgtcaagcctcgccagcgaggggcagccggcggcgatctcggcgaggccggcatcggttacctgagggacatgccacagggcgagcgagaggagcgacgggcagccgcgcgcggcggccgagatgccggcgtcggtgacgccgcgcgtcgggtggctcccacggatgacgaggctctcgaggcttccccggagcgcgtcggcgacggccaccgccatgaggccgacgtccgtggcctcgcgcccctcgaggcacctctcggaggagcagccgccgccaagggggacctcgaactcgtcctcctcctcctcgtcctcgtcgacgaacacctggttgaggtccggcaccgccgccgccgccggctctcgcttgatctccgacgagcggatgccgccgaggagagcgagccagcggcgggagacggccgcggaggcgcaccgggcgcgggcgcccttcacgcggcggaggatctcgaagaggcactcgtcggggagagcgtcgagcgacggcgcctcccgctgctgctgctgctgcttctgcctcttggccgccgtcaacccctcctcctccaccacctccaccgcctccgcggcggcggagacgaagccgcagggcggcacggcggtgacccgcgcccgcttccgcgacctgacgccgccgaacagagccgccgacgccgccggctccatcacaagaacaccaccatctgcacaaagcaaacccaaaaacacacatcagcatgaacccaaacccaaatccattaaaattcctcatcttgtttacctacctctgtaatcgtggaacggaggcatgccgacttcttcaagaacaaatcagaccaacaaatttggccccaaaaaacaacgcaagaatcaacaagagatgaggagaacgccgaacccaatcgccaggaggcgagaggggaaaaaagatcgcagatttagtgtgaggagatcaagggaggtggaggaggtgatggaggagagggaaggaagaagagggtgggtggtttttatgtgctttgggtagagaagaaggggggaagccaaagaatggagaggatgatgaggattcctgcccaacttgcacaagttgtgtgtgtgtgtgtggagggggggggttgtttttggcctccctgtcacactggatttgctggatttgcaatggattcattgaatctctctctctctctctctccctctcggggggggggggggggggggggggtnnnnnggggtctctcnncnnttcantgtgctggacatgcctgatgcatggacctctttttttcccctctttttacagtgggatggatggggaggaggcattgtggagttttgattgtgtttgaatttgatagctttgggatgaaaaaaaaagaagaagtgttcttgttagatttttattttgaaagattataattggatgcatacggctgtataggcatgtagtagtatgcgtttgttctcttggttgttaatactacttatgttttttaatatttcatgtccttaattttttatgattcgtttgattattcatcttattaaaaggttttgtgcaaatatataaaaatatagtgaagatttaataataactcaagtcataagaaactaaattgtaataaacatatgaattttataataagttgattggtcaaatgtattactataaaacaacaacgaagttagatattaaaaatggagagagtataacctcggacattagaacatcaaagagaatcggtaattcgtgtatgatcttgcacatttctccattaccattctgaaaaataaaaatctttaaatccaacttctcaattggtttcgtcatcacaggatattcaattaaaaaaaattcaacaatttactttttttcacactagaatttcccacaatttttgcatcgtttttgtgttgattaatcggcatatgatttttaatttaaagatgctttgttttgatacataggtcatgttcttttttccaataagagttgaatgaaaattaagattttcgtggcacgcttttcaaactactaaacggtgcgtttagtgctaaaactttttatatgaaagttgctctaaaatatcatattaatttattttttaagttttataataattaaaactcaatcaatcatatgttaataccatctcattttacgtaaaaaacttaatcttcatcttcaaaagaaaagagcaccaccacagtggtagcatggctttactaggaagctgtctagtacattaccatattcattactgaacaagtttgcatttatgcagttcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaacggtgactaggccctgttagaggataattaattggtaatcagcttctgataatagttaagttttataacttcttttagtttttactaaattctataactcaaaatcaaatctgaatgagaatctaatttatttaaggggattttaggacaacttacagtgcccagaaactccccaacacggggcctaagcccagataaattaacaaagccagtgccccagtataccaccctcaagtttttttcttttttttttaaaaaaaaggcccctactgtggacatgcgccacgcggatcgatccgtggaaaatgccggttcgatcgcccaactctgcctgctgccaaatacgcgcccgcgcgccgcttgatcaaccgatcgatcgagactgatctccaggtgagaaacctgcgagaccgatcgatatgatcgaccgaccacgcccgcgtccaccgctcgtccatcgaacccaacccctcgcgctcgccgtcgcgcgtgcgtgcatgcacctacatcaacaccaccctccgcgcgctgccacggctgtggctggctcgcgctgcgtgttccgtgtgcgcacaagtgcaacgcacctgggctagctgggcgcacccaccacttataactaacggaaagaaagaaacagagaaagaagagagatgaaacgggaaaaagaaaaataaaatgcgatacgacatgcaacggcctgctgctgctgggtgtggtggtgtgggtggtgaggtcgtccagtcctgtccaggtgcatgcactattgcgcccctttttccttcctcccccagcttctttcgcccttatcaaatccacagcttcgtcttaattagacccctgttaatttaaaaagcttaagaggcagcttgtcagtcattagcttctgagaatccagcttaagaacccgcatgtgacttctagtttattttcttttttaataattttttagtttattttttaagtccgtagttactccatccatccctaaatataatggattaatgataatctgaaatgttcgtgtgagctaaaacttctgagagaagcggcagcatcataagcctcccaaataaaaccttagattagattaatgttctttagagcttacttttcttgccgtttatattaggttgttaaccaaccagtaggactagctaacttatatgggcatttaactattttttttgtcacttttagattgaacgtttaatcatttgtcacctatatggcaacgacatgtaagttcaagtgttaaataattatttgtcacgtctaaaattagcaaatagttaaatatcttgacttatcttgttactctagaatcttagatgcacttaattatcttactactatcagcctagtatctctctctatgtaaaactcggtaatttcaagttggaataattttgtggttcttaattttcttgatgcaccttaattttttttaataaataaataaattatgaatagcaacaaacataagagaacattattaagcccttctcaccaacttaggagttgggagacaaaatgagccaaaaatgaagcagttgtttcatagagtaaaaaaaatgcattcgttatttttcttccattttcttgtactatcagctagggttgtgtttagttcagcgcaaagtttagattttggttaaaattagagatgatgtgacagaaaaattatgtgtgtatgataggttgatgtgatggaaaagtactgaagtttaatccaaatttgaatctaaacataacctaggttgatctactacgcggtttcgtggtggcctcttgtgggggtttgattaatgactcggtgaacagaactactaataatcgagagtactgaaacttacacgtgggcccatttcagaccagtgtttgtgcgtggggcccactgtcagtggctctacgcggtcgtccctcttgttgaacgagctccggagtccaaactaccagtccaccatggaaaggtcgagctgacgtcgtgtgaattgttctttttttttccctttcaagaattatgatttgtttgaccaacgagttgactgggagaatttttattttttttataggtgagttgggttgtatacgtagaatttgagtaaaggtaggtagctcgaactgtttttctatgttttgatgctattataaacatggattttaattgtacggtttggagtttttacctgtcaatctatatattgctcttttaattctccccccccccctcctaactcctaagtggctttgtttggttaagtgaggtttaaatataaactcataaattgaagcatttctcacatatttatgcccatctcacattacacagatattaagaaatcaggtaaaattaaataaaagaatattgtgattggtcgagaaaatgaagaggtgaagaatttgaatggcaaaatattataattgattaaaaagggaatatgagtggagaaattgttacactttggagtataggacaaattttgaatggtataacattattatattttaggacgtagggagtaggtgattaattaatacatcgccaatctgtatgtaatggccaagcttagaaagcttaatcgataaaaatttcaagattatgctaccaagtatattagaagaagaagaagaagaagaagaagaagaagaagaaagtgaaagaacaataattttgtccaaaagaagtgtactccgtattctctatagaggagggaggtaaggtacatatcaaaatgagatgtattcatcggcagacggcacgcctatagttgctcctattctacctttcaatcttctcccaacaccaaaatagggtgtatttgaaaaagacatatgatttatttttagaaaaagaagataccaacgttattactatttcgtataatggactataccttattgatactactgctttcaataaaaagtttacactgtttagtgataggcatgattagctttaattatttccccagaaatcgacattgcagaaactaggtcagcttattgaataaagatcacttataagatgattattcttccagcagaaatttatttacatgtcaaaatttttatcatagtcaattatcataatcctagattatatatatacttgcaaactcatatgcttgtatgtcacatatcatttaacaatagatattccgatcaaattatcacaaaattatagatttaacgtgtaatttctcacataactatagatttaatatagagtgtcacaaaaataaaaatcaagtagcaaatttatcacataactctaagtttagtgccaatttaatcacaaaactacaattatcatagctccaatatgatggcaatgctatggatttaaactcaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattcatcaagttgggtttaacttttaattctttctcttcacccttcttgcactggaccaagacctttattctttttcttgcattggggagctgaatccatcgatagattcgtgagagaaaggtaggagtagtaccatgatgcatgaccgaccaagggtccatccatccatccatctcgatctatactgtctactagtcttaaacaaatgaaatgtgtgagctgtttctcgacctgatcagtcgttcttgcaacttttgcaagttgcagcaataaaataacactggattgttgcttagatcacgcaaaatgcagtacaagaattcctaggaaatgaatgaattgctggctaggagtagcaatccagagtcttcttcatcatcgtcttggactgcactttctcggcctccatttgggtagttcatgtggccaggtgagctgaaccttgaatgcatgcttgtgcaatttgccgattgttttagctaaggcgtagtacgagggacggagggtgagatgacctaaagtcctgaagaccagaacgatgaaagaggaaatatgtcggttgctaattcatgcaaattattaatgcttgattaacttttcaatcaaacgcaattaatggttaattgattaattagtcccccacctacatcacttggcctgttttatatagtttgccttatggtgtcgtgtgttggtaatctgtggatcagcagatgccacggtgatctagataggaaaattagttcacagtacttcactcacatctgcatcttgagctatctatatattcatcctagctgcgacttgtgttaagtttatcatataatcgttgtttgattgctctctggttggcttctttttaatttgcagtagctagctatgcacataagaaagctagccatgcatgtatatatgaagaaattactgctattaagtaggagatcaagatttaaagttcatatatattagacaaacaaaaacacttctttttcctaaaaaaattagattaatagttctccacacagacgtggtaatagtcgtctttcaaaagtttatagcttaaaccacaatccctgtttctttttttttaacaagttctcctagcttgtttagcagccggttttctgaatctaatcccatcttgacgccttgacgtgtactagtagaattctagctcggacaccggcggcaagttgatccgaagctgcgcgcgcggggcgtctctcccggcgggcgcgcgagagcgcgcgtgcgcgtcgacgacgaccactaccaccacctcgcgcgacgccggtctctgcccgcgtctccgcgagcgcagcacgcgcgacgcgacgcatgcggcgtacgtgcgtaggcgcgggcgtcacgcgccgcgcggcgcgcgcgcgttcagtgaacctgcagcctctgcgtacgtacgttgccgtgccgtgcgcgatcgatcgaggcgcgcgtttgctagcttatgatgggtttttcccgcgggcgcgagcgctttttcctccgtttgcgccgcggggcggggggagtcgttttcggtgccaggcacggccggacgggacaaagcgagcacccgcaaacgtgagttcgatcgattgcccggttaatttactatggccacgtttgatagggttccaactcctaaatttaatttttagagttacgtttagagtaaagttgtagagcaatataaacccggcttcatctggctagttgttttgtgatagcacttcagtccgctccgttttattttacgtggagatcaaactgtttgtttgagttccgtcttcagaagaggtagaaataaagttggagctctcgtgccaaacaggtccggcttcacttgcaatcgagagtcgtagaataaatctcaactgaagatctacttggtgtgttcaatttcctagaaacgactggatcagctccctagcttcaagacctagcttaggggtttgtttgtgaaagcttcggctctagctgcatcacttttggaactgaagctagtctaatcaaacaattttagctctataaaaaagaaatagccgagttgactagagtaacctaaaaaaataaattagatgtgtgagtggagttcgggccgctatatagaactcatctccttagtgatcgctccctgtttttttagccacttcaccatatcattactgtgaattatttgccccatgcctctaaaacaaatttttcttcatatggcattgcttaaaccactttctttaagttatttaatttatgtttattttcaaaaagtatttaatttatcactacgattaattaattagatgatctgataaataatctatttcaaacacataaaactgctgatatgaggtaaccattatttgaagtagagttcatccatcaaatttaattttaaatcttgatgtctataattacacgcatatgtgagattgtgctctcatcagcagagcatgtcttaagagagtgcgcttgcgagtgtgtacgtgagacggatggggtatgtaatcggggaaagaaaattcttaacctgatcaattgttgtatttcgatacgataaaccatcaccatcccaagcattgcaatgcctgcacagcttgcatgcaactctgctaattttcccgacctggaccacgaccatgttgcctagctagtgcttggggagctgaatccaactgctaaataatccaactttctagattatttagcaagtactaatgttagagaaaaatatttctctttagtcaactttagttatcattttttaatttttaaatcatctgattagctcaagatttattaaaatgatgtgtgaatcatgcgaataagtagaaatccttatattataatattaaatttgaatttataactttttgtattattaaacataggaagtattatattacttcttatattacgcaatagtgcgatgaccagaaaaccaacagtgagatacctgtttatcacgctcatcgatcaaatccatctagcgctggcacatgcaacaagttgcccagaggcacaataagagggcaagaatgcaactatgcaagatggcagttgttgctgttaagaaaagtgcaaagagatactgtaatagttaaagatctagtgctactatttcgtttgcatcaaattgcatctatcaaagagagtctgcaggagtactactattcatcaacaacttggacaagatatgtatgttacatttatatatgacccttaaattttagaggtgtccgggtgagctgaacccatgcatggatacatctgcatccaagctaaacaaagtagtataagtacttattttagtgccacgagtgtaactggaccgttttagttgacgacctagtcgtaaacaaacaaaggggatcgatgtacataccgagagggttcatgaatctgaacgttttagacccgataccaaacaaagctttttgccgggtgttttagtttaatttaggcagtcgctttggcacacaaattgtcgtaatctatatattgatatcaataaaagtatatatggcctggtaaagaaaatgaaaagtataaagcagtgaatagagagttctttgaaataacttctttctccctccgatcccttactttttaatcatagaaacactgtgcgtcttgtatatatgtcatgtgtttatacatatctagatagctaccacttaaaacatgagtttcgtcatctatccgtcgtgttaggaaaccggcggctcataaagatccagcttagttatacccattaattggactgatcactaaatatgaaaactatctatagctatgcctctatatagagagaagatgatgctcactattatactccttgaggatgaatgaatgaatgagtgcctcacctttaaatcttgtgtctttcactttcttatagacatctgtcatgtattatgcaaaataaacccacaaataaaacgatttagatggtacccaaggaaagacatgcataaaaaaattattttccgaagtgaatatcttaagagatcctcttgagaaaacgaattatttccacgggcctaaaagaccagccactatacccaacctctccttactctcagccttcttaaaaagtaaagaattatgctctccctcatctcctcatccttatctcctcgagcccctctctcttctctcactcacaaactcaactcctctctcactcacaaactcacctcatctctcactcacggcagcggtggtgcacgcacagaggcaggtccgacggtgtggtgtgcgttgatgacgaccgccctccctcgtggatccaacgaccaagtggtggggaggggcgccagatctggtccaatgggaaagggcaatgacgttgacagtggctaggggcgatggcgtagatccgatgctgctaacctttggagggatgccccacagccggaggcctctttccatcccttgtgcctggattcaccgtcgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtccttacagaggtaaggtgtgcgcgcgcatttagaaagatacgtgagtatgcacacgttgtgagcgcatatatgtactgtgttttaagaaaaatataattactacctctctagaaaagttttacttttatataaatctagacaagtattattattattaattatgtattgtttcgtgaaagaaaaacaaacttcttcctaatttattattaatgatagttgtatgattatatttacagtatgacacaatcacattattacggtggctacacagttttttaagaaaatacttatatcaaagttaaaaagagaatagtataaccattgacaggtatttcaaacaaaaaaaatatggagtaataaatgcgtgtagttttactttttagctgcacgtacgtgtcggatgtccggagaattgggccaagctggtcgtcgctggatgctggcatgcaacgcacccaaccaaagctgcaccggcccgtctctattcgagaaacaaaaactgccaactggtgactgagaagtgagaaagccatacgggcacaagacaacgtgcaaaaccagctggatactcgggatttgtacactgtcaatacaagctccaaatgaatttcttacttcaaaatttgtatccttttcaaggcaacttcacaacttgttgagtgctcttattacacctttttttttctttctgacaaattgatcattttcagaaatttattgtgaaactaagaccgtgccaaaaaaaacttcaataaaaaattaagccatgttctcagcaccagagacattggcgctgaggttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagtttccgatcgataaggtgttaatggtttattttcgaaactattggtgctggtaaaaaaaatgttctgctattcctctatcaaagcatgtcaatgtcaaacatttgctaaagttgtactccctctgtttctgaataaaagtttagctttgattttttttcttagtcaaactaataagattatataaaaattagtagcattttcaacccaaaacaaacatattatagatttaatgaatctaaaatttggtattttagatgttgataattttttctataaatttagtagtaaaatatcaaaatgacttctaatataaaacggagagggagtatatacatatgccaaacaattttaccaaaatttgggtaatacccatatatacacatatattaattccacattggctcaattttccaaatggcacattaattcacacaattattttttgcacgatatcagaacaacttctcccatttatatctctactattataaaaactgaagatgtttttgccagaactttggtacgtcatccgtatatgagtcggtttttaagttcgttcgattttagaaataccaaaggagtcgcatagaaatctcttaaaaaaaactcgcatgctaacttgagacgattggactcctaataacaactcatgattttctaaaataatatatccaagcgaattctaacggtgagttttacctgaactaaaccttataataattataagattagaatagccttcacccgttgcgtcgcacatgcattttctctagtcttataaaaaaattggcaataccaaatagaggtaaggtagagaagtttatataatctaacatttatcatctcaaaaattgcctcagcctacgaggctacatgccaatatatcctgatcctacacagtggcggagccaggataaaattatagtggggtttctcagcctttgggccttataacattattagataaaatctattttagcccccttacaatagatatatggatttaaattttaaggggtcttaataggggctctaatgatttattagggggtaggggagacccccccagcccccacgctgcctccgccactgatcctacat

SEQ ID NO: 81123 - DNA, 20440 bp, Oryza sativa
acaatactgacgagggacctccttttcattggttttgtaagctgaggggtgcgttgtatctggttttgcggtgcagggatgaatttcgaacttggtgacaaactgagggacctaaagtgaacttattccactaataaatactcctacagtaacaggcaaaagaaaagaaaaggaatccgactcgagcggtatgaggatctaaagaaaaccctagcggcggcgattggtgtggcgggaaggcggccatgtcccccaaacggaggaaatcggtggcggcctcgagcggcggtcccaaatcgtcgccggcggcgaggtcgactcggtccaaatcgaagccggattccgatctcgccgagcacgacgacagtcccagatcgtcgtccgggaggctgactcgctccagagcgaaggtgttggaggagtcggcgggagtgtcttcgagcaagaagaagagaaggatcgaggaggagtcgccggcggcgacgacgacgacttcgacgacggcgacgacgggtgtgatgcacagggaggggcatggcaccttggcgtcccggccactcccgccgatccacccgccgacgacaccccgcgtcagaaaaagctcccgcatcgtccggctcgaaggtttttagctctcgatccgtcgtcatcgatcctctccccaccactgttaatttcttcttcttgttttaatttcttgtatacctattattaaccatgttaatttctccccatttctgcttcttcttcagttgatcgacttcagaagctaactctctggcgcgataagaaagatgatccctccaccgcggccgccttgcctaccccctccgacaagaacatggtgttgggcatgtctcgctcaattgtccgcgtttcatccccaccttctggtaatttactccatccgtcccaaaaatatggtaacctatggacaacatcttagtacaagtttggaggcatattcagattttactgcctgaatctactgtatttactgctaacttagctactaagtgagccatgtgctaggctgctagcatgtcacgtgtggttaattgcgttgttttacgcattccctatctagcattacatgagaaaatcatgctgcatctccacatgggaattaccgtggattttgtgctaaactagctgcagatgttaagggaaaagccggtgatataaaagaaagctaccgagatagacatgtgtagtccaacaacaaatggaaatatgtgttgtttagtgtatttagtagcccgatacaaaatatgtatttatcggctcctagctatgtagctacctgctaatcaactgaatgtttttcagagggaaaattgatctctccgcgcaccggattcgtcatcagttgggatggagccaccaagcgtgctatgatcgtcacgctcttcacttacttcaagaagaagccgcatgagccccaacccgaggtgcatgacttagctaatccccatgttaccatcatctgagttccattactgttcttgttaagtaggggctaacccaattgctaaaaatgacttttcatgcatgctaatttctttaatttcttggtgcaagtgtagaacaccgatttccattaggcaatccccatgtttctatcaatccgagttccattaccatttttgataagtatagtatggtcaagtgattgctagccgtagctgggctgccgtgcatttgctttgtgtgaattttactgtgccctctgatttcaattctcaaacattatcattgtcaaattgatggccttttcttgtatatccttagcatgagttccgtctcttgtgcttaagatgagtaaccattaacctttctttttcttgcattgccttctctctctatctttcagctgcaggttcatcttccagataagtctattgtgcagggacggttgatattcatgaatcgccactacaatctctccatcttggagatcacgtctgacctaccattgcaggtccctgcttttgggtccgccccaaagtatggccagaaaattcttgccttgtctcgggatgaaaatatgtccctggtggcgaggcgtggagcaatcacgtggtcggatggttctttcatgtggagaaaccattacatgtttgtggattgtgatgttcctgaggtactgatacatttaccttttcttcacacttgctatttgttttaccttctacttagtggtatttatttattttttaattaatgcagggtggtgtaggagggcctgtggttgacagctgtggtagttccattgctatggtatacagagccggccctggtgcagttatcatttcaatctcaattatttgcacttctttgagatgtggaagcaattcaggtatatactatttttccatcagtattaaaatatactacagattgaatcaaaatcgagcaatttctatgtggcacgtaaacccactaatcacgatatattcttattaattgaatgtttatggataaatcttttatatctatgttattagcgattttaaaagccaatgctgaaaaaactacgaaaaaacacctaaaatcaacttaaaattaagttttaaaattcaatttgctaaataataaacatggcctacaaagtggttggtgcgccaacatgcacgctcattttctcctaatagactaagtcaatcttatctgtagcgctcattttctactatagactaaatccatcatatctgtatgctcattgtctactaattgactgaatccatcttatctgtagctgtgttgcccgccctgtgtttgacgtggatttaagaagtgtggaactagctggtgtgtcactccgggaggagctctctgtgaaacataacatcaatggtggctttattgttaaacgcatagctgatgattctgctcttgagcatctcggtgttagacggggtgacgtgatcttttttgagaacgagtgcgggactagtttgcctgaggtgaaatgaattctggtctcaagtaatagtttaatataaatcaatatttgtcaagaataatacaaatgtgttgtgatttctatttttaaaattctggaacagatcgaaggttatctcctttctcttggttggagatacctgcaggggatgaaaaagtcgatggttctcaaggtatggtattacacaataacaaaaatgccacttttttttttgaaaaaaattggtaaaaaataatcagcagaactgtcttccttgtgtagttggaagtacatgacattgaaggtccatgtgaggagacaattaccttacccttaaagttttctgtcgattcaggaaaggtatacttctctaaaccactgtacaattgtcctactttgcttgttttaatctctagattttaccccttaagcatcgacaaatgtgttgaatttaaggttgtccgctggaggatggcttgaagatgtacagcaagactagttagagcaaggtcaatagtatagcccaccgctgacggtaccaaatgccacgtcattttacagttagtgtaaagctaactaatacaatagattggctattgtgctaactacatagaagctattaaacaattaattttggatacacagtacgatcaagaatgtactccatctttgtagccatttgtgctgtcatgagcgtgagtagtctaccgatgaagaaaaagaaagagtttggtttttgctttcctagctcatctcccgcacagctttagattgaaatcaacaccagaaacagcaactaaaagaaaatgactggtggtttatccttttatccatctccattcacacggaagcaaaaatgagagaaaagaaaaaaaaacaagagaatagcaaagaagaaagatgggttttgcagctaggcaatggctgattcataccagagcaaaccgagcggtgggttatgtcgagtcacagattaaggagctccatccatacatcgattcgcttcagttcggaagggagggcgtcgaccccagcagcaagaactcgattttgaggtttgagaagcttgattcgtgccgagagaagatcgacccagcggcaagggcgtcggttcgcgtgcatgaggtcgatcagcgcgagctcgaaatcagctggtggagctctcgaactctcctggggtgaatcattgccggtgtagtgacgtgacgctggccaacattccggcgaggaaccaagcacatcggcgcacgccggagcggagaaggaaaaggcgaaaagcagaacataggtgggaacacaagtatgagacatgagatccgatgagtatagatagccaaagggcctgcccggcacggcccggcccaggcacggctgggcacggcccagcagtcatcgggccggcacgggctgataggcacttcgtgccgggccgtgccggcccatgggctgcacctcctgcccaggcacggcccaccagctgtcgggccgtgccgtgccggcccgaaggcataggtggcccatcgggcctttttaaattaagtctatttttgttcctcctctttgggctatttcatatgtatagctaaaataagtctattttccgtccctcctctttgggctgacatatgtatagctaaaataagtctattgtctgtccctcctcttcggctgacatatgtatagataaaaaaaagtctattttagatccctattctttcgttcatggcatataatatgtctatttttactcccctattttttctgtgtatcgggcctagctgccggcccatcgtgccggcccatcgtgccgggccggcccggccgggccgtgccgagccaacgtgccggtggaggggcccaggcacggcccagtggtcggcccgggccggcacgggcccgacctccgtcgggccatgccgtgcttgggccgagccaaaatatcgtgccatgggccgggccgtcgggcctcgagccttttggccatctataccgatgagggtggttgcgggacccacaaaatgtattttttatcgtgcgacacgtgctatcgccgggcgcttaaatagtcgcccacttcaatctctctcttcagttattctccttccacctaagaatatgctgacatggaatattttggagcctgctgactagacttattgtacctgctcttacctggggaagataatttagtgaatgctagggcatctccaatgtgcatgtaaaggtgtgtttataagcaataaatattagtacaactttgtgtatagaaatgtgtgtttagaagagaatattgttatggctaaccttaagcttagagctagccagaaggtaaacagaagaacttaaaccattgtaacattgactataattaagcaaaagatatgtgggttttatcttatggttattgtgtggctcaatattaaggatgcccttatgtaacttgagaaactgaaaaatgacttgtagagccaaactctgagccctgctttgatgagcttggaatttgtagttaggatagaaaataggagtactgaatttataagaattgagtatttggtcactgcagaagaaacatgtgatctcaataagtgcttgctcgacttaattacctttgtcttttggatattttcttggggaatttttccctagtgtcacctcaattttgctggattttgctaatatatacaccaatggtatatcggtataatgtacttagtgttactctctccatttcatactccacacaaagacattttgggtttggtctaaattaaatttattgacgtgagactcgaattttgggtttgataaagaaataatctggttacgcgagaggggtctacagacacgggagagatttgcaaaagtgtagtcgcagcaacacgagagatgagaacaaagactattgcaaaggagagggagagagagtgagagagagtgtgtgtgtccagtcttgcagagagtgtgtcgtcttgtagggagcagcttttgcatctttgctgtctgcacaatgctgggccccggtgatatctttgcgggccaagggctaatgtttggatgctagaattccggagagcttcccgtccgggcacagacagcaagcaccttgctcaggccatggaaatatgtttcggttttttccaagccctccatttttcgctccgtttgagatagtacgacgattgatggccaaactattttttgtgattgctatttatggatataaacagtggcgaatccagaatatgaattgaggtggtaaaaatatcagatgactaaaacaactagcttttgtcaactcgatattgttcctaagagacctatacgcatgtaatgaaaaaaacatattacttgacatataacaaaatttgtgaaaaatcgaggtatatggtgtacttatttttcttatttgcaactctgggcactagcatgaagcagtgagacagctagcgctctgtatccttgccatacaactagcttttgctaatcatgtttagtcattggtagctaacaagaggcaggggattatggaggtggggctggcgccccaaccagcccaaagagagaatccaagggctgttcactttgttgaaaaaaaaaaaccttaccaaaattttggtaactatgctaaaattttggtgacttgtcaaaattttgacaggatttcttatataggtaccaaaatttggcagcaaactaaatatagccactttttgggcaactttaccaaaatttggtaaggttgaaaatggcactaaagtgaacaggccccaaatataaataaataaattaattgtagttgtttagaaaagtgttcctataaaaattttacagggatgcaacactaaaagtttgacatcttgtaaagagaaaaaaaaatccaaagtccagaatcggaaaagagcagggtcatcataatgacaccaaatattatattttactttcaaacctttcaatttgtaaacattattagtaaaaagaaaaagatggcatgtgctaaagtatactccctaccagtgtagtggaaaaaagccgtatatatatactgtaacgacagcaaatccattcggttaatgtgatacgatccacatttgttattcatgaacgtcaaaactctgttttaatttagtgattaatcgaccatattctccgtttaatcgtccgaataatcacccgtatgttgtacttgatgatgacctaaagtagtcttttaggactttgtttagcgttttatttttaacatactctttagttttacttattcaatatgaccaaacatgtcaatgtttggtgtataaatgcgacgttggaagctactccctccgtactcgtaaaggaagtcgttttgaacagtaacacggtcaccaaaacataactttgacttcttgtttctataaaaatatttattgaaaagtgatatatgtatacttttacgaaagtagttttcaagacaaatctattcatataatttttacattttctaactcaacaacttgagagttattcatgatttatatttccaaggtttgacttaaacattattctaaacgacttctaatacgagtatggagggagtatatattttaagttaatgttaagttattcctgttcaattaaaaaacaacgtgaatatattcaatttatatagttatacacatttacatattcaaataagtgcataatattataaagtgtatacacatatttgcgaacgtcaaatttctacataattccaattaatcgatgaacggtaatttttggtctgacaaacgtaatttgtcttccataacatagctctctctgtatgttgataatactcgttgttttgcataggcctgatgtcacattttaaaatctttgactataaataatttctaaaatacctgttttagaaatggagaccatatggatagattagtctaaaaagtacttcaataaaatcatatattagttgatattttcatatattattattattattatagaaaatagtggttaaagttaagtattataaatccggagagagttataaattatggtaaatagataaaatttctaacttactcatgaattttcactcaatctctttcgtgtctatgaatttttcctcgtcctctatatgatactgagtttttattttgatcctctccatacccatactgttaattgcctacaagttgaccgtttgaattttcttaaaacgactaaattttgtgtgaattttctcttgtaaatatgtacataacaattttgttattttttcttaaaaaaaagggtatagccgcctagaccgagacgaacaaaaacgaagagaaggaaaaaatgacagcaaaagatcgaaaacacgacaaacacacccaagtaccctacgtgtagatagattgtgtttagggatatcttctccaatcccgtaatattttcgattattgttgtaatgacgcagcataaataagtataaatacgtggaagaaaaaaatatatatatagcgtgcatgtcgtcccgttcgcagtacatcgtcctgatcgatcgatatatcggccatacttctcttcgatgcctttccatgcacagatgcactctcaacagcttttggctcttggctaccccatatactcttgttttctcttcaaccttgacccgttgaccgcacctagaatatcccgaatttatggacgcgcttattttctttttctaccgaccgacccatacagaaatagaaatggtaaaccgacaaaaaaaacaaaaatggtaaaaaaatggaaatgatttgttgttttaccaaccgttttcatattcaaccatatttctatgcatggaaattaccatttttacaatactataattactgtgtttctgcggaaattaccatttctacaatattgtaattgccgtatttctaatacctatatggtcatgcatctgtttcacccaaagtgtaaaagtcaatcaactttttaaccaaattcctaatgtaattaattacacggctaaaacagagatataggttgtaatttattatgtggtgtaagttttaattaatttacagtcatattatatagttatggtgaactaaatatgtgatgattttgcagtttcatgttttcgacagcagttaccggttccgggttgataccgacacattttcatccgtatagttctatttctaattttctgatatttaatttcagtactaatttttttccagctctacgttatagattctgtatacgaaagatatatcgttatggaaatgggcgagactgttgtcagaccgtttacatgcatcccatgtaacagtataatagcatgtcctcagtaacaataagtagtcaatatcgattagttcgggcagttaggactatatatatagtgtcatcgcatctatttaattaacaccaaaacaactatctgctaacaaccaaatcgataataagccaaaaaatttcattttttttcgcgaacgcgcaaaatgattacacgtcaatatattagaagaatagacaaaagggcatgtagcctagtggttacagtgacctaagtagtaccctaaggtcctgagttcaaatctcctatggagcaaaattcagattgggttgtttgcggggctaagttctctatctcaatggccgtatatatctggttggacatagaggctgggtagaaaatacccttctccctaaggtcctgagttcaaatctcctatggagcaaaattcagattgggttgtttgcggggctaagttctctatctcaatggccgtatatatctggttggacatagaggctgggtagaaaatacccttctctaaaaaaaaattagaagaatagagttttgatacacgacgcactcagccagaccggcctataccaaggaaggaagaaaaacaaagaaaggaaaggaaaaaaaactcgaaacgacggtaactttactccaaaaaaattcattcggctaattgtttgactaataaccgaacaaaacctgtaccaaatttagctatcaacgcctagccagttcaaacttgaaagtaatactccccttatacactgtcgatacacacagtcatctactccccttatattgtttaattgacaattttaacaaaaagttcagctagtgactggctacatttcttttcatttcattattataggtggggctggtcagctagtgatcttgggtaaatatacgatggaaccttaacttaggtgaaaactattgtaaactctaacaaaaagttatctaaattcaacaaaaactcacacatatggataagatgatagttacataaccatgtaaatctcgtacaaactcgacctcatttctgagatataaaagcaacaaattttgaaaaaaaaatcattaggacaattttttggtttgaaatttgtttcttcaaatgaccaagacagttgcaaggtttcatattgatgaagcaagaaaatattataagattacaatcttagaaaattaattgtagccgaaaaaaaacaaacacacggccactgcaagctggtagctctttgcacatcctaggagaacaagctagcaccaagccaatcaccgctaaacctataaggtagtcgcaaacaacccaccgaacatcgactccacacagaagatcatcgatgagctctggattatcctcatgtagaggggttgaggagagggagagggcgagagagaaggagatccactcgtccctcactccaacctgatgagggcaatctataaccgttgacgaccaaaccgagagaagatgacaacggcgaggaacaaagaccttctaggcaatggctacagggaggtcatgacgtcatagatgccatcgttgcccgtcctaccggactaggttttcactcggagagtcctgctagagaggggaagtgtggccgctcgataacgccccaaggagagtcacgacgcccgaagaagtcgttgttgtcggctcaggaaaccctccaagctagacttttgcctacagcacccactcttgcacccgtcgccaccacttcaaagctccaccattgccagccacgctgccctccttgtcgtcgccgcacccgcagtcaccggccgtggcgacatcccgccgctcctagcgaaatccggagcgggacctagatccggttgcctatagattcgccactaccgcgtaggctcctcccccgccacccgccactcctccgcagacgagaggagggggggggggcggggcactagatctggctagggtgatgccaaacccgacgacacaggcccctcccccacgcgcagcctgccattcctccacgcactgtcgccgtgccatctaccccgtcgcctatcactccactgtgcaccgcctccatgccctcttccactccgccaccgcctcctccacggttctcctcgctaactccagtggaggagacgcagatctgggccatggtaccccagccgttgaggtttccatggggagaaagcgtccgccgctactatccttgtggttgtccggctttgttgacgagccgcttgggcagggacgaggtgaagaggaggaagagggagggaggcaacggtggcatatttttgcctttcgagtcgtccctggggtgggaatgacgcagacatgagaaacggaagctttgtttcactagatggatcgtatcagcttggtttaaatttctttattttttatctcacaaaagaagccgagtttggacaagataatgcatgtttatatatagttgtgtaatatcatctcgtccacatgtttgaattaattttgttttttgaatgtagagtcaaggtttacaccatatttacatacccggttatcctcgccgaagttgtggggagagagttgaaggctgctgcgtatatgtcgtgttgcagggagagctgtattgaaggcaactgctgcagttctgcacagtactattcttagtattctttggtccatatcttttttctctacagcctttgggcagtggtgcagtttccatcttcaggtaagtctagtctgcatggctagaggcagctccttggcattaacatcagctagcgatggccggactgaatgctccctagcaagtagcaacctgtgttcttgagtcccccaacaaccagtgttctccacctccggtccatggcgagctctctcatgtctcatctcatcactactggaggagctggccgcgggtgagaggttgcagagatgtccgggtcttctctccgctcgtgagaggttgcaagcaaaacagacggtatgcatgcatcatctatcatttctttcatcagttggtagatctactatatatatatatattcttgcaagaagccaagaacacatcttgaaaaagttttgcttgtccattcatcgcgatctacagtttgcttttccggcgaggttgtggactggagatagcgcaagcgcacacacgcagtccgtcgatcgatctgcctcgatctacagtttgctttgccggcgatcgaggttgtggactggagagcgcaagcgcacacacgcagttcgtcgatctgtgccgcacaagttgcaacggtaagtccctcttcttccctcgtagaacaatcgtatatatatgggaaactattctaatccctcgaggggatgttccctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttttcttttttgtttctcgatgtgtagatcgaatttgaacatgaattttggtggactagtaggtatcattataatctacattgtcaatttttttcagatttttttacaactatttgcatcgaatttggaagaaaaaagttatacgagaggatatcccctcgagggattagaatccactccctatatatatgttatatatatgttagttgtcttttggcattttgatttcgttctctctgctgtacctgtgtgatgccgatttggttttctttccctgcttggctagctagctgctgctacttttctactactgtaatccattccatctcatgcatgcatgtccaccaactaatctcaagtatacattacttttgtctcctagatctggatatatagatgtcaaaaaaatagatctggcttcttttttattttgtacgatatatagatgtcaaaaaaatagatctggcttctttttttattttgtacttactagtgtatgttcattttaattaacttaagttgcgcgcctttctcctgtctagtccttcctctcttgaacagctagctccccttccatcggattcgggcatggattcttttttacatcatctagatccagaaccgataatggcgtaaaaaccctaacctaatgagaatggatcgatatagaggtccaaaactggggtagtagaatgtaaaccggcctgcctgtgaattcttcgaattgggcttcaaagtaaaccatttagatgggcccttttcgtattagaatagggactgcatagaagcccatttgacgagcccacccaccatcaaaaccgatggccatctcatcacaaaagaaaaagaaagttacctccacgtaagcacaaagccatccgccacgtctcaacccctgccgcgtggacagacacttctcttctcttcttcctcacgagtcacgcacgccgttcactccgcctctttctttctctctttctttctttctttcttcctgctcccctgagctcctgccttattacccatcgttgccgccggcggttggccggacgcatggcgatgccgggacagcttcaacacgcgatggctgccctggatccatgccgcctgattggcatggatacgcggcggccaacgctggggtggcctcggttcgtgctgccgttgctaacgggttcacatcctttcttttctttcccttttttttcgagttcacatcttgtcctttctattcgatttctattggttggtttgtttgtttgttttgaattttggtttgcaatttcatttactttaagctttttatgtgttctcattcattcttgtcttctagtttttgttgatttttctgaaaatccatctcactatcctatccttctttagatggctgatttaaacaacgacaacgtcttccctgccccgcatcttctcactcatccagcaaagcatcatcttgtttctaagactattcactctgttttcaacatcgaggtgaatgtgaggcatcaagaggaagataacaagtctgctttccgtcacttctgtagaatcttaaaaaggctccccattaataagaatctggatagagccgaaatagaggaaactactattccgactgagctctgcactgggtttgttattgagcagaggggaaatatactttatcttctaaccacagcccatgctttggatgattactatgatgcaaagaaccatgaccttaccccaaaagatcttaataaatcatttattttcaaagtcttgtgcatccatcaggagaggcaccttctttctctccaaggagtggatgataagagtgagcatctgaacagatacttctgcgatgcaaaagtagttgcggttaacactcaagttgatctgatgcttcttaagttgaaccgtgaggatatctactactcatatcaagatgcggataattttatcatttgtcccgaggaccatacacgtatcaagctaggaaaatcaccaccagttgagtctgagaatgtctttttacaagggtggccagcattgcgatcacaaacttcagtttgggggcacattagtcatactaacagaagatacgacacacttactagcttgaatgtgaaaggatataagatgaatctgattgaagtgcctgagtttcaatgtgcagccggaacatcgggaagtgcaattctgaatggggcagcacgttgtgttgcggtttatcacggtatacaaaagaattgtaaagccggatacgcaatcagttatcaagatgtgaaaacttttgtagatactgcacttgcaaatgtaagttcaattttatttccttttaactcttctccttttctcttttcaattgcttagtgacttagtcggttagtcctagttctgtttgttttcttcttttcagctgccaggtgatggtgatggtgatggtgatggtgatggtgatggtgatggtgatgatgatgacgacgaggagaatgacgataacgacagcgacagtgactatgatgaaagtgatgaggaagaggaagagagaaagaggaagaggggcaagggcattggcagcggcaggggtaggggaaggggcagggcgagtgggagtgaaaaggggaggggcagtgggaaggggaaggcgaagatgagatgaaagacgaagacgaagactgagagatggctggtggctgcgctactgtgtatcgcttcatgtcgagatggctagcgctactgaagtgtctaatgctgcatatctgtattccagttaattagagaacatgtctgtctgtatcccgttaattagagagttattcactagaactattgccactaggcgtatctagctaattaattagaattgttcactaaacatgttgccactaggcagtactatggctaatcatcaaaacattgtctattaattagagttgttcactaggcagtactaggcaatggaacaaggggcgctgggcggctgtggctgcgacaacagcatgatcttggttctttgctgttttagatgcatttcggcacccttgtttatccagcctataaacgcaaacctgactgtctgatggccactttgcaattgctatctgcaatagaccaagatggcagctgaggggagtatatctaggaatccgtttctttttgttgctgtttcattcttgcatgcatgggcaatttgcaaatactgtaaattgttgtgtattggtgcctagcaatttgcaaagagaatcaagaggtccatgtgcttctgaagaatgcaggtcgatgtgaatcaagaggttccacaaggcattgcaagttcatctacaggtttctgaatcaaagtcaggagtaaataaatattgtgcagtttgttcaatttccacgaaattaaactgtgcagtttgcccaatgtggagtactatctgggcattttagaagataacacctgttcacctgtctggaaacactcacgtgtctgcatcatgtctgaagtccatcgtctctgctatgaaaaatattctactttcccagcttcatttcctatgtaaataatagaggcatacaagttgcattatcttttctgataattgagtgttttatgatcattgggtctgcaagacagcaagctccgattcagtatactactagggcttactctacatcatgatgaactcatggcttgtgtagttgtgtatagtgtcagttttttctctgctctgattcagtattgccgaaatcctgttactcaagatttcaggcactgcataggtaatgagctagagtagatttgctgcacatgattattttctttgcagtttggacattagttatgtactggttctttctccagtagcctgaaaaggaaggttgcatagttactccacactttaccttgtgcaaagattttatatatatatatatttgaaaggcgggattttttttttactttgcaaagagaatcaggagtagaataatgtacgctcatgtgcctggatgcaaccagatttagcacatgttatttttttcaggtaagcatgtcttcctttcgcaagtcatcatggacaccacctaattgcaatatcagaagggagccatatctctctcaggttggcatgtccttcttttctttgtttaaatcatgaagaggtaccttttaattgggagtaactctgaacaggtggaggcagtctacatggaatactctagccagataatgctaccaagaagaggaccgtagtgggagtagattctaaactctcgttttttttaacttgtagaagttaaatttgacctttgcatgtttgtggagtgatttatcacatattaatctatcttgttaaattttttcataattatttgggtgacatgcaaacaacaaggggatgtcccctcgagagtttaaaatagtttcccagaccatagtggttagtggttagttgtgctgatttctcttttccagttcaaaatctgtaaagagatgactggcccaaatctttaaagttgatttggactatagatttcaatgtgtaaagtgatgttaactcatttggagcatatttataagtgattttattatatttagaataattgaatggttgatttgcagtttttaattgcaccattcttgcaatatgattgaattagcacaggagtgtctgaacttgaattcagtgctctgcatatgcagtggatgaatactcgcagtttacaagaaacctggaagaaatcaacctcctttattgcaccataattttattaattttattttgttaactttacaagagttttgctgttaactttacaagaaattgcaaacattcacattatagacaattctgtcaattcacatcaacgtaaagcggtcatcaggaagttggcgtggatatggagtaggtgcgaatttttgaaactggaacatctctgaaactgaggtacatctatgaaacatcagtgcaggagtatctccgaaacatcccacaggagtatcacagcttgcaagtttatgatctgcaagcttgcaatagcttgcagatcaaacactataaaaacaagcatgccagtatgctacagatagccagatagagtcaagcattctgtcaaaagctgctctttcctcaaaacatcagacgcctttctcttaaaatcaggtgaagcagcagaattgcatcttcctcagaaaattgcagctgattcaaagctgcaaattgcactgaactagtgaactctgtactaatcatgaatggttgtttgaagttgcatccaatcagattgccaactgacatgctcacgcacacacctggagcctacactgcacggtgtgcaacctgcagatatgttaaccataaacattaattagccccttccccatcttaatgaaatttggtcgccattccttcggccgacctggcaaaaaaaaaacattaattagcccaatgtcaaagcgtcattgttcttacataattttcatcacggtcgattaacatcatgcccaaacgattgaacaaatcagacaacagatggctgcgatgattgtgacttcacactagtgaaaattacagttggagtcaaagtcatccaagtgtcccaaaatgaactgttgtcacaaatcaagaacatgttcatcccaaaaggatttggggcctggggaagttgacaacttgaatgatgattgatgaacaacaacaaagaacagaaacccgcaccagagcaccaggagcatcttctcctttttatccttcgccccttcgcctcctcgccggttgccacagtacgcaccagaacgcaaccactactactagtcagcgaacaagctcactgatggagcaaagctaggagaaggtagacttgccggcgttctcgggcccacaagcaaggtggcggagagcggtgcccgagcgggcggccgagggtgacggtggaaccatacgatacgacggcgagtcggcgagggcacgcgaggaggagggcaaagatgaaagcaacggtcgtgattgaactacagcgttaaattacattacaaaaaaaaaaaaaaggagactcccgattgacctaggacgtcaaataaaagttaaacatcccagaatcaatggagcgtagggcttattcaaattgatatacctcttcaaaacatcttatctctagttttttttatctctatctcttttctatctctatctacttctatctactactagcaaaatgcccgtgcttcgctacgggtaaaataaagggttaaatgctataaaatacacagttagcatgtatataataactagcaaaatgcccatgcgttgcattgggtgaaacataaaaaaaaacaacggttttgctggctagctgtcgacagttttggaggctaaaaactttcgattttctggccgtacgatccgcgcgagatgattttctagctgtgcgattcgattttctggccgtacgatctgcgcgagatgattttctagccgtgcgatccgcgcgagatttggaaaaaaaaaatctgtacacgtgtgcttgcaggggctcgaacacagggtccccatcatggaagccatgcgtgctagccacttgatctgctgcatgttttggaaaaattaagtgagttacattttagttataactacattgtaactactatgtaactgcactgtaactatattatatatatatattattttaatacttatatatgagttacattatagctatagtgaaattatattgaaattatattatagttagatttgaaagttttctccttaaaaaactttcgacagttctctagatagtcccaaaaacaacagtaatgggtgtgtaggagcaaatcgaatctttccggtgcaagtaagatactaacatgacataattatttgttgatctaaatccattgacatgaatgattataggaaaagtattaataccactttaaaataaaattatgtattatagactataaagtttgaaacccaaaaagtatttacttttgtcatgtattattatgagttggttgcaatacatggttattttttggtacttgatattgataaacacatttttttttacatattgtaaagagtagcaataatataagaaatgtttctcgctatctatcagatcaacctcattgcactccaatcgcataatcattttcactcaaaaaattagacggaaatcatacgatgaatagaaaaaaaattggatgtaaacacgattcattctgttggtgattacatttttttttaaaaaaagacatgtgattgttttctattttctaaaaataatttattttgtcgtaaataattcattttgttggtgatcacatgttttttttaaaaaaatacatgtggttttttatttttaaattaataaaattgctcgttatttttatatgattcttggtagacgtggatccaacctttttttttttggtgtagtagcctcgggcaagccttctattatttaagctagtgctgcccaagctaggcaaaatgtggtattatttgtgcactgacatatgacccgtgtggggcccacttgccatgttagttaaaactggccacgatactgctgagggatcgaaattgacatggtattgtaagttaaaggatgaggttacctggtatttttatttagggatggatttcatattcggtgataaactaagggagctaaagtgaacttattcacgtttgctacagtatcgcacagtactgtactgggctgctg

SEQ ID NO: 81124 - DNA, 8263 bp, Oryza sativa
acccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggattttcaactagtactagatgattagttttgtgaagaagaaggtgccgtcaattgtctgtcgaagctccagaagactgttggatccgtcagcgcagcaaaggaagcagtgaagccagatgtgaagcaagagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcctaatcaacctgcagaataagcaaaacaaacaacacatcaacaaaaagagttagttcctttaaggtcttgtccctagttctggtctattctttccttgtatgctccccctctcaacctctaccttgtgacagatggataacactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtacctacagtccagcaacagtgcaagttatcagaatttctcaaaactgggcctccaacctttgccatggccgtcgatcctatggaagccagtgattggttgcgcacaatcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactacttctagaggattatgaaaattttgagaaacttgtggacaaagccatgcaactcgaaagtgagcataatcggatgacgaactgcaagagaaggattgtcaacatcccagtatttccatgtggaaaccaaggacagcgcactgagccacttcagatcaccggatcttctgttgcgcatcaagagtttccgccccaagaagatggacacaatgcagacaacaacattagcaatactaatgatgatgatgttaccaccaacaaccatgcttcttgccccaatagtgaccactcgaatcaagcgtgcaatgtcaacatcattcaccaagatgtcgacgatagtatcaatgatggcacccaaaatgacaaccctagtaattgggactctgggaaagactccgatggtgatagcaactatggtaccactgatgccaatgttagcaaggagttccagccaccaattccaactccaagtcagaatgactgtccccagacggatagctcagcaaagaagacgttgatttgctacaattgcaaagaaccagggcattactcgagggactgcctgcaaccaaggcaaagtcgacctccacattaccgccaatttacacgaagcagacatcccaatcgtattgtggtcactggagcaaacgccgtacccgtgaggcctcgtgttaatcagaacccatagcagaaacaatgtaccgatgctaagcacctttccttttaggcagtgcttagtattcatgtaatgagggagaaatgtgtaatacagacaagttccatgaggattcttttggaagatgcggatatgtgattatgtgtataattgcttgttgataaaggagacctagggtctcatttcagaggaactatattctaacctcgagttaataaccaacctgtggatggaaaagaaaaccaattaaactgtgttgggttaaaaagccaatgagacagtagttggggataggagtttgggtacgccttttacagatcaagataaggattgttggatgaaacccataagggtacccgccatgcctctacattgataagttcggatatacctacaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacaaaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgccccgcaacagtcaccttgtcattaagtaagcaagatgacctaggcaaaagtgtttctatgaaggcaaggagtgaaatcttcaactcggtatcagatgctacacggagtgaaaagtgcaagcaccggttaccaggtaatgccatgtcttgggagatgatccaatgggaaagaacgcatcaaggttaaaggtgtagaggaatacgttgaatgctaactgaggacaacctgaagataataatgggaagtaaactgaatgtaaagaaagtgaatccgagctgcttgttcgtgggagctattcccagttatgaaccaagtgatatgttcgaagatagtctacagaggtcagattaaaatcacatctaacaacgaagcttcagatctggcaggatcacgatcagacaataacaagtccagcagcaaagtcattcgggaagacgtcaaagcatgtcaagcgggataaattggttctcttgggaagcataacttatagttagagtggttgaccctggcatcgaatagcagaagtacctagcaccggagaccaggaaagccaatatgagacagttaatggcaagttgtcaatcatggtatccttagtaagcgggatatcatagtctaaagcgtatggtggtaagctggaaggaaacgccaagcatgatattctcatgataacaagcatggtatcctagtaatgacaagctgatatcgacgcataacgtgaagtgggtaacttgtatgaggttgacgccaaagatatgaattatgagaagttctggaactgaagtcccatcttcaagtgccacaatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcttgtaaggggggtggatttgtcacgtcctgataaatccatcccgaattaaaaatcattttctaaaaggaataatagaattaattaaaattcgaaaagaaattggcaaacactaaaatacgtacaagaaaaattcgaatgtggcccggagaatttttgttaaattctccttggtctaaaacgagccctcaaattttagtggaattttcagagcacaaataataattaagaagaaataaacaaagttaaagtggttttataaaaagaaaagccctaaaaagtcttcttttcccccccttcccttcttgggccggctcggcccaactccctccctctctctcctctcccccgcggcccatcgactcctccccgcgcgcgcgccgctgacgggcgggcccgcccgccaccctcgctgacgggtggggcccacccgtcatcgcctacctcgcgccgcgcccgccgctcgcccgtgccctagcgccgccgccgccgccgaatccgccgcatcccgccgtccccgcgcgccataaagagggggaaatcactccccgtgattccctctcccttttcccccgtttttccctctctctctctccctcggattcgtttggaatctctcccgaaatcctcgccggcgtcattgatggagccgagatcgccgcgccggtttccctctcatccggccgccctctctccctcccgacgctatataatcgttccccgtgcctccctcctccgtttccgccgctcgccgctctctctctccgtcggaatcgtgcccgcgccgtcgtcctctctctccgccgtcgccgacgagctccggttcgccgccgccgtcgctccggacttcctcccctctcggcgtcgcctccttcggcttcgccgcgtcctcgtcgaccccgtccgctcctccgtttcgcccgccgaccgccggaacatcgccgtcctcgtcgatccgaaccgcgccgccgccttcctccgctccggtcgtcgtttccgccgtcctcgtcgtcccggggtgagccgaggaccgccgcttcgcttccctcttccctcccctctctcggccgccgctccgccgcgccgttggtcgccggcggcgaccatcggggcgcgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggccggcgtcagtcgcgtgcacccggtccaccgtggacagagaggctgccgcgtgggccccactcccgtggacccggtccgcgcgccctctctctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggcgtttgggaaagcaagcaaggcaagtcacatcatccttgaacatattgaatcccagtctataaaagtattttgatttaaattattgcattatcgctttatttaaattcccgcgttatcactgttttatttagccatgcctatttatgtcacgaccggaaataacccaacgggcattccttacgtgcgtgcattaatccttgtcccaggaggcaaggtacaccaaaagttgatacaattcagagtttaacaagcggaagcgtaaataaaattattacatgggcaacgaaggcccagcacactcaaagacaacgaaaaacagcggaagactagggcgacgaccacaggcacttgacggcaggcacgagctagacaccaaagccttcatcttccaggaactccccatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgttcctagaactaaacaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccatatccgagggctcggctattcgaatagattatactctgatcagaggtgtacatctttacccacaagacacatctttctcacgtgcaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgcgttgcaacagaggcccgaagaccggtccttatacggccgaggtgctaccatcaaaaccatgcaccccgagcccagcctaaaaccattttaggggattttgaatagagggggcggtgtgaagccaattccacaataaaccaacaattccagagtatccaggtgatatgaatatttcccaaagtctatagttgtaaaaccacctaatgttacctaattaaaagcgaagcatctacctaaaattatactagggataccatgagtagagtgtccactagttgaggttttgtttgtctagggtgaacaaggtagtaataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaagctttaacactaaataactccacataacagcagaaacaaagcacaaaaatgggttctttacatcttaaggaaaaattagagacttgaacggtccaattccgagttcgaatggccaagatatggccatttgaagtttatatgctctttaaatggatatttgcgaatttcttcatttaaattttaattaaaaatcccatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcaagcggctgacggccgggcccacttggcagccgcgagggcgcgcaatgggcggcctcgccggcgcggcccacgggagcggcgcgcccgcgccccgatggtcaccgccggcgaccaccggcgc

SEQ ID NO: 81125 - DNA, 34688 bp, Oryza sativa
  unsure (1)..(34688): unsure at all n locations
aggaactccatacggtccaaatgattcttcaaaattttggcctcgcgacaggcatggtgaccaatttatccaaaagcgaagtctatgccattagatgtgacaccctcgacttataggatatctctcccccttcccggcacagatgaaacacttcccttgtacctactaggatttccactccacatcaggaaactcagaaaatcagatgttcaacctctcatcgataggttctcagctaggctcccaacatggaaaggaaagttactaaacaagactggtcggacggttctgataaagtctaccctctccgccctcccgacctatcacctcactgttttcccccttaaaaaatgggctgaaaaaaagatcgacaaaattcgtaggggcttcctctggacagggtcagaacaggcacaggggggacactgcctagttaactggaagagggtctgtagaccaaaaaaacatgggaggccttggtataacaaacctcgaactttttgggcgctctttaagactccgctggctttggcaggaatggaccgccgtcgacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacaagaaagaacagatcagtggcacaggagatacaagggaaccattggttgaaacagatgagacgaatgaataccacaacacaggttagggaattcatccttctatggcaccaaatccaacaagtggagttgcaggaaggaatagacgatgcgatagcttggagatggactccaaatggatcatattcagcaaactccgcctacaggatccagttcgttggaggcatacaagacaataggtctgatttcttctggaaggcgaaggtagaaaacaaatgcaaattctttggttggctcatgattcacagaaagatcctcacagccgacaaactccagcttcgtggatgggacaacagccacatttgtcctctgtgtggagtagaaccggaaacagcaacgcacctcctcatggaatgcgcctttgctaaacaggtatggagacagatatggctaaaggcggggctccacatgcctgtggcttccaccttcgatggagatatgctacgatggtggtcaacctgcagaagagagatggccaaagaacaaagaagaaattttgatggcctcttcatctgcacagcttggggcatttggctacagcgcaatgcaagaatcttcaatggcacttatagcacagtgatgcaagtggttgattcaattatcgctatgtgcaaagcctacgtcggagcgcatgttctagatgagtagtgcacgtactctctgttggcaactttttgtgacaagtcgacaagcacgatcgcaacacctaaacgccttgcggtgatatgaagtcgccaaccacctcgatctagccaaatggccaaatcaagatgggttttgcaaaaagaaaagctaaaccggctagcgaagccgatttagagatcaaaatcagcctctaggccgatttagatcgatatgaggataactacccgtctcgtgggcaaaacggaaggttttcaggacaaacctacaaagagatgtcgcactctcgcagcggcggcggacggtttacggcgcaaaccgacaaagatggactaaaactagggtaaaatagaaaacatagtaatagaacgattcaagtagattgtattcgggggttttacaatgaaccggccttgtcccttaaataggggttggtcttgccctctacaggcccttctccacatccaactcgggatagaaaccaaaggaaacacgaaacctgccttcccgagtaaggaaacccgtcactttccaaactttggcaattttcccctatttcgtccataggtgccaaatttgggtgtaaacacatgcccccctgcctttttggtgaacagacgtgaacctaaaagcatagaacatgttatctcagggcgataatccaattaccggccataggacttcctaagcatcttgcaaaatgctcgggaagtatttcttcaagtatttcccattaatttatccctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagtgtcaagatttacctcaactggcaaaacggcaatttcaacaatgttttattactcgactcggcttatccattagcctgagcatagtaaagagaagaactcaacaacttaatatcataagattcggcaaaacttctcacttccttggacataaaagaagctcctttaatgtttgaggaataccgaatctatgaacgatatgcttcaaaataaagtcaattacctccgcataagtaatattctcgagcggcacagcctcggcccacttagtgaagtaatccattgcaactagcacgaaccaatgccattttgatggcgaaggataaatttgaccaatgaaaaccaaagcccaacctcggaacagccatagtttaatgatagatttcaacacagcggtaggcgttaattgaacattgccgatccgttaacaagcttcactccctctatagtatttgaaacaaccatcaattattgtcggccaatgaaaccccactctcctaagcaaccaatttatcttacgggccgattgatgaattccacaaatcccttcatgaacttctctcctagcaactttagattgatcattatctaagcatttcaacaatactccatctatttttcggcgatataatatttgaacgcttgccgccgaatcttccgatcaatcttaagtgtaggatctttcaaatatctaatcaaaggaattcgccaagctatttctatctcatgggcacaaatgtccgaattcacaattaattcggccttttaatcaactgtaacgtgccccccagcctcctgtctgggatcggtcagaccggccacgcaatgccggtcggaccaccctgtctgcccggtcagaccggccatgcagagccgatcagaccgcgggtaccaccggtcagaccggccgtgcaatgccggtcagaccacccctggtctatgactttgtcaatttcgtccaaacttttgaaatcaagcatcggcctttagtatataatttttttttcacataatagccagatgcttggtatatcaaattattggaccaaaattccttctctctagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatagattccaataaactaaaaatgtaagtaatcggcttaagcatgtatgcaaaatattaacaatgccaatgttcctaaatacaataactctagaacaaatcatcacattgaccattgacattagccgaattactaataagcaaaactttcatgatgcaataaatatgaaatatatatattatatggtgatccataaaaacacatatgatttggctttaaataaatatcaaagactcatgagccaaatcatacttcaaacaaattatatgccaacctaccaattccactacctagaactagcatttgcaacatgtatgcataatatcaatttgataagcaaaaacacacatgtgctagatatcaagcaatgttctaacatggcataggcatataatataacgttgaacacaataaacccataccttgccttagcatccaacaaacggcggctcaaagatgtgatgttgtatccatcgccgttcatcttctcttggttccctcatgagcatattaatgtcttgccccccgagcaaaatcggctctcttgactgcactatttcgaaggcaagacaaacaccgcaccaacattcatagcaccatgcgaaggagacttatctctaatgaccgatgattcttctctcatcaaattggatatatcactactttggaaaatcaccgatctcttaacttttacttctttaggtctccacactcgcttaggtgtcgttcgaggctctaaattattacatgttttgttctctacatcttcggcctccttttcttttttacctatggcccgaagacgttgtaacctcctcttctgagaacgagataagccagaaggtatccacttcggctgtggttgttttctaggagctaaacaatgattcttaatattcttggtcgaagtagaagctcctatgttgctctcaattttcccgctcttctccaatgctccccggttagaccggcctctgggcccggtcagaccggctgcaagccatcagtcagaccggccaggagggtcggtcagaccggccgttgtctggcggttagacctgccagacgcctcggtcagaccgccgacgttgacagtaacggcgccggcttcagtcttctccacttgtacaatttttgccgcatctccagtaggtacatgaacatcttgagactcctccttgacagcaacgacctccggagctttagcttctttcctcacccacaccttcttcacctttgatccaccggaccgattcttttgtgggaaacggtcttgtcttgaattagatgaatgattcggtactgacctaggtgattcctcccatccttgatgaaacggcgtagagaattgaggcatccatggcatgtaatacataaaaggataaccatatagtgacattggatatggataccatggcattacaaccggaggtttatatggagttggtatggttgatggctccgatttctttgatgtttgaccaaatctcttcctacgagatgatcttagtcttttcgaatcactagtttggttatcaaatcgttgaccggctaatcctttcttgtatttagccataagcatctcaaaagtgagcttcggctttttggtcttttgggaattagatgacccatcctttgcaactttatgatcttcggccttcgcatttttgatcctattcttgggccgaagatccccaataataacacttttccctttctttttgtctacatcaataggactaacagggagaggatcactaacaattccggtcttaggcatagatgtaaccgaaatagtctcacaagtgaccgatgaatcatcaaccggtcttttctccatcaatcttgcatctttaaaataatcatgaaactcatgctccatttgtgaccatgtacaaattgaactaggagcaagcaaactataccatgtagatgcaaagtttgacaaagaaaggggaaacaacttcaacttaagcaaatcatcgctaccggccttaccacattgatcaataaagcggccgatatgctcgattgtagtcatagcattctcacctgtgaatttcgtgaagttgggcacctcaaatccttgcgggtatgggaccgaatctacatgttcaggatatggcctttgatatgtatgcatagctactttggattctatttcaccactatcccgtaagacattgtcattatcttttccaacatccacatgaccgatttgtgattcggtcttaggtgacaatgctatttcactttcgcttgtgatacaatccgaaccgtcacttagttcggctatatttttaatgatgttattctctaagctagcaacacaatctaaaccattacttggttcggctattccatcgttgtctaaactagtaacacaatccgaatcatcgcttgattcggctataatggttattgcattattatccacgctagcaagataatccgaaccaacatttggttcggctataatcgttatggcatcattgcacaaatttttaacacaatccgaatcgtcgcttggttcggctacacatgatattgcactatcatataaactagtatttaagctattatcatccactcggctttcctgagccagagcttcatgcaacacatgatcaatatcaagaaatatctggccattcaatttctctttaatagaatcaagcaatccatcatatgcaatgttggccaaatctttgtcagttattctcaaactaaaacatcggcttttaatatctctaaacctttcaatataatcagcaatagattcattatatttatgcctaaccgatgttaaatcaaacaacttaagctcagtttcattagtgtgaaaataatcatgaaatttttgttctgattgagcctaggaagaaatagaatttgccggtaaagaagtaaaccatgtaaaagcagtaccggacaaagataaagaaaataagcgcaatttaaaagtatcactattagcctcaccacattgcgctaaaaattgacctacatgctcccatgtggtcctactatcttcaccactaaacttggtaaattcgggaactctataattacgaggaaacggcacatcatcataatagtcaggatacggcttttggtaaacattagcacgattcctagtttcagtcccgaatctattcctaataatctcactaattatatcctccatattattaggcccatgttgatttggcggtggattaggtggcctaataggttgtgtttgtggcgcaatatgattatattggccttgtctagtatcgggaggataccccctagcaacatcattataaacattaggaacatgtgggggaacttgaggactacttgtagcagtagatacaggaggatcaaacgttttaaagtgatacaaataactagcattagtcatcggatctataccctgtattggaacaattgcgttggtctgaccggcccaaggcccggtctgaccggcatcatgatgtgcggtcggaccggctggccggtctgaccgccggggtaatacccggtctgaccggccggctggccggtctgaccgacggctatgttacggtctgaccggtcgtcaggctcggtcggaccgaccatgaacgccgtcccgtcagtttaactacccattggatctataggagattgatcaacagtggtataggctttatcctttaatgtgtaatcatccataaaagagcctagcctactccttaaaaatccatcaaccttatccttaaacattacatctaatctatctttaaaattaaccatagataaatctattgtagatgcaatttgttgttggatagattgtgatacctcgtcattacttaccatgtcgggagcgagcttgggacgtggcccgggcttgatgatcacgccttgacgagtcctagtagtagctctcatcaatgcctcccgtgtgagctcgttgatgtactcctccatagttttacgatcttctccttcgaagtcatccaatgtgaccagcatcacattagatggctccgcctccgtcttggatgatggcttcgtcatggcgaagtcgaagttgagttgacgatgaacggatctcctccccagcggagtcgccaaaaatcgtgttggcaactttttgtgacaagtcgacaagcacgatcgcaacacctaaacgccttgcggtgatatgaagtcgccaaccacctcgatctagccaaagggccaaatcaagatgggttttgtaaaaagaaaagctaaaccggctagcgaagccgatttagagatcaaaatcagcctctaggccgatttagatcgatatgaggataactacccgtctcgtgggcaaaacggaaggttttcatgacaaacctacaaagaggtgtcgcactctcgcagcggcggcggacggtttatggcgcaaaccgacaaagatggactaaaactagggtaaaatagaaaacatagtaaaagaacaattcaagtagattgtattcgggggttttacaatgaaccggccttctcccttgaataggggttggtcttaccctctacaggcccttctccacatccaactcgggatagaaaccaaaggaaacacgaacctgccttcccgagtaagaaaacacgtcactttccaaactttggcaattttcccctatttcgtccataggtgccaaatttgggtataaacactctccttctagttgcttctcattttcttaaaattttaccaccttatctcccaggttgccttgatagaagaatgcttgggatcctttgtaatctgggtttgtaaaaaacctgtattgctttttctctactctccttaatgaaattggcagagctcctgccgttgacccctcaaaaaatatatatatatatatatatatatatagttgaagcagagtatgcacaaccaaggcaaacaattgaacactaccattgctattgctccattgtcaaccaatttgtccagaacatttcacagccagacacacagaaggcaaaccagtttgatagtatatctttgcatgcttttgctcaccttttgttttggaaccagaccttgatctgcttggggtcgatgctggcgaggatgggtcactcgcggagcagctgctggcggcaggagaagctaggcttagggcactcagtgtacacccgctctagcgcctccacctgctccggcatgtaccggggtccatcctggctttgtcatacccgtcgctgtcgctgcccgctccgcatcgggcatcgcgagtcaagcccaagtcaaatagaaatcgaagacaaattttgacggcgtaaaaaaaagttcggcaaaaacatgttaaatttttataataactagataaaatacccgtgcgatgcaacgggtgaaaaaaattctaatgacaatatacgtttttcatacatagccatgtcaatgacaatatttgtatggatcgtttgtagctaagacaattagaaaattggaacatcttcgatgtaatggtccaacctcgacgatgacaacatacatcatcaatgcttgctttacctaaaataattggattattcacgtgacaacatacatataatctaacatactctttcgatctcattattgtaaccaataataggatcaatcaaatccaacgttctctcgcatggtcaagtctacacaaaatagagtcactgtgcactcttctctaaataacaattaaaaatatgtttatcttttaaatataatttctatatgatgtgttatcaggaatattacctatatctgataatagatgatgaaaaaaaatcgagcaatccgacccaagcgtctatcaatttagcgttttttctgaccgtttttttagagcagcttgtttttcataaatggtgtttttttcatgagaggttttttcaaacaatttttttagaaatggcatgcttgctttttctaatagatttttcctcgcatgtatttttttattttttagggatgacggaaacctttttagcgcttttttcagacatttttttctcacgcgtttttttgcttttttttctcacgcttttttaaccgtttttattttctcgcgtattttttttcttgttagttgtacgatgaaaacttctttttttagttgtacgatgaaaacttctttttttagttgtatgatgaaaacttctcttttaagtagttagattacattagattagattagagctagaggagagatatatatagggaccacagaaactaatagaagcagagttttttttgccgcattttttttcctacctttgtactttttttctcattcgtttttttatttttcactaaccattttttgccattttcttagggaatcagatagataaaagatgtgattttttaagtagggacggacaaaggaaatgttttgaattttttaaatagtaaagatagagaagtatgcaaaacttatatacgtacgtatgaaaaagaaaaaaatatacagtatataaagtttgtatacgtgtatataaagtttgtatacatgcatagtattaagaaataaaaaaccaaaaaaagggaaagaaaaaaaaagaaaagaaacgaagaaaaaagaaaaacggaaaaaccatacgtacgaaataggattatataggaatatgattttttttccaatttttagatagataaaagatgtgatttttcaagtagggacggacaaaggaaatgttttgaattttttaaatagtagagatagagaagtatgcaaaacttatatacgtacgtataaaaaagaaaaaatatactgtatataaagtttgtatacgtgtatataaagtttaagaaataaaaaaccaaaaaaaagggaaagaaaaaaaaagaaaagaaacgaagaaaaaagaaaaacggaaaaaccatacgtacgaaataggattatataggaataggattttttttccaatttttaagagaatcggatctactgtttttttcgccgctttttttggcatatgaatcggaccctttttttttaaccttgcataggaatcggacattttttttttggttttccccatttttaaggggaataggttttcccctatttttttctccaactttttttttcgtttttatgggaatcggactttttttttggttttttcgctattttttatttagacggacgaaggacttttttttgttttttctctatttttctccgacttttttttgttttccccgttttttaagggaatcggacttctttctctttttattttgttttttacgctattttttattattattaaaacggacgaatgaaacatatctatatatatataatatatacctaattaaaaaatagataaagcttccggttaattttttcgtccgtcattaaagggtgggcccacgcgattttcgccagtaatgcgaatcgcgacgcgtgacggcgattttgacgctccacaaataaaaagagaaacggaaaaaaaaagagagaaagctagcaagcagcccaactaaagcagcagcaggccggcccaacaaaaagcaaacgcagcctagcagtcagcccacatagcaaagcagcagcccagtacagtactgtgcgatactgtagcaaacgtgaataagttcactttagctcccttagtttatcaccgaatatgaaatccatccctaaataaaaataccaggtaacctcatcctttaacttacaataccatgtcaatttcgatccctcagcagtatcgtggccagttttaactaacatggcaagtgggccccacacgggtcatatgtcagtgcacaaataataccacattttgcctagcttgggcagcactagcttaaataatagaaggcttgcccgaggctactacaccaaaaaaaaaaaggttggatccacgtctaccaagaatcatataaaaataacgagcaattttattaatttaaaaataaaaaaccacatgtatttttttaaaaaaaacatgtgatcaccaacaaaatgaattatttacgacaaaataaattatttttagaaaatagaaaacaatcacatgtctttttttaaaaaaaaatgtaatcaccaacagaatgaatcgtgtttacatccaattttttttctattcatcgtatgatttccgtctaattttttgagtgaaaatgattatgcgattggagtgcaatgaggttgatctgatagatagcgagaaacatttcttatattattgctactctttacaatatgtaaaaaaaaatgtgtttatcaatatcaagtaccaaaaaataaccatgtattgcaaccaactcataataatacatgacaaaagtaaatactttttgggtttcaaactttatagtctataatacataattttattttaaagtggtattaatacttttcctataatcattcatgtcaatggatttagatcaacaaataattatgtcatgttagtatcttacttgcaccggaaagattcgatttgctcctacacacccattactgttgtttttgggactatctagagaactgtcgaaagttttttaaggagaaaactttcaaatctaactataatataatttcaatataatttcactatagctataatgtaactcatatataagtattaaaataatatatatatataatatagttacagtgcagttacatagtagttacaatgtagttataactaaaatgtaactcacttaatttttccaaaacatgcagcagatcaagtggctagcacgcatggcttccatgatggggaccctgtgttcgagcccctgcaagcacacgtgtacagattttttttttccaaatctcgcgcggatcgcacggctagaaaatcatctcgcgcagatcgtacggccagaaaatcgaatcgcacagctagaaaatcatctcgcgccgatncgtaccgcagaaaatacaaagtttttagccctccaaactgtcgacagctagccagcaaaaccgttgtttttttttatgtttcacccaatgcaacgcatgggcattttgctagttattatatacatgctaactgtgtattttatagcatttaaccctttattttacccgtagcgaagcacgggcattttgctagtagtagatagaagtagatagagatagaaaagagatagagataaaaaaaactagagataagatgttttgaagaggtatatcaatttgaataagccctacgctccattgattctgggatgtttaacttttatttgacgtcctaggtcaatcgggagtctccttttttttttttttgtaatgtaatttaacgctgtagttcaatcacgaccgttgctttcatctttgccctcctcctcgcgtgccctcgccgactcgccgtcgtatcgtatggttccaccgtcaccctcggccgcccgctcgggcaccgctctccgccaccttgcttgtgggcccgagaacgccggcaagtctaccttctcctagctttgctccatcagtgagcttgttcgctgactagtagtagtggttgcgttctggtgcgtactgtggcaaccggcgaggaggcgaaggggcgaaggataaaaaggagaagatgctcctggtgctctggtgcgggtttctgttctttgttgttgttcatcaatcatcattcaagttgtcaacttccccaggccccaaatccttttgggatgaacatgttcttgatttgtgacaacagttcattttgggacacttggatgactttgactccaactgtaattttcactagtgtgaagtcacaatcatcgcagccatctgttgtctgatttgttcaatcgtttgggcatgatgttaatcgaccgtgatgaaaattatgtaagaacaatgacgctttgacattgggctaattaatgttttttttttgccaggtcggccgaaggaatggcgaccaaatttcattaagatggggaaggggctaattaatgtttatggttaacatatctgcaggttgcacaccgtgcagtgtaggctccaggtgtgtgcgtgagcatgtcagttggcaatctgattggatgcaacttcaaacaaccattcatgattagtacagagttcactagttcagtgcaatttgcagctttgaatcagctgcaattttctgaggaagatgcaattctgctgcttcacctgattttaagagaaaggcgtctgatgttttgaggaaagagcagcttttgacagaatgcttgactctatctggctatctgtagcatactggcatgcttgtttttatagtgtttgatctgcaagctattgcaagcttgcagatcataaacttgcaagctgtgatactcctgtgggatgtttcggagatactcctgcactgatgtttcatagatgtacctcagtttcagagatgttccagtttcaaaaattcgcacctactccatatccacgccaacttcctgatgaccgctttacgttgatgtgaattgacagaattgtctataatgtgaatgtttgcaatttcttgtaaagttaacagcaaaactcttgtaaagttaacaaaataaaattaataaaattatggtgcaataaaggaggttgatttcttccaggtttcttgtaaactgcgagtattcatccactgcatatgcagagcactgaattcaagttcagacactcctgtgctaattcaatcatattgcaagaatggtgcaattaaaaactgcaaatcaaccattcaattattctaaatataataaaatcacttataaatatgctccaaatgagttaacatcactttacacattgaaatctatagtccaaatcaactttaaagatttgggccagtcatctctttacagattttgaactggaaaagagaaatcagcacaactaaccactaaccactatggtctgggaaactattttaaactctcgaggggacatccccttgttgtttgcatgtcacccaaataattatgaaaaaatttaacaagatagattaatatgtgataaatcactccacaaacatgcaaaggtcaaatttaacttctacaagttaaaaaaaacgagagtttagaatctactcccactacggtcctcttcttggtagcattatctggctagagtattccatgtagactgcctccacctgttcagagttactcccaattaaaaggtacctcttcatgatttaaacaaagaaaagaaggacatgccaacctgagagagatatggctcccttctgatattgcaattaggtggtgtccatgatgacttgcgaaaggaagacatgcttacctgaaaaaaataacatgtgctaaatctggttgcatccaggcacatgagcgtacattattctactcctgattctctttgcaaagtaaaaaaaaaatcccgcctttcaaatatatatatatataaaatctttgcacaaggtaaagtgtggagtaactatgcaaccttccttttcaggctactggagaaagaaccagtacataactaatgtccaaactgcaaagaaaataatcatgtgcagcaaatctactctagctcattacctatgcagtgcctgaaatcttgagtaacaggatttcggcaatactgaatcagagcagagaaaaaactgacactatacacaactacacaagccatgagttcatcatgatgtagagtaagccctagtagtatactgaatcggagcttgctgtcttgcagacccaatgatcataaaacactcaattatcagaaaagataatgcaacttgtatgcctctattatttacataggaaatgaagctgggaaagtagaatatttttcatagcagagacgatggacttcagacatgatgcagacacgtgagtgtttccagacaggtgaacaggtgttatcttctaaaatgcccagatagtactccacattgggcaaactgcacagtttaatttcgtggaaattgaacaaactgcacaatatttatttactcctgactttgattcagaaacctgtagatgaacttgcaatgccttgtggaacctcttgattcacatcgacctgcattcttcagaagcacatggacctcttgattctctttgcaaattgctaggcaccaatacacaacaatttacagtatttgcaaattgcccatgcatgcaagaatgaaacagcaacaaaaagaaacggattcctagatatactcccctcagctgccatcttggtctattgcagatagcaattgcaaagtggccatcagacagtcaggtttgcgtttataggctggataaacaagggtgccgaaatgcatctaaaacagcaaagaaccaagatcatgctgttgtcgcagccacagccgcccagcgccccttgttccattgcctagtactgcctagtgaacaactctaattaatagacaatgttttgatgattagccatagtactgcctagtggcaacatgtttagtgaacaattctaattaattagctagatacgcctagtggcaatagttctagtgaataactctctaattaacgggatacagacagacatgttctctaattaactggaatacagatatgcagcattagacacttcagtagcgctagccatctcgacatgaagcgatacacagtagcgcagccaccagccatctctcagtcttcgtcttcgtctttcatctcatcttcgccttccccttcccactgcccctccccttttcactcccactcgccctgccccttcccctacccctgccgctgccaatgcccttgcccctcttcctctttctctcttcctcttcctcatcactttcatcatagtcactgtcgctgtcgttatcgtcattctcctcgtcgtcatcatcatcaccatcaccatcaccatcaccatcaccatcaccatcaccatcacctggcagctgaaaagaagaaaacaaacagaactaggactaaccgactaagtcactaagcaattgaaaagagaaaaggagaagagttaaaaggaaataaaattgaacttacatttgcaagtgcagtatctacaaaagttttcacatcttgataactgattgcgtatccggctttacaattcttttgtataccgtgataaaccgcaacacaacgtgctgccccattcagaattgcacttcccgatgttccggctgcacattgaaactcaggcacttcaatcagattcatcttatatcctttcacattcaagctagtaagtgtgtcgtatcttctgttagtatgactaatgtgcccccaaactgaagtttgtgatcgcaatgctggccacccttgtaaaaagacattctcagactcaactggtggtgattttcctagcttgatacgtgtatggtcctcgggacaaatgataaaattatccgcatcttgatatgagtagtagatatcctcacggttcaacttaagaagcatcagatcaacttgagtgttaaccgcaactacttttgcatcgcagaagtatctgttcagatgctcactcttatcatccactccttggagagaaagaaggtgcctctcctgatggatgcacaagactttgaaaataaatgatttattaagatcttttggggtaaggtcatggttctttgcatcatagtaatcatccaaagcatgggctgtggttagaagataaagtatatttcccctctgctcaataacaaacccagtgcagagctcagtcggaatagtagtttcctctatttcggctctatccagattcttattaatggggagcctttttaagattctacagaagtgacggaaagcagacttgttatcttcctcttgatgcctcacattcacctcgatgttgaaaacagagtgaatagtcttagaaacaagatgatgctttgctggatgagtgagaagatgcggggcagggaagacgttgtcgttgtttaaatcagccatctaaagaaggataggatagtgagatggattttcagaaaaatcaacaaaaactagaagacaagaatgaatgagaacacataaaaagcttaaagtaaatgaaattgcaaaccaaaattcaaaacaaacaaacaaaccaaccaatagaaatcgaatagaaaggacaagatgtgaactcgaaaaaaaagggaaagaaaagaaaggatgtgaacccgttagcaacggcagcacgaaccgaggccaccccagcgttggccgccgcgtatccatgccaatcaggcggcatggatccagggcagccatcgcgtgttgaagctgtcccggcatcgccatgcgtccggccaaccgccggcggcaacgatgggtaataaggcaggagctcaggggagcaggaagaaagaaagaaagaaagagagaaagaaagaggcggagtgaacggcgtgcgtgactcgtgaggaagaagagaagagaagtgtctgtccacgcggcaggggttgagacgtggcggatggctttgtgcttacgtggaggtaactttctttttcttttgtgatgagatggccatcggttttgatggtgggtgggctcgtcaaatgggcttctatgcagtccctattctaatacgaaaagggcccatctaaatggtttactttgaagcccaattcgaagaattcacaggcaggccggtttacattctactaccccagttttggacctctatatcgatccattctcattaggttagggtttttacgccattatcggttctggatctagatgatgtaaaaaagaatccatgcccgaatccgatggaaggggagctagctgttcaagagaggaaggactagacaggagaaaggcgcgcaacttaagttaattaaaatgaacatacactagtaagtacaaaataaaaaaagaagccagatctatttttttgacatctatatatcgtacaaaataaaaaagaagccagatctatttttttgacatctatatatccagatctaggagacaaaagtaatgtatacttgagattagttggtggacatgcatgcatgagatggaatggattacagtagtagaaaagtagcagcagctagctagccaagcagggaaagaaaaccaaatcggcatcacacaggtacagcagagagaacgaaatcaaaatgccaaaagacaactaacatatatataacatatatatagggagtggattctaatccctcgaggggatatcctctcgtataacttttttcttccaaattcgatgcaaatagttgtaaaaaaatctgaaaaaaattgacaatgtagattataatgatacctactagtccaccaaaattcatgttcaaattcgatctacacatcgagaaacaaaaaagaaaaatttagatataaacagtacgctactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatacgattgttctacgagggaagaagagggacttaccgttgcaacttgtgcggcacagatcgacgaactgcgtgtgtgcgcttgcgctctccagtccacaacctcgatcgccggcaaagcaaactgtagatcgaggcagatcgatcgacggactgcgtgtgtgcgcttgcgctatctccagtccacaacctcgccggaaaagcaaactgtagatcgcgatgaatggacaagcaaaactttttcaagatgtgttcttggcttcttgcaagaatatatatatatatagtagatctaccaactgatgaaagaaatgatagatgatgcatgcataccgtctgttttgcttgcaacctctcacgagcggagagaagacccggacatctctgcaacctctcacccgcggccagctcctccagtagtgatgagatgagacatgagagagctcgccatggaccggaggtggagaacactggttgttgggggactcaagaacacaggttgctacttgctagggagcattcagtccggccatcgctagctgatgttaatgccaaggagctgcctctagccatgcagactagacttacctgaagatggaaactgcaccactgcccaaaggctgtagagaaaaaagatatggaccaaagaatactaagaatagtactgtgcagaactgcagcagttgccttcaatacagctctccctgcaacacgacatatacgcagcagccttcaactctctccccacaacttcggcgaggataaccgggtatgtaaatatggtgtaaaccttgactctacattcaaaaaacaaaattaattcaaacatgtggacgagatgatattacacaactatatataaacatgcattatcttgtccaaactcggcttcttttgtgagataaaaaataaagaaatttaaaccaagctgatacgatccatctagtgaaacaaagcttccgtttctcatgtctgcgtcattcccaccccagggacgactcgaaaggcaaaaatatgccaccgttgcctccctccctcttcctcctcttcacctcgtccctgcccaagcggctcgtcaacaaagccggacaaccacaaggatagtagcggcggacgctttctccccatggaaacctcaacggctggggtaccatggcccagatctgcgtctcctccactggagttagcgaggagaaccgtggaggaggcggtggcggagtggaagagggcatggaggcggtgcacagtggagtgataggcgacggggtagatggcacggcgacagtgcgtggaggaatggcaggctgcgcgtgggggaggggcctgtgtcgtcgggtttggcatcaccctagccagatctagtgccccgccccccccccctcctctcgtctgcggaggagtggcgggtggcgggggaggagcctacgcggtagtggcgaatctataggcaaccggatctaggtcccgctccggatttcgctaggagcggcgggatgtcgccacggccggtgactgcgggtgcggcgacgacaaggagggcagcgtggctggcaatggtggagctttgaagtggtggcgacgggtgcaagagtgggtgctgtaggcaaaagtctagcttggagggtttcctgagccgacaacaacgacttcttcgggcgtcgtgactctccttggggcgttatcgagcggccacacttcccctctctagcaggactctccgagtgaaaacctagtccggtaggacgggcaacgatggcatctatgacgtcatgacctccctgtagccattgcctagaaggtctttgttcctcgccgttgtcatcttctctcggtttggtcgtcaacggttatagattgccctcatcaggttggagtgagggacgagtggatctccttctctctcgccctctccctctcctcaacccctctacatgaggataatccagagctcatcgatgatcttctgtgtggagtcgatgttcggtgggttgtttgcgactaccttataggtttagcggtgattggcttggtgctagcttgttctcctaggatgtgcaaagagctaccagcttgcagtggccgtgtgtttgttttttttcggctacaattaattttctaagattgtaatcttataatattttcttgcttcatcaatatgaaaccttgcaactgtcttggtcatttgaagaaacaaatttcaaaccaaaaaattgtcctaatgatttttttttcaaaatttgttgcttttatatctcagaaatgaggtcgagtttgtacgagatttacatggttatgtaactatcatcttatccatatgtgtgagtttttgttgaatttagataactttttgttagagtttacaatagttttcacctaagttaaggttccatcgtatatttacccaagatcactagctgaccagccccacctataataatgaaatgaaaagaaatgtagccagtcactagctgaactttttgttaaaattgtcaattaaacaatataaggggagtagatgactgtgtgtatcgacagtgtataaggggagtattactttcaagtttgaactggctaggcgttgatagctaaatttggtacaggttttgttcggttattagtcaaacaattagccgaatgaatttttttggagtaaagttaccgtcgtttcgagttttttttcctttcctttctttgtttttcttccttccttggtataggccggtctggctgagtgcgtcgtgtatcaaaactctattcttctaatttttttttagagaagggtattttctacccagcctctatgtccaaccagatatatacggccattgagatagagaacttagccccgcaaacaacccaatctgaattttgctccataggagatttgaactcaggaccttagggagaagggtattttctacccagcctctatgtccaaccagatatatacggccattgagatagagaacttagccccgcaaacaacccaatctgaattttgctccataggagatttgaactcaggaccttagggtactacttaggtcactgtaaccactaggctacatgcccttttgtctattcttctaatatattgacgtgtaatcattttgcgcgttcgcgaaaaaaaatgaaattttttggcttattatcgatttggttgttagcagatagttgttttggtgttaattaaatagatgcgatgacactatatatatagtcctaactgcccgaactaatcgatattgactacttattgttactgaggacatgctattatactgttacatgggatgcatgtaaacggtctgacaacagtctcgcccatttccataacgatatatctttcgtatacagaatctataacgtagagctggaaaaaaattagtactgaaattaaatatcagaaaattagaaatagaactatacggatgaaaatgtgtcggtatcaacccggaaccggtaactgctgtcgaaaacatgaaactgcaaaatcatcacatatttagttcaccataactatataatatgactgtaaattaattaaaacttacaccacataataaattacaacctatatctctgttttagccgtgtaattaattacattaggaatttggttaaaaagttgattgacttttacactttgggtgaaacagatgcatgaccatataggtattagaaatacggcaattacaatattgtagaaatggtaatttccgcagaaacacagtaattatagtattgtaaaaatggtaatttccatgcatagaaatatggttgaatatgaaaacggttggtaaaacaacaaatcatttccatttttttaccatttttgttttttttgtcggtttaccatttctatttctgtatgggtcggtcggtagaaaaagaaaataagcgcgtccataaattcgggatattctaggtgcggtcaacgggtcaaggttgaagagaaaacaagagtatatggggtagccaagagccaaaagctgttgagagtgcatctgtgcatggaaaggcatcgaagagaagtatggccgatatatcgatcgatcaggacgatgtactgcgaacgggacgacatgcacgctatatatatatttttttcttccacgtatttatacttatttatgctgcgtcattacaacaataatcgaaaatattacgggattggagaagatatccctaaacacaatctatctacacgtagggtacttgggtgtgtttgtcgtgttttcgatcttttgctgtcattttttccttctcttcgtttttgttcgtctcggtctaggcggctatacccttttttttaagaaaaaataacaaaattgttatgtacatatttacaagagaaaattcacacaaaatttagtcgttttaagaaaattcaaacggtcaacttgtaggcaattaacagtatgggtatggagaggatcaaaataaaaactcagtatcatatagaggacgaggaaaaattcatagacacgaaagagattgagtgaaaattcatgagtaagttagaaattttatctatttaccataatttataactctctccggatttataatacttaactttaaccactattttctataataataataataatatatgaaaatatcaactaatatatgattttattgaagtactttttagactaatctatccatatggtctccatttctaaaacaggtattttagaaattatttatagtcaaagattttaaaatgtgacatcaggcctatgcaaaacaacgagtattatcaacatacagagagagctatgttatggaagacaaattacgtttgtcagaccaaaaattaccgttcatcgattaattggaattatgtagaaatttgacgttcgcaaatatgtgtatacactttataatattatgcacttatttgaatatgtaaatgtgtataactatataaattgaatatattcacgttgttttttaattgaacaggaataacttaacattaacttaaaatatatactccctccatactcgtattagaagtcgtttagaataatgtttaagtcaaaccttggaaatataaatcatgaataactctcaagttgttgagttagaaaatgtaaaaattatatgaatagatttgtcttgaaaactactttcgtaaaagtatacatatatcacttttcaataaatatttttatagaaacaagaagtcaaagttatgttttggtgaccgtgttactgttcaaaacgacttcctttacgagtacggagggagtagcttccaacgtcgcatttatacaccaaacattgacatgtttggtcatattgaataagtaaaactaaagagtatgttaaaaataaaacgctaaacaaagtcctaaaagactactttaggtcatcatcaagtacaacatacgggtgattattcggacgattaaacggagaatatggtcgattaatcactaaattaaaacagagttttgacgttcatgaataacaaatgtggatcgtatcacattaaccgaatggatttgctgtcgttacagtatatatatacggcttttttccactacactggtagggagtatactttagcacatgccatctttttctttttactaataatgtttacaaattgaaaggtttgaaagtaaaatataatatttggtgtcattatgatgaccctgctcttttccgattctggactttggatttttttttctctttacaagatgtcaaacttttagtgttgcatccctgtaaaatttttataggaacacttttctaaacaactacaattaatttatttatttatatttggggcctgttcactttagtgccattttcaaccttaccaaattttggtaaagttgcccaaaaagtggctatatttagtttgctgccaaattttggtacctatataagaaatcctgtcaaaattttgacaagtcaccaaaattttagcatagttaccaaaattttggtaaggtttttttttttcaacaaagtgaacagcccttggattctctctttgggctggttggggcgccagccccacctccataatcccctgcctcttgttagctaccaatgactaaacatgattagcaaaagctagttgtatggcaaggatacagagcgctagctgtctcactgcttcatgctagtgcccagagttgcaaataagaaaaataagtacaccatatacctcgatttttcacaaattttgttatatgtcaagtaatatgtttttttcattacatgcgtataggtctcttaggaacaatatcgagttgacaaaagctagttgttttagtcatctgatatttttaccacctcaattcatattctggattcgccactgtttatatccataaatagcaatcacaaaaaatagtttggccatcaatcgtcgtactatctcaaacggagcgaaaaatggagggcttggaaaaaaccgaaacatatttccatggcctgagcaaggtgcttgctgtctgtgcccggacgggaagctctccggaattctagcatccaaacattagcccttggcccgcaaagatatcaccggggcccagcattgtgcagacagcaaagatgcaaaagctgctccctacaagacgacacactctctgcaagactggacacacacactctctctcactctctctccctctcctttgcaatagtctttgttctcatctctcgtgttgctgcgactacacttttgcaaatctctcccgtgtctgtagacccctctcgcgtaaccagattatttctttatcaaacccaaaattcgagtctcacgtcaataaatttaatttagaccaaacccaaaatgtctttgtgtggagtatgaaatggagagagtaacactaagtacattataccgataaccattggtgtatatattagcaaaatccagcaaaattgaggtgacactagggaaaaattccccaagaaaatatccaaaagacaaaggtaattaagtcgagcaagcacttattgagatcacatgtttcttctgcagtgaccaaatactcaattcttataaattcagtactcctattttctatcctaactacaaattccaagctcatcaaagcagggctcagagtttggctctacaagtcatttttcagtttctcaagttacataagggcatccttaatattgagccacacaataaccataagataaaacccacatatcttttgcttaattatagtcaatgttacaatggtttaagttcttctgtttaccttctggctagctctaagcttaaggttagccataacaatattctcttctaaacacacatttctatacacaaagttgtactaatatttattgcttataaacacacctttacatgcacattggagatgccctagcattcactaaattatcttccccaggtaagagcaggtacaataagtctagtcagcaggctccaaaatattccatgtcagcatattcttaggtggaaggagaataactgaagagagagattgaagtgggcgactatttaagcgcccggcgatagcacgtgtcgcacgataaaaaatacattttgtgggtcccgcaaccaccctcatcggtatagatggccaaaaggctcgaggcccgacggcccggcccatggcacgatattttggctcggcccaagcacggcatggcccgacggaggtcgggcccgtgccggcccgggccgaccactgggccgtgcctgggcccctccaccggcacgttggctcggcacggcccggccgggccggcccggcacgatgggccggcacgatgggccggcagctaggcccgatacacagaaaaaataggggagtaaaaatagacatattatatgccatgaacgaaagaatagggatctaaaatagacttttttttatctatacatatgtcagccgaagaggagggacagacaatagacttattttagctatacatatgtcagcccaaagaggagggacggaaaatagacttattttagctatacatatgaaatagcccaaagaggaggaacaaaaatagacttaatttaaaaaggcccgatgggccacctatgccttcgggccggcacggcacggcccgacagctggtgggccgtgcctgggcaggaggtgcagcccatgggccggcacggcccggcacgaagtgcctatcaggccgtgccggcccgatgactgctgggccgtgcccagccgtgcctgggccgggccgtgccgggcaggccctttggctatctatactcatcggatctcatgtctcatacttgtgttcccacctatgttctgcttttcgccttttccttctccgctccggcgtgcgccgatgtgcttggttcctcgccggaatgttggccagcgtcacgtcactacaccggcaatgattcaccccaggagagttcgagagctccaccagctgatttcgagctcgcgctgatcgacctcatgcacgcgaaccgacgcccttgccgctgggtcgatcttctctcggcacgaatcaagcttctcaaacctcaaaatcgagttcttgctgctggggtcgacgccctcccttccgaactgaagcgaatcgatgtatggatggagctccttaatctgtgactcgacataacccaccgctcggtttgctctggtatgaatcagccattgcctagctgcaaaacccatctttcttctttgctattctcttgtttttttttcttttctctcatttttgcttccgtgtgaatggagatggataaaaggataaaccaccagtcattttcttttagttgctgtttctggtgttgatttcaatctaaagctgtgcgggagatgagctaggaaagcaaaaaccaaactctttctttttcttcatcggtagactactcacgctcatgacagcacaaatggctacaaagatggagtacattcttgatcgtactgtgtatccaaaattaattgtttaatagcttctatgtagttagcacaatagccaatctattgtattagttagctttacactaactgtaaaatgacgtggcatttggtaccgtcagcggtgggctatactattgaccttgctctaactagtcttgctgtacatcttcaagccatcctccagcggacaaccttaaattcaacacatttgtcgatgcttaaggggtaaaatctagagattaaaacaagcaaagtaggacaattgtacagtggtttagagaagtatacctttcctgaatcgacagaaaactttaagggtaaggtaattgtctcctcacatggaccttcaatgtcatgtacttccaactacacaaggaagacagttctgctgattattttttaccaatttttttcaaaaaaaaaagtggcatttttgttattgtgtaataccataccttgagaaccatcgactttttcatcccctgcaggtatctccaaccaagagaaaggagataaccttcgatctgttccagaattttaaaaatagaaatcacaacacatttgtattattcttgacaaatattgatttatattaaactattacttgagaccagaattcatttcacctcaggcaaactagtcccgcactcgttctcaaaaaagatcacgtcaccccgtctaacaccgagatgctcaagagcagaatcatcagctatgcgtttaacaataaagccaccattgatgttatgtttcacagagagctcctcccggagtgacacaccagctagttccacacttcttaaatccacgtcaaacacagggcgggcaacacagctacagataagatggattcagtcaattagtagacaatgagcatacagatatgatggatttagtctatagtagaaaatgagcgctacagataagatggacttagtctattaggagaaaatgagcgcgcatgttggcgcaccaaccacttttgtaggccatgtttattatttagcaaattgaattttaaaacttaattttaagttgattttaggtgttttttcgtagttttttcagcattggcttttaaaatcgctaataacatagtagatataaaagatttatccataaacattcaattaataagaatatatcgtgattcagtgggtttacgtgccacatagaaattgctcgattttgattcaatctgtagtatattttaatactgatggaaaaagagtatatacctgaattgcttccacatctcaaagaaggtgcaaataattgagattgaaatgataattgcaccagggccggctctgtataccatagcaatggtactaccacaactgtcaactacaggccctccaacaccaccctgcattaattaaaaaataaataaataccactaagtagaaggtaaaacaaatagcaagtgtgaagaaaaggtaaatgtatcagtacctcaggaacatcacaatccacaaacatgtaatggtttctccacatgaaagaaccatccgaccacgtgattgctccacgcctcgccaccagggacatattttcatcccgagacaaggcaagaattttctggccatactttggggcggacccaaaagcagggacctgcaatggtaggtcagacgtgatctccaagatggagagattgtagtggcgattcatgaatatcaaccgtccctgcacaatagacttatctgcaagatgaacctgcagctgaaagatagagagagaaggcaatgcgagaaaaagaaaggttaatggaagatagagagagaaggcaatgcgagaaaaagaaaggttaatggttactcatcttaagcacaagagacggaactcatgctaaggatatacaagaaaaggccatcaatttgacaatgataacgcttgagaattgaaatcagagggcacattaaaattcacacaaagcaaatgcacagcagcccagctacggttagcaatcacttgaccatactatacttaacaaaaatggtaatggaactcggatgatagaaacatggggattgcctaatggaaatcggtgttctacacttgcaccaagaaattaaagaaattggcaggcatgaaaagtcatttttagcaattgggttagcccctacttaataagaacagttatggaactcggatgatggtaacatggggattagctaagacatgcacctcgggttggggctcatgcggcttctttttgaagtaagtggagagcgtgacgatcatagcacgcttggtggctccatcccaactgacgacgaatccggtgcgcggagagatcaattttccctctgaaaaacattcagttgattagcaggtagctacatagctaggagccgataaatacatattttgtattgggctactaaatacactaaacaacacatatttccatttgttgttggactacacatgtctatctcggtagctttcttttatatcaccggcttttcccttaacatctgcagctagtttagcacaaaatccacggtaattcccatgtggagatgcagcatgattttctcatgtaatgctagatagggaatgcgtaaaacaacgcaattaaccacacgtgacatgctagcagcctagcacatggctcacttagtagctaagttagcagtaaatacagtagattcaggcagtaaaatctgaatatgcctccaaacttgtactaagatgttgtccataggttaccatatttttgggacggatggagtaaattaccagaaggtggggatgaaacgcggacaattgagcgagacatgcccaacaccatgttcttgtcggagggggtaggcaaggcggccgcggtggagggatcatctttcttatcgcgccagagagttagcttctgaagtcgatcaactgaagaagaagcagaaatggggagaaattaacatggttaataataggtatacaagaaattaaaacaagaagaagaaattaacagtggtggggagaggatcgatgacgacggatcgagagctaaaaaccttcgagccggacgatgcgggagctttttctgacgcggggtgtcgtcggcgggtggatcggcgggagtggccgggacgccaaggtgccatgcccctccctgtgcatcacacccgtcgtcgccgtcgtcgaagtcgtcgtcgtcgccgccggcgactcctcctcgatccttctcttcttcttgctcgaagacactcccgccgactcctccaacaccttcgctctggagcgagtcagcctcccggacgacgatctgggactgtcgtcgtgctcggcgagatcggaatccggcttcgatttggaccgagtcgacctcgccgccggcgacgatttgggaccgccgctcgaggccgccaccgatttcctccgtttgggggacatggccgccttcccgccacaccaatcgccgccgctagggttttctttagatcctcataccgctcgagtcggattccttttcttttcttttgcctgttactgtaggagtatttattagtggaataagttcactttaggtccctcagtttgtcaccaagttcgaaattcatccctgcaccgcaaaaccagatacaacgcacccctcagcttacaaaaccaatgaaaaggaggtccctcgtcagtattgtcttccggttttggttctttgtcttacgtggtattgatgtggcgcttatgtgacaattggatcgaaaaaataataaaactactagggcccacaaatcgttgtcaaccaccgtcgcacccgccacagctaccacgctcgtcggcgaccgctcgatctcctcttccggccacctctgccgttgctgctccctcctcctcccgccatcgcttcgcccacggtccgccggcatgctccggctgttgcgcgctccgctctgccggcctgctccctctgcccccgcctccatgcccagctctgcccactttgagggatataataggttggaatgatcctatatattgtttggatggagggatgaaggtgggatgcctggatcaatatattcgcatatgcgcatggtaagttgatcaatatattcttccacaatatagtagctctctttctatcatttttgttgcatgaatcctaaaataatatatgcttaatcactaaaacacatattgttatttttattgttttattttcattatcagatatcgccgtagcgttagcacgggcgtattactggttgcaattagttggggaggttaccccctagtatacatattgcaaaataatactccatccattccataatataaggcacaaccacttttttttagatgttccataatgggagaatagccactatggtccctgaagtttcgctctgagatcattttagtccttgacctttcaaattgtccaagcaagccttaaactttatcatgtggacatatacagtccttggcccatcgaaaattgccacgtgggtatgccatgtcatcttccaatgcaaatatatgatgaaatacccaatttgcccttacacatatcgtcatagggaaataagagagaaagaaaaggagaataataataataataaagaagtaggtgatcctgcatattaaatatccgttagagttttaacattgaaatgcaactactcacatgaaatttatttggcatgataattatatatttagtggttgttgctaatttaactttgtattagcataatccggtgaaaaaaagtttgccatatatccagtcgcattgaataaagtttgtaaattcttttcattatttttgtatggtacatggaagggtaaattggacatttcaccatatattttgcatgagagcataacatggcatgctcatgtggcaatttaagtgggcccaaggactatattagcccacatgacaaattataaggactcgtttggacaatataaaaggttagggaccaaattgatcctagagcaaaacttcaaggatcatgttggctattctcccttccataatataaggcatgcatgcatgcatgccattaactatgacatattctccattaattactacttttttaaatccttcactctcacgttctctaactctattggatgtatgcattatatttattaggatgatccaaactacaagatgataattattatttcttggtttttggatgaaggatggttgtgccttatattttggaatggaggaagtacttagtcatgaacaccacactatttgcaaatataaagtgaattgcgtctggtaacaaacaatcaagctccataagttatatagaaaatatgagtcaattgtacccacggtacaacaacttagtaggtgggtgcaatataatgcaaaaacttgagaattaaatatctgagtgcaacaacttgataagtgtgtgcgttctactacgagaacttgacaatttaatattttggtgcatcaacttggctaagcatatgctatgtgagttttttcatgatgtcaaaatgccattgcataagaatcctacggatattaccttaaatattgaatttattctttaagaattatgctgcatatacaattttttttcatgggcttcttcatcagactaatcacttgcttatacactcaataagcgcattagtcccttaatcgtttgtcatcaattaaccaaaacccactaggagcatagatgatctttcacaaaccacatataataatagcaaagatgtattaagtcttttttcctattactaagctaagcatgtattaagtctttgattcatgtaccaacgtcttgattccaattatttatttattccgttcgaatttcaatcatgatgtttgatccttcgttcactgccacataaatgatttttttaaggcccatatacatttcaggctgaccgtaactggtggcgcctgcaaaaatcgatctctattttcgcaatatggcttcttaaaagtcccgcatgcaactctatttcgcaagtggacctcttaaagagccatatgcaaaaataagcctatttttctaggcgggtctcttaaacaaccacatgagaaaatgtattttcggaagcccggcctcttaaaggtctacctagaagtcggacttacctcctccttttccttccgacacttcattttttttagggtaatttggaaccatgccattataattttgcaaagtttgagatatgacatcggtatctcaatgacatgtaggacccacatgagttaatgacacgtgggttaggatggcatatctcaaattttgcaaaataataatggcatggttccaattttccctttttttaagtcatcatccttatctcctctcctcatattattgcaaactcctctctctctctctctcttctcattgaaaggcgccaattggatagatttgatatgatagtatctaaatcaatttcaagtgctttgtaaattcagtactctggtgaacattcttctaaatctgttgttgactacgcctttcttcttttatattatttttactccccatttttatattataagtcgttttgggttggtcctatagtcaatttttttaagtttgacaaaatttatagaaaagatatcaacattttcaacataatacaaatacactataaaaacatattcaatgatgaatttaataaaactaatttggtgttgtagatgttatttctttctataaatttgatcaaactttaataagtttgacatagatcagacccaaatgtcttttagtataagacggagggatgacacgaagtaaattatactgataaatcat

SEQ ID NO: 81126 - DNA, 14305 bp, Oryza sativa
cggccgcggagttctcgggttccatagatgcgccggcgacgattacgggattaaatccgagcgaatccgagggagagagagaggggaaagcgggggaaatgggagagggaatcacggggagtgattcccctctctttaatgcgcgcggggacggcgggatgcggcgcaatccgcggcggcggcggcgctagggcacgggcgctggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagggagggagaagtgggccgagccggcccaagagggaaggggggggaaagaacttcttttaggatttttctttttttataaaccttttccactttgtttatttcttttcaattattatttgtgctctgaaaattccactaaaatttgtttaagcattttaggcttttaggaaatatacaaaaatcctccaagcctcatttgacttttatctttgcacattttaattgttgaaggctttcacatgatttttaattattcttttgcacaatttcgaggatgaattttagagtcgatttgggacgcgacaatttacctttgttatgaccttattattattgctattgttattattaccttgttcaccctagaataaacaaaaccccaactagtggacattatattcatggttccactagtatgaatttaggtagatgcttcgctgtttaataggacaacattaggtggtttttataactttagactttgggaattctcatatcttttggacactatggaattgttggtttatgttggaattggacacacacctccccctctattcaaaacccccaaaatggttttaggctgggctcgaggtgcgtggttgggctttgttagtcgtacctcgggtactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtgtatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcattcgggaaaaggcaattttcccggtcgcgacatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcgacacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgatcagatatgagaggctgcacgatgactaacagatgcagtggaagcctcctctcagggcacgttccgaccagacagagatagggacgaactgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacatgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggttaccggtaaagaaatgacgatagaacaatttattactgacaccggtctaactacggatcaattgctaggagttgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcctaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatatgtatgcatatatatgtattgaaacatatatatgcatggtttatatatatatatatatatatatatatatatatatatatatatatatatataccccatgcagccccagggccatgcaaaaaaccgggactaaagatcgatctttactcccggttatttcacccgggactaaagatagcgatctttagtcccggattggtactcccggtttggaaaccgggactaaaggggggtacaaaccgggactacaaagggtttctccaccagtgatagctatcttcacagcttgcacacaaattttgcttcatcgtgatcatcctaattgaacacaagtttcttgatctgacgcagaatacgttttatcattggtcagcaggtagctagctgacatgagttgcacacttgcatagtttacaggaccctgataatgcatgacttgctggtctgaattatatagttgttcaattcgatccccttacagacttgcaggcagctggaagcctggactcgaatcatatcaatgttcgtcaaccatcaacaaggaaaaaaaggacttcgcactagtgccatgtttcacaccttacaagctaggaattaacaatcgtcctatgatcagggaaaaaatgttacatcttcatacaattttcatcagcaatatgagtttctgttcgacgtgagacacagaatacgcgtgagtgtgagattgtgtactggccaggtgcatgcgatttaatgccctactcctttatttcatattataaatagctttgattttttttctagtcaaatttcttgaagtatgatcaagtttataggaaaatttagtaacatctacaacacgaaattagtttcattcaaactaacatttaatatatgttgataatatgtttgttttatgtcgaaaatattactaaatgtttctataaagttgaacaaatttaaagaagtgtaaataggaacaaagtcaaatcgacttataatataaaatggaagaagtagttgacatggttgcttttgtctttatacgagtcactttatatgttttacaatgtgtacagttggtccagtagacattaaaaatgataaacacatattttgtaacactagactctccatcaagcagaagcaacattaaaaaaagtgtacaacagcaataagcaactgtctgatatggatacactacacacaaggtgcacacattgtcaaacgttgtcagctgatcctgatgaccatgaggccggtcgagctacttccagcgtcgatctagacgactgcgaggtcgaggaggagctacgtacctccgtcgttgccctgccctccgatcccttcctgtcacggagagacaggaacacatagatggctacataagccagcaccatgacggccatggcgacgacgtacccggaggtgccccagtccctgctgctgcctgccgcgtacgccaccaggaggccgagcaggtcgagcacgaccaccatgtgcattggcccgaaccggtcagggtcattgagctctgggaggatcaaggtcccttgcaggaggagaacgatggccacgatggatgccgagaaggatgtggagttgctgtagaagaaggcgtggtaccggcggccgtcggtgtcccccaggatggggttccccgctgcgtgccctttgccgtcgttcgtcggccacacgctccctggcggcactaggccggcctggtacgtgacgctcgctgccaggatccccagtagcgtcagatacttgcgcatcttgtacttctctttgtactcatcagtggtctcttcatcatgattattggtgcacttctttcctgtcgaacctttagaccccgttgcctgatcatgattcttagtgacctcgtcttgcttcttggaagagaagaaggaaagacaaccaatgagtattttatggaaaaatttgatgtgtagagcggcgaaaataagcaccgcgccgaccaaggcgaagacgtagatggacgtccgcagccttcgggtggttccggcagcgtaggcacccatcaatccgaccaagcctgcagccatgcaggcatagagtgcgttgcagtagcctacggcgatgctggagaggttccgactcatcaagcaaactatggcaatgacagatgccatgaagctcgtcgcgttgcaatagaagaatgccttgtatcggagagggtaattgtccgcgagaatcgagtcaccgtagcggtggtcttcatcggtgtgctcgatccagaagcctcctggcggggtcaacccagcttggtaggtgatggtgacggctagaattgcaagaagcagcaatagtttctgcttcttctccagcttgcttttctcctccaacttaccctttttgtcatgtggaagcttgctaatcacaacgtagattgccaccaccaacacaaagatggccacagccaatgaaaagacatagatggaggtgcgcacgtctcggcagctcccagcagagtatgcgccgatcaggccaaagaggtcgagtatcacagctgcctcgagtgcacgccggccgatcagagacctactctggaccatgatgatgacgatgatggatgctacgaaggcagctgagttgcaataaaagaacaccttgtaccgcttagcatgggttgcggggagtatcaaacccccaccactatggccattgtcgtcgtctctccagactccaccgggcgggtctaggccggcctggtatgttacggttgtgatgagagtggccagcagaagtatcagtgaccgtgccctctcaacgggatctgtgctgtcttcacggtttttggaggccggattacgtctggatcctgttgctatagatggctcagtgggttgctcgccctgacacggcccaggcatgaccgggtctgggccgaggtcagtcgggctagcacagtccgacctacacgccgggcagggccgggccgttgctgtcatccagccgcaacaaccatgtgtttgtgcttgcggtttagtttttttggataaaaacttgatcacagcaaggcaagaaatgtataggaggacagcgccgatcaggcagaggacgtacacggtggtctccgtctccctgcagctgccggatgcgtaggcgcccatgagaccaagcagcgcgaaggcgatggccacgttcagcgccgatagccttctcccgttgttgcccatgctggtgctcaggagcaacatgatgacagtgagcgacgcgacgaacgcgacggtgttcaagacgaagaacgccacgaagcgccagtagtggccctcctgcaggacggggtcaccggcgcggtggtggccaccggcggcggcggcggcgccaccctcctcggcagcatgctcccatgtgccacccggagggctcaaacctgccgtgtacgtgatcgtcaccatgaagatggagagcagcatcaagaccttgcgccgctctttggggcggagcttgccatcctccacggcctccttcatgtcaagcgggttacttgagcaaccatggagatggccatcctccatgtccatggccttctccttgtcaggtgagtcgtgcactgtcttcttctcaggcgtgtcggtagaaggggcgaccagcgcatgaaccacgatgtaaacgaagatggttgccgaaagcaccgaggcgaagatggtggtgagcctgccccggcagctcccggcgatgtaggccaccatgaggcagagcagatcgaccaccatgacccctcgcaccgccatgagccggggcccctccacgcggaacgggaggaggaggatggtgagcacgagcgacgccacgaacgccgtcgcgttgaagtagtagaacaggtcgtaccggaggcggcgggtgtccggcaggatggggtcgccggtgaggtgttcgtccgtggtctccagccagacgccccccggcgggtcgagccccgcgatgtaggtcaccgtcgccaccaggatggcgagcagcaggaggtacttgcgcagctgccactcccgcgatttggggtggctcgccaccgtcgccttcccaccaccacccggctgctgcttgttgtcgtcggcgtcgggctccatttgcacggtgcaaactgtctcagctacgggagctgaagtcgcctgtattgtgtgatcctgattagtggtgtgcaaatgctgttattgcagatgatgatgatgctgtgtatatatatatatatatatatatatatatatatatatatatatatatatatatatatatatatatatatatatctgcgtttgcaagtcaagtcgcggctaagaaaataaaatgtggtggtcaggtcgcgtcgttgtttaagctgcttctcggtgctcaaccagcccttccatttcccaacctccgtgttgatagtctgacagtcacatgtgaatgcagagtgcacgccatggatgacctgacatggtgccaagtcaagctgatttaaaagtgaaggtataatagtgcacgaatatgggaatcaatgctacgatgaattggaaatccatttaagtactagcagtagttatggccagtttgtgggatattgtgtgttatgatatgctacattaatggcaaaatttgctacggagcatccaaaaaacatgtaattagctggtggacatcgcaagaacacaaatttgctattgggcaaaaaaaaaaactggtaattagctgataaacactcatggttatattttattatttcaagaggagcgaaactgatgtggagtacgattctgtccctgcgcagcttcaatcgatgaggtcggcagcaggacggtggcaggtggcaacggccggcaggcagcaggacgatggcatcgatagcagctcctccgcgtcgcctccgtccgccacctctaccttgtcctctagaggttgttccccgacaccgaacacctctgccctggcgtcaatgtcttccccaacctcgtcaagctcggcatctgctacacctgagccatcattgcggagcagatccgtgcaccgcgcatgaggtccatgtcgccgctcggcggcacgtcctcgtggctcaagctgctcgatgtgctcgtccccgccccggatcttgcttggctcccttgcactcggctgggtcggaagagctagccgcgagagcatcgcatgaggacccttgacgccgcccaagtcgcttgagctcccccgccaccgcccttttgccagtcgctgccgtcccactgccagcctcgttgaactagaggaagatctagggaagaagataagtctttcaggtgggtcccacatagcaagtttgaccaagggcaaacttgtctttaatgagtgtttctctctttaattcctctggaaataataaaataacgtcgtgggtgtctatcagctaattaccagtttttttgtgctcgatagcaaattcgcgttcttccgatgtccaccaactagttgcacgttttttatgctctgtagcaaattttgcctacattaattgttgaatgaagtaaatttgaccaatatttttatttattccacttgtgttaaaaaaagaagcatgcggacacttatataaattgggccgagcattgcatgtgttaacactatatgtcaaacaagctatactttttggtacacatctctcctttttcatattattcattgtgctttagatcgataaataaattatctgctttggtggtcttagattatataaataccaaaaaaaatgcatgtgcattgcaataagtgaagataattttcatgattgataaaagtgtaaagtgcacagacggtttttaaacttgtttagatgtgtcatctcagtttctagactctcaaaatacatgttttagtcctcgaacttgtcatgagtgtcatataagtcccaaacgggctccaatatttttaggtgaagataaagaaggtagtcaaaaatgttattttaaagagaactgagaaggtttacagtgtgttcagaactacaggtttctaacttctactcattcgtttttcacgcctatgcttctcaacctaataaatagtgtattttctaaaagaacattctatataaaaattgcttttaaaaatcacattaatctatttatttcagtttttataggtatacttaattaattatgcagtaatgagccaccctgttttatatgcgcgaaagagaagtttccaacttctcacctgaacacagcctaaagagtatttttgttttattttcatgttagggccctaagggaacataatggaagacttagatggcaaagtcatccttgaaaggttacatgttgtggcaactttgggtaattgggttgttggccttcaggtctttgtccccgtgtcctttttttttcttttttagcaaatgaccatctgtatcagtgtatttttaataatagaatagaatcttggcctttgctcagagagtttcagctaattattacaataattgttcaaaacatatcacatctcaacaattcataaagaacacaaatgatagaggtacacaccaaaccactaacaccaactgaagagataaaccacatacttattgaattatatttgcaaatctcaagccgaagttgacgaaaagttagtgttggtaaaaaaaaaaccccttctctaaaaaaaatgcaaacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtctgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgattgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccatagtctcccttcatggcgtgattcaggtaccccgattgggcgaaggtcttcgataaattctacgcaaaattcgatgacctcctatgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaagggggaaatatcaactcaaaactgaccgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgatagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctt

SEQ ID NO: 81127 - DNA, 4421 bp, Oryza sativa
gttagggcacgggcgctgctggcgggctcggcgaaaagaaggaaaataacaggtgggtcccccctgtcagcgagagtggcgggcgggcccgcctgtaaccggcgcgcgcgcgcgcgggaacccgatgggccccggaggagaggagagagagggagggagagttggccgagccggcccaagagaggaagggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttaaaagatgatttttattttgggatgaatttatcaggacgtgacagtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtattccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacagggctcagttctgcctgcctgtcccgggtatcccggccgtaggcaggagtgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtcaagaagaggagcttcttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacacggatctagcggaaactttcgaaagtctccgctccgcccgcataaaactgaaccccgacaagtgcgtgttcggtgtgcctgcgggaagcttctcgggttcttggtctctgcccgaggcatcgaggccaaccccgagaagatacgagctatagagcggatgcgccccccagcaagcttagagatgtgcaatgcgtcaccggctgcatggccgccctaagccggttcatatcgaggctgtgagagaaggcactacccctatttaagctcctcaaacgctccgggccgtttacctggacggaggaagctgagcgggccctcactcagttgaaggcatacctcagttctcccccagtcatggtcgccccggagccagatgagccgttgctactctacctggcggcaacgccgcaggtggtcagcgcggcgttggtcgtggagcgcgacgaggacaaccctcactccgcgcatccccaccctgtgtcgactcgacccgggagagagcagggaggagaggcccccgagtcgaacggtggcccaaggcccccgacggccggagctggccctctgcccgcttgtccgacggtgccaggcacccccgacccccaggatggccccggggccactgcgggaaggccgcgcctgtcgccctctaaccccgaggtcgtcggcacagaagccgagtgcgccccacgcggcctcttggacgaagagcgccttggagatgcggcccctagcgaagaggatcggccccgccgaaaggtgcagcggcccgtctacttcgttagcgaggccctccgggacgccaagacccgataccctcaggcccagaagatgctttacgccattctgatggcctcgaggaaattgcgccattatttccaggcgcatcgggtcacggtggttacgtcttaccccctcggccaaatcttgcataaccgagagggtactggacgggtggtgaaatgggcaatcgaactctctgaattcgatttgcactttgaaccatgccacgcgatcaagagccaggccctcgccgactttgtggcagaatggacaccagctcctgagcccgtctccgaccccgaggccagttcgggcccctcgcagttgccttacaccgcctactgggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggacttagggtggcagctggactagggatccgccgcctcctggtgttaggcgactcccagctggtcgttaaccaggtctgtaaggagtaccggtgctctgacccgcagatggacgcttacgtgcgccaagtgcggcgtatggagcgccattttgacgggatagagcttcggcacgtgcccagacgggataacgcggtcgccgacgaactctcgaggctcgcttcctcgcgagcccagaccccaccgggcgcctttgaagaaaggcttgcccagccgtcggcgcgccccgaccccctaggggagacggacgcgcctgaacggcccccgaggcccgtcggagtccaggcctcgggacccaaggggagcgctcccagctcccttagattgattgcttggatcgctgagatccaggcatacctcacagataagactctacccgaggaccacgaagggagtgaacgcgtgtcacgcccagaaatttagcccaaatttccagactattttgtgtattaaatccctgtccaggaccagccagggtacacaaaacgacaagtaataaacagttccaaacgtaaataaagcgtaaaaatacttacagaagaggcacttagtcctcacaccgaaacaaaagcagcagcagcggaaaaaaaaaacgatcctagcggggcttcagctccactccacaggcaaaactcaactggggtctgagccttggtcttccaactccatcttcagctcagaagcactacacttctgaaaagggggaataatagcaagactgagtacaaccaccgtactcagcaagccacaccaacgatgcggacgtgcaaaggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctggactacagtgtattgggtc

SEQ ID NO: 81128 - DNA, 19368 bp, Oryza sativa
ctaaaaaccggtgcaaattgactatttcggtggtttgggaagacaaaacaggttgaccgtggtcagacttgctgatcagcataggctaccgtagaactcacatgtcaacgcccactcttcttctaccctctctttcttctcttttactcccaaccaagccaagcagtatgggaggtggccacggtgagcccctcggagcacgttcgcctatccaccatcgttcttgtagctcggagaggcctctccgtctcaacaccgtcatcccttgatccagttttcatagttgagcgagtctctgtacctgattttgcaattgagggatacgattcgacgagtacaatagttgagggagctaaattagactaattctcaattaatatagctcagtgatgtcaaaatatgcaaaagtccaaccatcgagtcactcctctattggcccgtcttccattttttattttagcacaacaaatttgatcttttttccttttatgcatttatataattggaaatttggaattacatttttaattttttttgttcctgttacatttttaatttttaattaaatgtaatatcaacacggtgcaatacaataacttttaagttaaatagaagttcattttctccactaggatacttaaagaattttgagtatattttttttataactatcgtataataatatctgtaactttgtgttcattcatcaaaatatggttttatattaagactatgctattcactagaaaaatttgagagtgtacatcctgaaagtatgataacaagagagattttctatcattttgtttacgtttgggccaattattttcctcttagagattataagagattcaagtgcgatttttgcagaagtccctagaaaataaatgtcatatactaaaatttatatagaataaaatgctttacctataaaatactgttttagtagagagagagagagagagagagagagagagagagagagagagagtaactgagtcatctataaataactcgtatggaattacctagctatgcacaattttgtccaatgtcaaaaacatctcctatggaattacctacgcacattgttgtctaatgtcaaaataactcctacgctatcatatcgttttcgttttccatcgttgtcacgctgtcaattttgcaggcctgcaaaaactactagagtacaaaagttaaaactattttttcaccatggatggatggatagatttatatatgcaagtcctccaagatgtataccagtccaaaccaaaaactccaactcgcaatattaattcacactgaaaaatttggggaagattcaatatataatttccactcttttaatttaatttcctatctaatcttgactgattcccgtttcaactggagaggagatgggagtagatgcacggtgccacaatcgcgaaacgtgaataatgaaacgagcgaagaagttaggcagactgaaggccatatgagtatatgacatacacacgtgacgtcgggtacaatatactccctccgtcccaaaaaaaaaacaaaccctgggtttgcgtgtccaactttgactgtccgtcttatatgaaatttttttataattcgtatttttattgttgttagatgataaaacatgattaatactttatgtgtgacttgtctttttaattttttttcataattttttaaataagacggacggtcaaaaattgggcacggaaaccagggtttgtctttttttttgggacggagggagtacaaagtaaaatttgacgagaggcaaggaccccacttgtcatacactaaatccaccctggtatacatgacactaaaagtaggcaaggaccccacttgtcatacagtaagggctcatttgaatcgcaggaatgaaaaaacacaggattctgataggaatacaattgtaaaacagagaatttgtaaaacacaggaaaaacacaggaatggccgtttgattggaccacagaaaaaacataggaatctgatgggagagatagatagactcagaggaaatgttccaagaggttagacctcttgctaactttcctccaaaatatgcataagattacccattccatagaaattttaaaggattggataggattcaatcctttgtttcaaagaccttcgtaggatttttttttccataggattgaaatcctccaaaattcctacattttttctacaaatcaaaggtgccataaatccaccctggtatacatgacactgaaagtatatattaattatatgatagcaatagattttctatcgttttctttacaatgtcatggaggttgaactttcaactaaagtgatattacctcgtcaaagaaaaagtgatatcacctccatctcaaaatattgcaacccggatctggacagatatctagatttattatagtaggaacaaattacatcctaaattacaatattttggaatggaggaagtaataagagtaatttgaaagtgtgtggaaaaggaaactttagctctttatgtgcggaacgcagcctaactacctaagtagacactacaggaatattggcacgcatgttcaaaaaataataaatatggtacctgtgaaaaacagacttttaatagacaatgagagagataggtaactgagtcatctctaatttctaactcccatggaattactagagaagccaaacaaactgcctctaatgtcaatcagtttcgctttccatccttctcatgctgtcaatttatcagtcaatcacactacaaaattaacataatctcttttttttttcttcaccatggacgatggatatatagatagatagatatatttatccgagtcctccaagaacaccaaacgagaagctccaagctcgcaataattcaccaagaatcgcaccacttttcaccttttcttctcctcctccatttccatccatggcgacgctgctgctgctgctgcacacggcgcaacagtgagctatagctagagctcggcaccacgggttagcaatggcggtggcggcggcggcggcggcgaggcggcgagatgtctcttgtcttctcctcctcctgtgcttcagctcgtcaatggcggcgaccggcggcggcggcggcggcggcgagcaggaggctgacagggtggcgcggctcccggggcagccggcgagccccgccgtgtcgcagttcgccggctacgtcggcgtcgacgagcggcacggcagggcgctgttctactggttcttcgaggcgcaggcgtcgccggcgccggagaagaagccgctgctcctctggctcaatggaggtctcgatcgcttctgctttttttttttctaaaaaaaaagaatttgctgcagtaaaagctctgttaaatgttaatcggttaaaaattctgttagttaagtaagtaattactcctagtaaaaactacagtttctgtttgttcttttgtgtgtgcgatatgaaaaattcagatattttctcttgggtatttgttctgtggagtacttgtcgtttatgtttgtttagttttgagatgaggtttcaggttaaatttgtgatcattggttaatctgaacttctgaagagctgcttattgattttttttctttcaactgatcatattgcataaatataaataaataaatgattgttgcatgcaacatttatgttctttcttgatggttaattaggaatatttttttttctaaatggtttgttaattttgttcttggttttgtcaggacctggttgctcttccattggctatggtgctgcatcagagctagggcctctcagagttgcaagacaaggagcagcactagagttcaaccagtatggctggaacaaaggtgcagagtttattttgtttcctttaattcctgaattatttaaatatttttcatgcttaacatcactgacatttgtctttagtataattctgaaaacattttttttgtgctataaaattggtctttgccagaggctaacctcctgttcttggagtctcctgttggggtcggcttctcctacaccaacacatcctctgacctctccaatcttaatgatgattttgtaggtaattaagctgattgtaaaatgatactctagtttgcttggccatctacaggtgatctgaatttcgattgccttgtaataatgattagaagtgtaattttgtggcatcctttttttttttgttgcagctgaggatgcttatagtttcctggtgaactggttcaagagatttcctcagtacaaggacaatgagttctacatctcaggggagagctatgcaggtaaactcatttcagaaatgaaaccggtaaattttctaatcagttttgtatggtctaacattcagaattcttcattttcatcaagaaattaaaagatttcctaaccgcaacatattacaaaatctggtgtgagacatttttctcatttgttctcatgtggatgtaaacatgtccaagatgccttcctttcaagattccagttatctaatcaaaatggaaggcagcatcccaatccttgaccaaaattttcttatcgtttgctttcacaatatctcaaggattgtatgtatcgaattatgttagtgtcaccatcttatctgaaaccagaacttccactgaagaaaaaaatcatcactgactttatagaactagctgacacctatcatgagttcatgacagctcttagttcagcaatcatccccttagcaagcaaacaaaagatcatacttttaatggtgaaagtgtcagatcaggaaccaagtctctaaaataatataaggtttagtttcagccttctcaaatattcctgaagtacaatattctcagagtcatctgattgttcagaattcagaagaaatttatgtagaattcagtaaaagatgacctgcttaaacaaaaggtagaatgatttcagttgttacttgcatttatgtattgaggacagaaattataccgatgccatccgaactgatagattttctctgcttgaaacaaagtttgagtttttggattgtaatattggtccattagatctctgaacatatgtccctgaaagaatgaccaaagcatcagtggtaggttcacgggctacattgggcttctttcacaatccacatgctgtggaccagaagatgctctgcaaaaaaagcttttgttctgcacatcatgcaagatgaatctcaatctgaacttttcctgtgcaatgtccctgttatacaggtcactatgtgccccaacttgctgaccttgtctatgagaggaacaaagacaaaagggccagcacatatatcaacctcaaggggttcattgtgagaatttcttgaattgctttcagtaattattgttatggttttgccaaaaagttcttttatgtgaaatgtgctcatgtataagaaaccatatacaaacttagaaagtagaaagaactgtttactctcaccgtttcatattgcttgtcattttagctttgtcttaagtcaaacattccttacaacttacgccataaacttttactcataagatttatgtttttagattgaacaaaagaaatactttcataatatataattcacatgttcttaaactatatgaatttacagaaattgatggtcaaagttaggtatattcgacttaggacaaaactaaaacgacaagtaatttgaaacggagggagtattttgaacaatagtttctcagttgtaatgctcacaggaacacccaattggaacacgattaacttccatttaaaccatcctaaactcataaaattggttcctgcatgaacataacagtcaaaaaatctgcttgcaggtaggcaaccctctcaccgatgattactatgattcaaaaggtttggctgagtatgcctggagccatgcaattgtgtcggatcaagtttacgagcgcatcaagaaaacttgcaacttcaagaactccaactggactgacgattgcaatgctgcaatgaacataatcttcagtcagtacaatcagatagatatatacaacatttatgccccaaagtgccttctaaacagtacttcagcatcttcacctgatcgtgcattcttcgcaaataaccaggtaaaactgatccatatgcaaaaaaaaggataaagtttcattctggaccctcttctgaaattcatgcatttctgtgttttgacaggaacaattcaggtggagaatcaagatgttttcaggctatgatccatgctactcatcctatgctgaggactacttcaataagcatgatgtgcaagaagcattccatgcaaatgccagtggactgcttccagggaagtggcaagtttgcaggtgaattagcccaaagatttttcagttttatatttcaatgtattagccattaattcttttagcttgacaggaagctgagctcatccatttctttttgcagtgaccaaatcctcaactcttacaatttctcagtactttccatcctacctatatactccaagctcatcaaagcagggctgagagtttggctctacaggtttgcctcatcttaatcttagacctgttcaattaaatccatttttcagttttttttatcattcacctcagatcttccccattatcctccatactacagttcttgtacagtttctctgaaaccttgaaattactgttcaaatatattggtagtaatatgcatctacataaaaaatatgcaacaatgccctacaatttacctgaatcagtctctgttcatcaaagcagcggtgatgctgacggcagggtcccggttatcagttctcggtactgcgtggaagcactcggcctaccgatcaagaccgattggcaatcttggtaccttgacaagcaggtctgcaaaccagaagctgaactgaacatcaatacatcatgtgatttgacttgtatacatgctgaaacatggagcaaaatatttcaatttgcaggttgctgggaggtttgtggagtaccatggaatgacaatggtgactgtcagaggggcaggtcacctggttcccctcaacaaacctgctgaagggcttatgctgataaatgcattccttcatggtgagaagcttccgacaagcagatgatatgcgctgctgatgaagctttggaggtacaagatggcatgagatacaggcatggacatcaattttcattgaaaggcgccaatcggatagatttgatatggtagtatccaaatcaatttcaagtgcgccgtaaattcagtactctgttgaacattcttttaaatctgttgttgactatgactttcttcttttgtgttttttttactcaccttttccatattataagtcgttttgggtttgtcctataatcaaactttttaagtctgacagtttatagaaaaataaagtaacattttcaacataataaaaatacactataaaaacatattcaatggtggatttaatgaaactaatttggtattgtagattttatttctttctgtaaacttggtcaaactttaataagtttgacatatatcaaagtatcaaaccgaaaatgtcttgtagtataaaacagagggagtgacacttagtgaattataccgatatgtattggcagaattcagcaaagtttaggtgacaccagggaagaatgccccaacaaaagatccaaaagacaacagtaagtcgagcaagtaggatatcacccgtttcttctgccttgaccaaattctcaactcttgaaatttctcactactttccatcgtacctacatattccaagctcatcaaagcagggctgagagtttggctatataggtttacatcatcttaatcttagatcagtcaattgaagtcatttttcagttttttttttatcatgcacctcaaatcttccccattatcctgcacagtacagtttctgtacagcttctctgaaatcttacagttaactgttcaaatatattggcaatatgcatatataatccaaaatatctaacaataacatacaatttacttgaatcagtctctgttcatcaaagcagctgaaatgaacatcaatgaattgactattagtattcatgctgaaacatgcagcaaaacattgcaatggtgacagtcagaggggcaagttaccaagtttataggctgctttcttctggaacggttgcgatcttctcccccacacacgcaaaacagagcaagtaattacgcatttgttataaacagctttcctacagatttttttttgtgcaaaaaacacaacgtttagcggtttgaaaagcatgcacgtggaaaacaatggagtagatggcatgagatatactactaggcaacattgtataggtggcaagagatacaggcaagaacacggggacatgaacaccaaacttcgttcaaaaaggaccaatcgggctgaatatatatgacagtcgttcatatgaatattagcagttcagccaaaattaggtaacatcctaggttaaacgccccgacagaagtcatcaagtcaaagaacactcgaattacataacattcactaaattatcctctccaggtaacttcagtcttgctgtacatcctcaagccatcctccgtcaggcaacctaaaattcaacacatttatcgctgcttaaggggtaaaatctaggtattaaaacaagcaaagtagaacaattgtacaatagtttagagaagtttacctttcctgagctgactttaaattctaagggtaaggtaattgtctccttgcatgtaccttcaatgtcatgtacttccaactacacaagaaaagtaattttgctaattatttttccccaattttgtaaaataaataagtaatattttttgttattatataatatcagaccttgagaaccatcgacctcttctcacccaggtatctccgaccaagatgaaggagataatcttctatctgttcacgaattttaaaaatagaaatcacaacacatttgtattattcttgcataatattgattacttgagacaagaattcatttcacctcaggcaacatagtcccgcacttatcctcaaaaaagatcacgtcaccccgtctaacaccgagattttcaagagcagaatcattggctatgtgttcaacaataaagccaccttcgatgttatgtttcagagagagctcctcccggagtgagaaactagctagttccacactttttaaatccatgtcaaacacagggcgggcaacacagctacaaataagatggatttagtctattagaagaaaatgagtgctagtgataagatggatttactctattagtagaaaatgagtgcgcatgttggtgcgccgaccactttatagcccttgtatattatttagcaaattgaattttaagacttaattttaattgattttaggtattttttaatcatggattactttccagcatttgctttttcgaaccgctaataacatagatataaaagatttatccataaaactaataagaatatatcgtgattagtgggtttacgtgctagataaactttttaactttgagaaattgctcaagacgatattatgggaaaatgacatctaaaaagttagtgccatttccataatatagatagtttcacatgtacataacataatctgtattaggaggaaatacatatcctaaaacaaatgtcttagattgccaatttctatccatcattttgtagtgaaattacatgctactacttacactgctcatctagttccctgtttattgttttcttcatacaggctactactatacccgtatgtagtgtagtggttttatccaaatatttttcaatggttgcaacataatccttgcttccaattttcttttggcatttaaacatacaatattatcgtaatgaagttaatttcttcgattttgattcaaacggcggtacattttagtactgatggaataaagaaatttaatactgatggagaaagagtatatacctaaattgctcccacatctcatacaaggcatgaataattgagattgaaatgattgctgcacaagggccgtctctgtatactacagcaatgatactaccacagtagtcaaccacaggccctccttcaccaccctgcattaattaaaaaaataaataaataccactaagtagaaggtaaaataaatagcaagtgtgaagaaaaggtatttacctcaggaacatcacaatccagaaacatgtaatggtttctccacatcaaagaaccatccgaccaggtgattgctccacgcctcgccaccagggacatattttcatcccgagacaaggcaagaatttcttggccatactttgctgctgacccaaaagtggggacctgcaatggtaggtcagacgtgatctccaagatggcaagactgtagtggcgattcacgaatatcaaccgtccctgcacgatagacttatctgggagatgaacccatagctgaaagatagagagagcaggcaatgggagaaaaaaaaggttaatgccatattgttactcattttaagcacaagaaacagaattaatactaaggatatacaagaaaaggcctgacaatgaaaatgtttgagaattgaaatcagagggctgagtaaagttcgcacaaagcaaatgcacggcagcccagctaccgttagcaattacttgaccatacttaataaaaatggcaatggaactcggatgatagaaacatggggattagctaatggaaatcggtgttctacacttggaccaagaaattaaagaaactggcaggcatgaagagtcatttttagcaattgggtttgcccctacttaacaagaacaataatggaactcggatgatagaaacatggggattagctaatggaaatcggtgtcctgcacatgccccaagaaatttaaagaaatatacaggcattgtaagagtcatttatagaaactgaattgaacatgatggttaataataacagattacacacatatagaagccacagtatatatatacagaagctgcaggaaaagaagcctgcacctcgggttggggctcatgcggcttactcttgaagtcagtggagtagatcgtgaggatcatagcacgcttggtggctccatcccaactgatgacggtgccggtgagaggagagataaattttccctctgaaaaacatccggttgattagcaggtagctacatacatagctagaagttgatataaattcatattttgtatcgggctactactaaatacatattttccctttcgttgcaattcgaactagacattgtctatctcgcctacagctaattaagtttgatcgatgactagattagcactacatccatggttaccatgggagtagagagcagcaataattttctgattttgactgcataagtagatcgatcaatctatcagacagtaaagtgggttgactcagttgaattagaagtagatgttaattaccagtcggtggagatgaaacacggacgattgagcgagacatgcccaacaccatcttcttgtcagagggggtgggcatggcggccgcggtggagggctcgtcttccgcatcccggagagttgccttccgaagtcgatcaactgaagaagatgaagaagagaaaaaaaatataggtactcaaaaaaattggggaagaaacagtggtggggatggatggatcgaaagctcaagaaaacctttgcgctgggcgatccaggagctttctctgccgatgcgcggtgcggtggagtgcggctgcggcgggtggatcggccggcgtgccaaggtaccaggctcccccgtcgtcgtcgtcgtcggaatcactgtcgcccgcgactcccccgccgtctcctcctcgatccttctcttcttgttgttgttggaagagattcccggcgattccaccgcctgaatcggaagaaccagtccaatctgctttgctcgggagcgagtcaacctccccgaccacgatccgggattgggaatgccgtcgtgcgagcggagatcggaatccggcgttgatttcgaccgtgccgacatcgccggcgacgatttggggggcatgtccgcctcccgccgcaccaatcgccgccgccgccgcgcgttttttttttcttcactttttagctactagaaaaatgcgaagtatatttcaatcttattactactatatttattactaatgtatagtactccctccgtttgacttttttaatcaacgtttgactactcgtcttattcaaaatttttatgtaaatataaaaatacttatgtcatgcttaaagaacatttcatgataaatcaaatcacaataaaataaattataattatataaattttttgaataagatgaaaggtcaaacatttatcaaaaagtcaacggcgtcatacattaaaatacggagggagtatatagtttagttaggatgaaatttggagtactgtacgttcgcttggatatatattacctccgttttttaatagatgacgccgttgactttttctcacatgtttgattttttctcacatgtttgaccattcgtcttattcaaaaaatttatgtaattataatttattttgttatgagttgttttattactcatagtactttaagtgtgatttatatcttatatatttgcataaaatttttgaataagacgaatggtcaaacatgtgagaaaaagtcaacggcgtcatctattaaaaacgaagggagtatatttttagaaaatcatgatctacaggaagtccgatcgtcttaagttagcatatgagtttttttaaacagatttcttatatgagtatgattccttatgtattaccaaaagcaaacgaacttaaaaaccgacccatacacaaataccgtacaaataccgtagagatatagattaaaaccaaaacataaaattaaaaccgactcaaacacagataacgaaccacggaaacatcttcaatttttataagcgactcaaatatggatgacggaccgcggaaacatatttaatttttataatagataatagattttcaaccacaccaaaatttaacaattttactatatatttatcggtaaattttcttttaaaaatttgacagatgtaattacattacatagtgtagcacaatgtaacttgtatataactttcatccgttagattttgtttcaagatttgtgcaagtgaggaaggaaaaaagtcagagcacgtatttatgagaggattcgttcccacgaccttctatttcaccgaaatagcatgttacggagagatttttttaaattacatacaagttacattgtagttacatgcaaattacagtgtaattattttacaattatactataattacatctgtcaaatgtataccctctgtcccagaaaaaagaccaatcctatctacgaatttagacacgtgtatccaggttcgtaactagaatttattttttccaggacggagtagtaggtgataccaaatttaatgatagtaaattttagcagattcaaattttgatagtattaattattgtgtttagtttcaaatgccatgtgcttctcgagcgactttttgaaaacaaagcaatcctccagagaatgtctatctgttttgtgtatggggcaccatgatttctttgtgtcgctgccttgtgggtccgggcgcttgggagggttcgcgtattctgctgcgaggacttccgcttgagctttccttttcccgtttttgcgatttttcttcttgctcgactcagatgtgtctgcggctgacttcttctctcccccagtcttcggtttgtcgttcttgcgtcttagtgcgtcatcgacgtgggcacatctttcaacgatctcgaataatcttcgagtagttgtgatgcgccttgttgccaactcctgggtagtgtagcgatctctgacaccagacttgaaggcgcgaattacagaagcgtcagtgatctcggggatggtgttcctgcactcgttaaagcgcctaacgtattccctcaaagattcacttgagttctgtgttaacgcgtgaagatcgtcttcgatcgcgtgacgcttgtatgttccttggaaattggcgacaaactgatgccacaggtctgaccacgaagaaattgagtaggggggagatgcatcagccacgaacgtgcagaacccttcaacgcggttggtaaatagtttgccaatgcattggcatctgctccagcggcataaagcattgtcgagtagacttgaaggaattcttccgggtcggtgctcccatcatacttttcaataactctaggtcggaatctctcaggccatcggacatcacgtagggaacgaccgaaagccctacacccagcgcttggagcggtgggttgtcggtggtcgcatgaccttcgtggatgtcggtctgacgatgaagaggacgcggatgatgacgatgatgacgatgggtcgcttggttccggcgtgcgattacgagggtgacgacctggatctcgggaatcttgtcttcatctctcgttgttgtctcgacgctgatctccttcatcttcgtcgttacggcgacggccgtgaccagtgttgtctggccctcgccgatcgcgatcgtcatggtctcggttctcttttgggcgacttcctcgatcatggcgtcgtgaggagacatgacgccgggagtggttcgcgtcatcccgtgtgcgtcgtgcttctcggcgtccgttgatttgatctcgaagatcgccagtgccacgaggtggaggggtagcttgtcgaggtgattccctccgttctggactttcaccgttagcgtcgccgactggcgatcggttttgttgtgctgcggtgatggcttcttcgaacgcattgctgaggttagtcaccgatgcccgtactcgttccgtccaacgctcgaggtcgttgttcagaacgggatcgtaaggtgtttccctcagtatggcttgaacagccctgatgtgttgggctggggtagtcgattgattcgccgccaccgcattggcttgtgctgacgtgccaacgtcatcgatagccaacacctcccgcgccgcgtctgacgttgatgacccatagtcttcgaggagatgtaaaacagatggttcatggggattgagatcgattaccccaacgaaccgatctagggctggagtcgctccttgttccttgctgttatcccggatggggacgtatgacttaggagacggagttttcatggcgccgagtagaattttgcaactcgagaggtcgtgattctttgtcttatggataggacaatagacgttccgagttggagaagtacgctggatcccacgttctttgcaggcgcggatttcagcacgagcgttgacgaatacccagtaatcttgaagagtatgtttcttggttttatgaataggacaccaagacctgatagtttcggaagtcatctttgctggcccgcggtttgtgtcggagggacaaggcctggccgcatcagaatccttcacgaacttggatgtagtcggtaatccgttctccgtttcaacgggtggatttttcgacgtggaggcgtcttggttcgtagccaccgcgttctcgttcccagtcattgggggaccggttgagatcggcattgtggtgtaaaccgggtagacgatttcgccgacttgagtccataccagcattgttgaggtaggaagaacttgagcggagctggtgttggcgttgttgtcgacgaagcttgatggcatagtagtagaaccttgaataccaagtccccctacctggcgcgccactgtcgacgggggatacccgtagaccggatatagagggtattggggtacgctggtataaggatctacgtagtacgacatcaagcaaccaaaagacgagaattatactggttcaggccccttgataggtaatagccctaatccagttgatatgggattatatggtggaaaacacagattacaaaggaaaagacggaactcgggggattcggcgagattgtagtcgagatgattcgactagctctcgtcgacttggctccttgcaggctccgacttcataggctgtgtgggttatgttgactctgagattcgatgatctatgccctccccggggggtcccttttataccgcaggttgggtgctctccgagtaggactcgaacataccagacctgacacgatacgtaggtaacccaattcttgtccgagaaggtctctccccgtccattgatttcacgaagagtttccttagatgccaaaagatctattcgtgtacacgtggatatgccatgtcgatacatgacgtatatcgaggggtagagggtatgcctgacccgtaaccctgacaatttagtagaatttttaagattagaaacttctagattattaatttaatttagtaaggtagtattggtaagagtatgtttggtttgtaataattaaaaaaaatggtaaggatataaatatcaacaaagttaacaagctcgtatatcttcgtcccactcatatcggattccttttatttttttttaacaaattttataaaatcacacctattattatctaagttgtataaaattatagggattttagtacgtgacatgtagctatataggtattgtggttttaaagttcataaaatcacaccgttaaccagtttaacatattattatatcaaaattttaaaatactactcctcccgttaaaaaaaataaatctagaacgggatgtgacatattctagtataataaatctgaatagagatatatccagattcgtaatactggatgtgtactagtttaattttttatggacggatggagtatataacaattaaacgatggataaaaaatttataaattttagatgtgatcttagaactcacggtactactgtgtgtttggcaaactgaaaataaataaatgtctactagctccaggtgatatacatggccgtattactgatgcctagacctacgattcatgtaccaacatcttgattccaattgtttatttatttcgtttcttatatatacaagcagccgttcgaatttcaatcacgacgtttgatcgttcgttcactactacataaccaatttatttttacgagggcccctatacattgcagcacaccgtaactaattgtgcctataaaaatcaatctctattttcgcatatggcttcttaaggacccaagcaaaaatttattttcgtaaacggacctcttaaaaaaccatatgcaaaaataagtctatttttctatgtggatctcttaaaccgcaacatgagaaaatatatttttttagacgggtctttaaaggtccgtaaagtctgacttaactcctttactctcagcacctcaaatttttttaagtcatcatcctcgtctctctcctcgtattattgcaaactcctctctctcccctctcattgaaaggcgccaatcggatagtatccaaatcaatttgaagtgcgccgtaaattcaatactctggtgaatattattttaaatctgttgttgactacgcctttattcttttgttattttactccccattttcatattgtaagtcattttgggattgtctagtcattttttttaagtttgacaaagttcacagaaaatatagcaacattttcaacataacacaaatatactataaaaacatattcaatgatggatttactggaacaaatttggtcttgtagatgttatttctttctttaaacttgatcaaactttaataagtttgacatagatcaaaccaaaaatgtctttagtataaaacggagggagtgacactaagtaaattatactgatatatcaacgatatattggcaaaatttagcaaagttgaggtggcaccagggaaaaatgccccaacaaaagatccaaaagacaactgtaattcgagcaaacacctattgagatcacccgtttcttctgcagtgaccatacctcaactcttataatttctcagtacttaattccatcctacctacatattccaagctcatcagagcagggctgagattatcatgcacctcagattatccccattatcctccacggtacagtcctgtgcagcttctctgaaatcttacaaataactgtacaaatatattggtaatatgcatatataatccaaaatatccaacaatgacctacaatttacccgaatcagtctgttcatcaaagcagccgaactgaacatcaatacacatcatgtgaatgtcattactagtattcatgctgaaacatcagcaaaacattgcaatgcaggtttgtggaacaaccataggggcaagttaccaagttgccgcgttcgtttggaacagttgggatctctcacacgcgcatgcataataaagcaagtcattaacatatgattaattaaatattagcttaaaaatgaatcaatatgatttgtttgaaacactttcctgtaagatgttttttttgcaaaaaatgcaacatttagcagtttaaaaagcatgcgaaaaacaatggagcagatggcatgagatatgctactaggctgctaggcaacattgtatagatagcacgagatacaggcaacaatgtggggacatgaatatcaaacttcgttcaaaagggaccaatcgggctgaatctgacagtcgtttaaattaattagcatagctcagccagccaaaattaggtaagtcctaggttaaacgcccgacagaagatcatgtcaaagaacattcaagtaactaacattcacaaaattatcatctctaggtaacttcagtcttgctgtacatcttcaagccatcctccatcgggctacctaaaattcaacacatttgtcaatggattaaaacaagcaaacatgggcaattgtacaatagattagagaagtttacctttcctgaatcgacagaaaactctaagggcaaggtaattgtctccttacatggaccttcaatgtcatgtactagcaactacacaagaaaggcagttctgttaattattcttttacccctttttttaaaaaaatagtggtattttttgttattgtgtaatatcagaccttgagaaccatcgacttcatcccctgcaggtatctccaaccaagagataggagataatcttcgatctgttccagaattttaaaaatagaaatcacaacacattttttgacaaatattgatttatattaaactattacttgagacaagaattcatttcacctcaggcaaattagtcccgcactcgtcctcaaaaaagatcacgtcaccctgtctaacaccaagatgctcaagagcagaatcatcagctatgcgtttaaccataaagccaccattgatgtatgtttaacagagagctcctcccggagtgacacaccagctagttccacact

SEQ ID NO: 81129 - DNA, 12677 bp, Oryza sativa
gattattaccacaagattaattgagtattaaatattaaaaaaatgaaatttttttaaaagaaacttatatatagaaagtatttgaataacatgcaccatgcaatgcaccatttagccgttcgagaaatgtgttcgctacaagttagggagtatctaatcctataaacactttagaacacactcttaaatttattacttaagtaataaaacacatattatgtagtttacaatataattggtcaataatagcctaaaatatcaattgtatgtcctccctgatcccatgtttgtaagttttatatacaagccactatccactaattgccaagtcatatttcatattagttatgaggaatccgtctaatgagcacgtgtgtcatcaagcacaaagataaagcgcaatactaagtgcataacggtcaacaaatgatagttaagtagagtatgcaaccaatccaccgcaaacaatagttgactacaagtagattgcggctatgagtaatagcattcctacactcctatataaacacttataagatatcactacactcctataaatgcttataagatgtcacgcgaccctctaattagcgagaatctaagaaaaaaatataaaaagcaaaacatctataaatcgatttgcactcaaaattggcgatccattattttcaaccattaaattagatatatgacagtagttcctctatcctaaaggccgtctaatccgtccatacatacatacacaactcctatgtacatacgtatgcagcgtatataaaaagaaaaaaacagagtgtgtatatgatctgtcccatttggtacttttctttttcttgctataaggtttttcccaaattgagcatatacgtagcaaccactcctagcgaggaagtaaaagaagccacgccatggcaccgcctcacgcaacccgttgctgaccgatgtaaaaggcaatttcataagctcatataaatgcatgagtacacatatgtacaccctatccctatgatagacaaatattcattaaaagaaaaagaaaaaacaaaatctatacgagagactactattcgaaaaaaaacatacacttaactacattatatcccctttctcaacgtcgttctcatccaaattgtgttaacaattagcacaaatagttttgataaattccatcaaatattaatcaccgtgaacaaagcataggtgaataaatgtataaacaagaaaaaaaaatctaaacccaaattaactcgtatgttagcaaaggatcacaattatgttaatattttttacgtggtcctcaccacagaatctattagtttttttttgaagtagaatcgaattatcaactctgctaacttttaaagagaaaattatatttgtactatcaattaacaccataaacaaattatattatatctactctatacaataaatcgactcaagatattagaaaaactattttcatcacctccattttctttcactcatacccaaaagggcaacaagcgtggatctcaaccggctatgttgaaataactatggcaggagtacgcattgttgagttgaggtggtccgagtaaaaggttattgttgacaatagagctcaactgacctatttacgaatacaatcctttacaaaattatactccacacttttcttgaggagcacgactatatcaatgcgggaccatgagtcaaggcatcgaaggaaaaagccttagcggctacaatcggcttcacccagcttttagaggggtattcatatatgatttttttcttattaattggtagaagcagtatttttaaatatttatatatagatttggatacatgtgagacatggtatgaagtagagatgaacttttttttattaatgacacattgggtttatttttaggtatagatgtaattctatctattaaaatgacatccatattttaagacaatatcatttagtatgtcaactgttaacatctatggtctactccctccgtcccaaaaacaaacccacttcttctatattcaaacccagaaatgggtgtccacatccaaactcaaaagttggtcttataatgaatatggtgagatagggcttcttttagtattctttttataaacagtaaataaattgcccgcacatgtgtgcgggctttcttcctaattatatatataaatggtataacaagcttattaagaagcttctaaatagttcatcaataatgagttgtttaaattgtttagaggagtacaatacctagcaccgttacacgggctaaaacttttatactacctctgtcccaagataactataattatatgttgtttagcatatattaaggtttgagaagaaagactatggtgcccctcattaaatagtgtttatgtgagagtggaaagatggttgagggtataatagagataaatttaaatgagatgattgatggggcaattagtactctagaattacaattattttgggacaaagtttgaatcatagaaatacaattattttgggacggaggtagtacaaaatacttactaccataatgcttaaccattcaatttactcataaatattgtttggaatttctctgcgtatatttttttctttttagagattgtttgttttattttcataattaatagaccgttacaatttttataatttgcattaacattactataaaaaaatcgatgaaagattagactcgaaggaaaacgaagagtaggagaaacctcttcgttaagaaaagaaaaccaccgacgagtccattcgttttcatcttcttcttgttcttgtactaactactcctaactcccaccacctccgcctccgcgtcgccccgccgcgcgcctcctccccgcctcgccgccggcgcgcacctcctcgcggatcgcgatgcacaagacggcgcaggcctggttcaccggcggccccgccgcccccgccgcctccgccggcgagtcgcagccgtccctcctcgccgactggaactcctacgccgcctcccgccccgacgcctcctcctcctcccctctccctttcgacatcgaggccgccgtccgctccgccaacgacaccgtctccggcaccttcagcgtgtaaccccacccacccctctcctttcctctcctcctcctcgcgccgccagatctgatcgagatctcaagcgatcgcccctctccgatgcagggtgaccaagggcgtgcgggagctgccggggagcttccagagcgcgacgagcagcttcccgtcggggaaggcgctcatgtacttcggactcttcctcgccaccggcatcttcttcgtcttcatcgcgttcgcgctcttcctccccgtcatggtgatcatgccgcagaagttcgccatctgcttcacgctcggctgcgggctcatcatcgcatccatcttcgcgctcaaaggacccgccagccagttcgcccacatgacctccatggaggtacagctgctattattattattcttctcgctgtaaattgttttggtgattgttaaattgttctgtagtgctatatctcaattttgggagtagagacaatccaacacccaatttgacaccgcaaatttggtcgaattggcttagggcctctttgtttaggcttaggcttttaactcagctttttaacttatatgatttataagccaatggatagaaagtcgtaagtttaatgttggagtcatacctctacctcacaaaagccaaaaaaagcttctcaactcagcttttggcttaatagtgtagagtggcttatggttttcaaaaagccaaatgaaaaactgcctatttgtttatgcttagacttttttggctcataagctggcttataagcctaaacaaagagggccttaacgttttggagctgcaatatttgctcacaaattttgctgttaactctcaagcacaatgagtgttctgtgtatatagccaaaggttgtcattcgcattattatcaaacaacattggaggtaaatactaaacagtaatataaatattcttgccaccagccatagaaaaagagaagaaaaaccccaccaccacccgcacctcagcccagctgtagatcatctatcttccatgcatctaaagagttcttttagcacaaacaactactctgtgcataacttactacctgtatggtgttttaaattttctctgctagattagagaaacactgtaggtttgtttggatggggttgtccgtaattaattccatgtatacgatgaagtgtaggaactaaagcaatgtttagacagaacagtatggattctaacggccaaatgtacttacgagttaaaacagtgcaacttgaaaaaaaaagagacagaaggcaaaacctggatgaattgactagaaaaagacaatactgctgctcttttttcttagttcctcttggatggttgtaatccagattccatatatgaattgatttgtctatgatcctttccaaaataggaccttgtaaacttatgaaaggaaaaaatatattgtgcatactagcttttctttatggaacaagaggcacctacgaaacgtccctttcatgaggttctttttaatccctcggtaatcatcagaccatcatttactcctcagaataggaccccaaaaacgaagctattttttccttatcatcaagggacctacatgctttaagtctgtattccttccatcatggggtgcacttcttttggattttgtacttggatggaattttcgtgtggaggtagcggttataaattccctttttattctcctgttctccatatgggttgcatgagtactctagcctatgaatgcagaaaaaaatcacagattagaaagcatagaaatggacctttagctcttcttctggttcttggttcacctcttgaatgtttactcattgacctcaacaacgtttctaactcattgaccttttggcacctgcacctccagatgttttattcttttgtctcctgaactatactcagcaagcaacacagaaattttctttagaagccatttaaaaatactccaatatccatgtagcatcaagcattcaagcctagattttctaactatcacaagtctttaatgcaagaatccgagtaccctaagacccaaaagaaggaaaaaagggaagaaaacatctagcaaaatgaagaatctgtatggtgtacgctactaatttgagcacgtccaaaagaaatgtgaacagtattagttgagaacattgtcatggcagagagtgatccttgatctttcgagtgagtgctcactgcctcattggcacttgagctgaacaacatgcaagaatatgatgttaacttggctgcttctgcttagcctcttctgttcgtttggcttttccaatcaggtgcaactgaagaagacatgttgtcatcctttttacttcatatgaatgagacaatatattggctcaatctaaaaggaaaacttgatatggaacctgtgaaggaatatattttggctcaaatttaaaatgatttctaaacttccatgcatcttaataagctggatagaactagaagtctttttccctaaaaggtttctgatttcaatgagttaaatgtaaggtttttgcttataccagttctactaaaacgttagccacttagccagaatacagtggatggaagtgctagaggcagcaccttattctgcatccccaacaaaacgggaaaaacttttatgaataattcaacagttctttttcctgtccatggccagttagtattgctgtggttgctacatttttttgacatagtcaggttcttcctccactccaccatgaatttgcagctacctcatgactaatgcgccctttgtcagtccactcacttttccccctctccctttagtcggaggccttggctcatagcctcatagtcacagggtgctacttctgctgcctcttgcataagctgtgtggatcaggtgctcaggttaggggtggtagcggcagcaatgttaatcaggatattgtgctctgcagtttgttatcaaatataactggtttctcaccatcttttggcttgcaaacaattgagacagatgcgtacagtttgacttaagtgcaattccctgattagattgtttagcacattcacacaactgcaaagcccataagaacatttctttttcttgatagatgcttcgaacatgccatatatgcaatgaagtatataattcttatatctccaagtcatcaaggagagttgttgtaggtattgtttttttttacctgtactacaaatttacatatcctcatctagatgaaaaactccaaatctcgcatgtaggcctgtaaacattatgcaagggtcatcaatgcaaaattgtggataaaatagaaatcttatgacgattcaagaactatttatcttattgttttaatatttttgaatggctgcttctcctggctcaaacttgttaaatagtttgcagggtgatatctttgtgctcctgtgtttttaaaattaatcgtatagttgatttaataaaataatctgcctgttctcttcagaggctaccatttacaggggcacttattggatgcatggttggtaccatttatgtgtcaatgtttcttcacagctatttcctctcagtgatattctctgtccttcaggtgcgtccttcctctgaataaatctttttgacttgtctttatctttaaattttatagttattctagtctaggggatagtaagcatacttctgtgtctctaagaacaggctactagtggaaatcatgctttaaatggataatattttctccatttcttcaatactttaaatgtttgagttggatggggtgatctatagttctttgatagtatgatgcccatccctcctacctcatcccttcacataaacaatgccatgaagcatataggccatatcttcgtgagtaaccttcatctccttctgttacaggttctatctcttgcttactacaccatatcctactttcctgggggttccagtggattgaaatttatctcctcgagtctcttgtcatcagtaacgagctgttttggccggtaacctgagtaggatgacaactacttgatcatatatccttcatttttcttgcaatatttttgtatgtagcactgatcaacgatagagagattgtgacacccctcctactcatgcttgttgctgtttagactaagatcaatacggggtgaaaaggtttgtcgtacttatgtatctgaaggtcatattgtggaaataaagctgtcctttccttgtgtatgatgttttttttcttaatacgttggtgaaaatgaaaccgctcttctgctagcaccttagtgtaaactctccaactactacctccattttaataattatgtcgtctacctttagataaacgttaatcattcatcttattaaaaaactttgcaagtattaaaggtgttttgagcatgacttacatttttacatatttacactaaacagagggagtagtatctttagcacttcagacctcttcttttttctactaattttcgtctctttagtggggtatgtgtattaagagagcatgaagcacacccgcaggtttgctggtgtgtagtggtgtccgtttgtgtgtcttctatatacagagtaatgaaaaacataagcttgtcttaagttttgctcatcccttcccttctctatatgtgtaaaaaaattacttaccttcagcgattctttaagtgacgagggaatgtaacttgaagcgtttttttttttatcaaggtgcatattcggtcatgcattagcacgacttttcattttggactatgttttcttacgctttggactaaattggttatcctagtggcatgtgcattatggaagcaccgtaatgatttcaacagtgcctccccaagcatttctgctattttgcatgctgtggctagaaagggttctgtttggtgtattgctagagcttaagtcactccgtgtcatgttgtgtgatgttcttttgttttggtgattctagaggggccctttgatgactcagctgtacattgtctcttcttcttaatgaaatgaagcgtaactgtattgtgttttcgagaaaaaaaatcccatcactttagacagattgctagttttggtaacaaatcctacataaaagtgaaaaatataagtgttggtccaatatactgctagggcaataaaatctggtctaaattgcaattcatttttgaaagaagtcctacgtcacaaataataaaccttccaaaattatctttatcgtgaatcattaaagtttaagtatgaacccaccccctatgcttcactccttgaatctcaaatctcctctcatctctcgagaaacgggggcgtctagtctagtacgcggacgttcgcgggccactttttctactgccatcaaatttagaaaatccagaaaaaaaataaaaacaaagaaatacaaataacacgggtcactttttaaaaatatgtgtatatttttggcccttatactttgcttgaagtccatttttcaccatgaagcaaaaaaaaaaaggggtcatttttcatctggaactttttaggaccggacatatgcaagatcctgtaactcatttcatggtgattttgattgctatgccaatgtatttcaccaacatgaacttcaaaaacatatggtttatggttatggacctaattaatgtgacatctgcatcaacagaaaacacacaataagagtatcaaccaggaaaacacctctgttttaaacaaaacaattaccgatgttttgctttggaccaccttttattaccgatgtttcgctttggaccaccttaggactaatgttttcactttggactgggtattttttcctttatttcactttggaccacccttgctcttttatccatctacatccaacttgtaatatgtcgaagaaatagtcttacatatagctgtggcagttcattgacgagtaggagacgatgtaatcgagatcgttcatatgcttgagaagagagtcgggtggtccaaagtaaaacaaaggcaggtttacccagtccaaagtgaaaatattgcttaaagggtggtccaaaatgtaacatcggtaataaaaggtggcccgaagtgaaatttactattaaaaatatgtcgtaggttgtttctgtttggttttgaaagcttaaggtgaaaaataacaactttctaatcatagagtgaaaaacagactccgagtaaagttcatgggctaaaaatgtattttcggccttttgagcttcaataaaaaaattaaagttgagaaagatggatttttttcctagaaaaaataatcttgccaaaaatttaatattttttaaatgaaattgatccattgtatttttgttaataatatatatatatatatatatatttttgttaataatatatatatatatatatatatatatatatatatatatatatttcttgatttttctgtgaaaaatggagcatgtttgtatagtacaaggttaataccttgagtgatcttttgtaagaaaaaaaagaaaacttttccattttctttagctatgatattttttttgagattgttcttgatacataaatttattaaagcgttttacaaattgtgcaagcacaaaacccttccggttgtgttcgatagtagtggattaagagaaagtctcttttttcacgcgcacatcaccgaactactaaacggtattttttttaaaaaaaatatgtatgaaagttgctttaaaaaattatattaatctttttaagtattaaaataattaatactcaattaatcattaattaatggctaatatcattttccttatattttccatactctcatacacaccataaattccaatctaaatgagaactttagcatatgaaacatacggtcatatatagcatcatgccacatctagatttgaaaggacaacaagaactaaatggaaagtgttaagctctcaaagaggtatgcgccttcattcattacaagttttgtgtggtgatagatgatactacaatctacgttattcagttccttttgatttactacaatatttagcatcaaatatatcacaaacctacatatataaataagctataatattgcaaaactacatgtttagtcgcaaatttatctttaaaacaacatattttagagatgaaaaacaaagcatatatcttcaatgttgtggattcagtgaaaacctgtagttttggtgtattggcactcaaatctatgcttatgtgacaattctttgaaaatacggtagttctgtcaaatttaattaaaagagttttttttcagaaaaatagatgttatggttgaagctacagaaacaccagatattttgacttgacatataacccctgatgttgaggtcccaacttttttctctaaaatatcttatatgtattaatttaaattccaaacaatacggcatgctggtagatatttacttaatctttcatgtcaataaagtgtatatggaattttgaagtagatatttacttaaggaacggatttattaaaaaaatgtgaacgcctggtgttgaagcatcaacaacagatatacagtgacatctgctgcaactgtcactcactcccatatactgtacaattggttggttgttaaaacttagacagttgctgatgcactaacaatgcatgattatcacaactcataagcgcatcattgtacacatatacagatggaagttttggcttgactgcactcgcagaaaacaactacgattaataagctaaataaaggaaacaattaagagcgagctggttaattgctctccaacattatggccatgccgatatggctcatcctgctggcctccctcggcgccgtccatgtcgccgccgacgtcctccgactcgtcgccaccctcacgttcggcctgcgcgcccgtcccaggggggacctccgccgccggtacggctcgtgggccgtcgtcaccgggccgacgtcaggcatcggccgtgccatggcgctggagctcgcggggcgcggcctcaacgtcgtcctcgtcggccgtgaccccgccaagctccgcgacgtcgccggcgccatcgcccgggtccacttccaccacggcgtgcgcaccaagaccgtggtctttgacttctccctcgtctccaccgtgcaaggttgatggggtacacacttgtgtttttccagcaaaatttcagaaatctctgtacattttttgtccaaaattatttgaaaatttaacaaatttttaatgaatttaaataaaatttgaccaaatttacaataatttgaaaaacaccgaaaatttcggatatgtacttgccagtagggggcgaaattttgaaaaatttgtttcgaagtaggggcagatatagctaggtaggagaggtggggggccaggttgctcagtaacccggtcaagaaattttttttagctatagttcatctatttttatcatatgtgtaccctcaatccaaactcagacactcgtatcagtcaaaatttggtctaaagtagagtaaagcaagcgagtggcacctctctccatttcgttttagctccacccttgtttcaaagtataacataagttaatatttgtggttgcgttcatggtgtgtcatagactcatggttcatgagatccatcgtcttctccatatccggtgcgcaggtgagaaggcgatggcggcgctaagggagacggtggaggggctggacgttggggtggtggtgaacaatgccggcgtggcaaagcccggcgcgatgttcctgcatgaggtggaggtggagccattaatgaggatgatacgggtgaacatgctagccctaacgaaggtgacggcggcggtgctgccggggatggtgatgaggggcaggggtgctgtcgtcaacatcggctcggcgtcagcggaggctctcccctccttcccgctctactccgtctacgccggcaccaaagcgtacgtacccacacatgcatattcgcgttcttttcttgttaattgatactaaaggattgtttggttcaattcttgttgaatcagatatgttggtgagttctcaagaggcctctccgtggagtacaagagaaagggaatcgatgtgcaatgccaggttagcattaggacatggattttcatttctcgagtgaatatttttttctcgcatgtcacatatcaatagtcatcctagatcttgtttaattttacgcaatctaaccagctgtggctacctgaaaaaaagtgcctatataaagtgatacaacctaaagatcaatgaaactaaattaactaagctagacccaatgaacaatactattatgacttttcttcccctatctcctgcaggtgccatgcctggtggagacgaacatgatatcgagagccatgaaggatatctttctgtcgcagttcgtggtgaccccggaggagtacgcccgtgcggcggtgcggtcgatcggccacgggcggatgtgcgtgcccaacatggcgcaccgagtgcagctcctggggatgagatccaccccggatttcgtgttgaactggtaccgcctgcggctccacttgcagcagcgagccatctttcgaagccgcaggtgtcatcggatcgcgctcctctgacgtaaagtcagagggacgtgggtcactg

SEQ ID NO: 81130 - DNA, 19563 bp, Oryza sativa
tggttttattcggccatgtcgatatgccgagtgggtttccaacatagtcccggtcatcaagaagaatagcaagcttagggtgtgcattgattttcgcgatttaaataaagctactccataggatgaatacccaatgccgattgccaatcaattgattgatgcagcttcaggacataagattataagttttatggatagcaatgctggttacaatcagatttttatggccgaagaggatatccataagaccgctttcaggtgccctggtgcaatcggtttgtttgagtggattgtgatgtgtaacatcctgaaaattttgaatctggaatacggaatttaaaaattaagaataatcaaaaatctttttaaaaccttttttgcatgttgggatttattatgcatttgtgtgtatttaggttgtgtgccaaagatctcgattaaatctatctcctagagggacgccctcagtccaacgtcctttccttccattatcttcacggtctgatttattaagtgcttcggtactaaacaaatcacagacctgaatatataacccgaaaatcttttcttatgtcgcaatgcgacatatctttctcaattcttaccgtccggttatttcaaaccttttattattccgactcgataattccctcgaatacctataaacgatcgacgtatttatttatcgcacgttgattcgaatatcctcaaatccattcctaccgcgatgactggatttgtatgccacacgtcacccctagaatcctcccttcgctatcatcgttcgttcgtgcgagcactctcaaataatcctacgacgacctataaatttgtttgtcgggcgttaagcctaaactcctttttggcatcacggtgcatccatccaaacaaatcaagtctcgtattacaatccatttatcccgcccttgtgcattctcggaatatctataccgacccaaatccagttattgtccaagctacaatacaccatataatccaatccacatttacagtccaagtatatttctagtccaaacacagagccaaaatcaatatccatactctacagtccaaatgcacagcacattatacagtcccatttacaagttccaagtacagactaccaaagtacaaatcccaggaaaatactaagaactcctattacaattgggccattttcctctctctcccagcccaacgaacaacccagcataagtctattttaccttcccagagacgtagcagcccacccctgttatctttctcaagccaacccactgaaagtctactttgcctcccctgctcaaaacaacaggcatgcatgcacaagaattgctcgatgaaatgcctacaagcccaacagtagtttgcaaccacttttgccgggcacacaacaggaaattgcaccaaccatcaaatgtctgggacccccctcaccaacatgcaaaaccaacacacatacacccatacccccattccacataacactctccaaacacatgcaaacacagtgaggagggcccacaccgaaaaataacaccaagttcacagaggggaactcaccttgcctcccatgcagacaaccacaacaccaacaaaaattttcacaatttgaccctttgcaaaaactatttttacaaatgaaccgtcaccaaaacttatttcaaaaataacccttggcgctgaccaaaagagtcatttttaaaataagttttggcagcggctcatttgtaaaaaaagtttttgcaaagggtcgaattgtgaaaatttcagcaacaccaaggagcctatataaacaccaccacagccatgcacccctccatttttctcctcccctccctgatcaagctctgtaactaccaccactccgttccctcgcgcattggctgccacctctccgcttgctccgccgtggccggctccggctgggcctcagttgagcaagaggacaggaagtccgccgcgccattgatcagtctgagaatgactaactttgaacgactaacccctaacatctaacccttttgttgttctgttgcactgactcactaacccgctgactctttactttcagttgtcctaacctctgactcactgactcactgacctttccatttttgtttcgctaacccgctgatcctttcagttgtgtgatcctttgttgttggcaatcgaaagcgtagtgtgcgaggacgatccgcgagccaatcaccgacgctcggcgaccatgcacggtgtgccgctacccggctgccgcaaggtgtgcagcttctcctccggctcactctccccatcgcctccttccctttccaaccgccggcctcctcctctccacccctgtcgaactccatcccctcattgtcattggcctccgccactgaagccgccatcatcgtcgtcctcatcccagccaacccccaactccgcacttcacgtcgccatggcgccaggctaccgccatacgccaccctgccccgccgtgcgcgcggctgcgccaagccgccgccgcaccgcggtgcctccctcgcctgcgcacagcccaaccgctgccgcccgcgacgacaccccgacctcctcctcccaatcctcctctccctcgcgccgtcgcgctgagccgcacgcggcctagccgccttgtcgactctctccaccgttccccacatcaccgagccccctcccctctgtctgctgcgcgccagccccgccgccgtcgcgcctgaccgccgccccgatctctccagggccgcgccaggaccaccgccgcctccctatttgatactggcatccatcctcaccatcaagctccacccctccgcggaccctctccccactgcgacaatcctcccctccccatcccccaccgcctcctcccccctgcgcagccgcgtgccgccctgaagcgtcgtcgagcccggccgccggtctgccgcatccacccccgcgccaggccgctgtgccagctgcgccgccgcactctgccccgccctcaccgtgcgccgccccggcgccgtcgcccaggccgccgccccgcgcaccccaggcgccgcctcctgctgcgccgtcaccgcgccgacggcctcccctccattccaccccacgccgccagcaccagccctctccccaccgccgtcgaccctgttacatccggcacaactgatgacgaacaggaacaagtgtccaaggtcgttggctccgttctgagtacggcccagcaacggcctgttcgtgtaactaggcccaacccgaagtataagggtggaaactgggttaactagctgtatataaaggagagagagagaaccgggagtcatgacatgtaaagacagaattcccaactcaatacaaactcaatctctctctctctacaactctgtctttctctctgcttctcttcctctattcctctcaaactgtctctgattctctgaaaatatcttaccactcttccaagttggtaacatttggtatcagagccgcaatcctggagaaacctcggttcaaaactcgtcttcagatccaagtcgacgacatggcgaagcaaaacgagggattcgagaagactctgttggagattcaagcggcgatcggaaccatggtcgtcaagcaaggagagacataagagatgctgctcaaactggacaaatctgtggcggggtggcgacctcaagttgatgctgctgtacaagggttgcagcacgacatggaggagctgaagctgcatgtcctcaagttggagaagcagagcgaggagggcggcaattcgtcgaacacctcgcaggcgtcaaggatggcggaggaagggagtcaccaaactcctctgcttcctacgcccagcacgctgccgttgttttccggaacagcggcgagcgatctcggtccagatggccatcgcgtcacaaattttcaccgggggaaggcatcgggggtagttcatactctcgggccacctccggtcaagggtacgttccagattcccactaaattttctgttcctcatggggttgagtttggcgcaaattcgagtcggggaaatcgggatttgcatggggagcaagggttcaatcataggctaccgaagttggattttcctcagtttgatggttcggatccacagagttggaggatgcgttgtgagcattattttggggtttatggaactcatccaaatttgtgggttcggatagccaccatttacttcatgggaagggcagcgtcttggctacgttcatctcgtgctcatgaagtttttgtcgattggggtcgattctatgaagcgatgaaccgaaaattcgacagaaatcaacatcggcaactgattcgacagcttgatcagattaaacaaaccggttcagtgagcgagttttatgaacggtttgatgatctgatgaatcagttgttgacgtatgatcctatgtataacactttgaatttggttcaccggttcatagaagggttgcgttttgacattcgcgaagctgttttgttacattgtcccgaggatttggagtctgctctggttttggctctattacaggaggagttgtctgagcggaatcaagagcaaaggaaatttgtggatggatcgcagaagtttaaaaatgcatatccattaccattgccaccaaccaaggttttgaaaactgaggagaagaaaggcggagagctcaatcggggtactaatctttctgacaaggttagtgcacttcgatcgtttcgtcgtgcacaaggtttgtgttacttatgtgccgaaaagtggtcgccgacacataaatgttcaggaacagttcagcttcacgctgttcaggagctctttgcactatttcctgacaatgcaaatgaggatcaggctagcatatcttctgaagatagtgattcttccttgttagctatgtcagttcatgcagttcagggtactgattctcagtctaccattcggttacaaggaaaaattcaggggttgaatatactgatgcttgtagattctggtagtttggctagctttatcagtgatcaattggctgaccgtcttactggagttcagttcttagctcatcctctgtctgttaaggtggccaatggacaggtgttgcattgtcagaaagaaatgccttctgctgaatggtttgttagtggtcagaagttcttgaccacatttaaagtggtggccttgggaggttatgatgcaatcttaggcatggattggttaactaagtatagtccaatgcaaattgattggcagcttaagtctattcacttgacagttatgggtcatgaggttttgttgcgtggggtgcagtccgatacttctgattgtgccttgatttctagtcagcatttacagcatctgcacagtatcgactcagtggcaggtttggttcacttatgtgcttccctcagtgactctacagaccagttatcctcagttccagatgttgtctagtctttggtacatgaattctctcatttatttgaggaacccagtggattacctcctgctcgagattatgaccatacaattcctctaattcctggggctgtgccagttaatgtgagaccttaccgttatacacctgcccaaaaggatgagatcgaaaaacaggttaaggatatgttacaaaaaggaattattcagccaagtgctagtcctttttcttctcctgttttgttagtcaaaaagaaagatggcacatggaggttttgtgtggattatcgccatcttaatgctatcactgtcaaaaacaagtatcctcttccaataattgatgagttaatggatgaattggctggtgcttgctggttttctaagcttgatttgcgttcggggtatcatcaaattcggatggcagttggtgaggaggctaagacagcttttaaaactcacaatggtcattttgaattcaaggtgcttcccttcggacttacgagtgctccagctaccttccagggtgtgatgaatacagttttagctgatcaattgcgtcaaaatgtcttggtctttgttgatgacatcttggtatacagtcgcactttggaggagcacaagaatcatctgcgtcaggtgtttgagactctgagtaagcatcagttacgagtcaaattgtctaaatgttcttttgcacaaactcaactgtcttatctagggcacatcattagtgctgatggagtttcaacagatccagaaaagattcaggtggttcggcaatggccagttcctgtatctgttaaagatgtgcgcagcttcctaggtttggcagggtattatcgcaagtttgtccgacattttggcatcattagtaagccattaactaagctattgtgtaaggggcagccttttatctggacacaacaccatcaagaagcttttgacactttgaaacagagtctgatatcagcaccggtgttggtcatgcccgatttccagaaaatgtttgtggtggagactgatgcttctgatcgaggtattggtgctgtgctgatgcaagatcagcattcggtggcatttttgagtaaggctttaggacatcggactcaagttctttccacttatgaaaaggaaagtctggctattattcttgctgttgatcattggcgcccgtatttacaacatgatgattttttaattcgcactgatcaccgcagtctggcctttcttgataaccaactattaaccacctcttggcaatataaagcaatgactaagttgttgggtcttcgttatcgtattgtgtacaagaaaggattggagaatggagccgcagatgctttatctcatagatcctctgatggtcttccaattttaagtgcattatctgttggtttaccggattggttacaggatgttgtttcgggttataagtctgatcccgaagctcttcagcttttgcattcttttaaggaaggcacatgtcattctgctcattttgagttgcaaaatggtattctttatttcaagaaacgtgtttgggtgggcaataataggcagcttcagcagcaagttctggcaaatttgcacactgctgctctagggggccattctggaattcaagtaacttatcagcgagttaagcagctgagttaagcagctgtttgcttggccaggtttaaggcaaactgtgcaggattttgtgcaaagttgtgcagtctgtcaacaagctaaacctgaacatgtgccttacccagggttactacaaccagttcaaatacctgaacatgcttggcaagtcatatcaatggattttattgaaggattgccccgttcagcctcttataatagcattttggtgattgtggataagttcactaagtttgcccacttcctgcctttatcccatcctttcactgctgtgtctgtggcgcaattattcatggacagaattcattctatacatggactaccgcaggccatcatttctgatcgtgatcgagtgttcaccagtattttttggaaggaattgtttcggcgttctggcactcagttacaaatgagctcttcttatcatccacaaacggatgggcaaacggagcgcgtgaatcagtgtttggaaatgtttctgcgctgttttgttcatgcctgtccatctagatggagtaagtggttatctcttgctcaattttggtacaacacttcatttcattcaaccttgatgttgactccctttgaagcaatgtttggtcataaacctcgtcattttgggctctcagtggattctgttggggtgcctagtgcattggatagttggatgcaggatcgtcataatatgcaaagcttgatttatcatcatttggttcgagctcaacaacgaatgaagagtcaggctgattctaagcgtactgatcgcgtgtttgcggtgggtgattgggtttttatgaagcttcaaccttatgtgcagcaatctgtcatgactcgtgctaatcagaagttggctttcaagttctacgggcccttccagatccttcagcgcgtgggttctgttgcctataagttacaattacctgccaccagtttgattcatccagtggtgcatgtgtctcaattaaagaaagcagtagctgcctctgaagttgtttaatcaacattaccacgtttggatcctgattctgggcatctggctactccagtagaggttcttcaacagcggctacgtcgtcatggtgataaaatgattgttcaagctttagttcactggtctggtacttcgtcatccaccacttcttgggaagatctggaggagttaaggcatcgctttccttctgccacagcttggggtcaagctgtgtttcaaggaagggggaatgttacatccggcacaactgatgacgaacaggaacaagtgtccaaggtcgttggctccgttctgagtacggcccagcaacggcctgttcgtgtaactaggcccaacccgaagtataagggtggaaactgggttaactagctgtatataaaggagagagagaatcgggagtcatgacatgtaaagacagaattcccaactcaatacaaactcaatctctctctctctacaactctgtctttctctctgcttctcttcctctattcctctcaaactctctctgattctctgaaaatatcttacctctcttccaagttggtaacagaccccttcctgccacatccccacagccaaccgccggcagcaccaactccttccggcgcccctcgcccggagcctcccccacctctccgccctccttcaccgccgcgacagccgccgtcgctgcgccgtgcggttccccctctgtctcggctccggcgtgggtaggagagaagaagaaacgggaaacgagaggagagatcgagaaggagagaagagaaacggataagagagaagaaaggagtgggacccactaggggccgctgatccgcgaccagtcgcgcggccgcgcgcgcgcgatcaggtgcccccctctagtagtctagtctgatctcttatcctatggagtactactatttatatgtatgcacttttaatgtataaaagatacacatgtatataaagtttgtgtgtatacatataaaaaaggaataagtctacataaccccctaatgtactgttggttgattacttagccccctgacctaacaaaccaggtatttaaccccttaagtttgttaatgccgtttacttaaccccatacggtggtttttaacctgattttgccctgctggcactccacgttggacagatgggcatgcataaaagattcgagcggttcgccaaacaaacatacccccacgacttctcctcgttctctccggcggcgcatcctccgcctctgcctccccggcgagacgaagcgagctgatgttaagaagtggatccactttatcggattgcagagccgggcaaaggtgagtgtctgcaactcgtttttgtgtttttttttcccaatcagatcgttgtcactccaaggattagggctaatactacaggggtttttagtattgatattttgtattttctctctgcagtctagatggtgccatattgtgggtagtaaggctcatcgatttcaatgaatttcttgtggtaaattaattaggtgacttgacgattttagtgtttaggtctttatgtatccccgcgcgcccatcgatctgccgtggcaggcctatctaacgtggagtgccagcagggcaaaaccggacaaagaaaccactataaggggttaagtaaacggtattagtaagcttaaggggttaaatacatggtttgtaaggtcagggagctaagtaatcaaccatcagtatgttgggggttatgtagacttattcctataaaaaaatctaaaatatacgtgtatacaaactttgtatacgtgtatacaaagctggtataagtatgtataaaaaccaaaaaatacacgtatacaaactttatatacacgtatatacaaaatttatatacgtgtatacaaaatttgcatacgtgtatacaaaatttatatacgtatatacaaagtttgcatacgtgtatacaaaatttatatacgtgtatataaagtttgtatttgtatgtatacaaagtttgtatacgtgtatacaaaatttatatacgtgtatataaagtttatatttatatatatacaaagattgcatacatacgtattaaaaagggaaaacagaaaaatatacgagaagaaaaaaaagaaaaaaaagaaaaccgaaaaaggtacggaagagaaaaaaaacaaaaaaaaaggaaaccgtacaccggaaaaaacggaccgtacgcacgtcgtcgccgcctcctctccacgcgcgacacgtgtccagtcgcgcgtgggagggtgagcgcgaatagtcgcgtattagccgtttcgcccacgggaggacccacgttctagccccttcctctctgagttgacttccccctagaagtctacatcaccaccctatgctttagtataaaagccagagagatttttcacctactgaagtctacataatacccttcgcagagcctaccagtagccacctcatccactaaagtccacaacacaccctctatacaacccagagccttctcatgaagtctaaaccacctccctacccgagagtgcttcatcctccgtttataagtccttccaaacatcgaaaatccatatatttccaaccgtaactccgattgcctccattcaacttccataatccctctaaaatcgagatctatttaatggcaccattagttgtattgaatgttgctttattttatttcttttaggattgtgcgtggttattctttggttatttatcgaacgtaccggatatttatcgatcgtgggaattctagttatctaactgaagcagttatctcgaagacattaggaccgatagcaaggcaagtcactacgctcgaacatatcgatcctatgttacaaatgtgttgttttgcaaataaattgcatgctatttataaattgcatacctacatttgattatagcctgcccttgatattgattacttttatacatattgtacgccttttaatgccggagtcatttatttatatgcggtcaattattgaaaacgcttagcaatgctattgtagacatgcgtacacttcatatttacgctagatgattatggatgtgagatcactcgatgagagtgattgatgatttgcgggtggagacatgagtgccacccgccacacacaaaccgtttgcgaaaaccaaaacttaatacaacaaaacttcgactagggcggcaagaatagaatatgggtggttctaggaaacggttagtcgccgaccctggtcaattaaggaccgagtcaggaaactatgcaagaaacgaaccgagtacgaccacatttcaggtatgggcagacccgttagattaggacactctcgcaaagcggtacctcagtcatggcaagtgctgtatgtgagcgttgagtatagtgcagtgttggaaaggtaaatgacgtcaagaaatgaaattttaaaacacaccatagacaagtaattaggtaccccttatccctggagcgccaggactcccctcactatacggcagaggagttaggagtgcccgggtgcaatgggggttcatagtccttggagtaggtaccgaagagcgagagtgactgaaaaaccgggccgtggcgagtttcatgtgttgggactaggctcatgtgttgggcaagccacggagtgcgggattaaaagcgtacatccactgcaatgtgagtaaatcaatctattcgaatagccgtgctcacggttaatgagcgttgggacttgtattacacttgactagactcatagattttaatactgcatagagtaaatatgagagacatctgaaccttgcccaaagagtgggaaggttagtatagtagagttggtataagatgaaatgagagggtaaaccgaaccaagcggggcttggaaaggtggatgatgtaggaccgagatgtcgactagaggggggtgaataggcgatttaaaaactaaatgacacctaatcaaaactaacctaagttgctaggctcggtgagggttaagtctgactaagcaactaagttatgttttgcaaacctagggtgatagtggctcaattaattctctaggaaagtaaatcacactcctatgtcaatgttttgcaatcctagggtgatatgatttcaagaaagtctctaggaatgtaaattgcgcaaatgtaaatgcgacaatcaaatgagacaaggagacaagagatttttcaccgaggttcggaaactcaccggtttcgtactccccgttgagacgagcccaactccaccactcaaccacgaagccaccgcacgcccccttcgtcaaggagtgggcaaggcgggagccggcccacggagaggactacccaagcctcgatcactcggggtagttcttcctttactccgaaggcggtgaactccaaaccactcacaaaaccggcaccgggcctcctccacaatcttctcggagaggtcaccgggcaactcctccacaagccgtctagaaggcggcaacctccaagagtaacaagcaatgacctggtgtggagatgatcaatcaagtgccacactagctctataaatggaagcaatgcacttgactgtaggctagaacaacctcaaccactataatggatgaacactaagctcaaaggtgtgtgagagaggtgcaagggtgtatgcaattgaattgggtgccaagagagcccccttgctgctggagggggagtttttatactcccaccaaccaaaactagccgttgggggcgaaatcccccaactctgtgctctaccggtctgaccggaggtatgtggccggtcagactgtgctactctgcaacggctagaaaactagccgttgtagccctgtcagagggccccatcggcctggccggtcagaccgacatggggtggccggtcagaccgccctcggctcggtcagaccgccctcagctcgatctgaccgaatacgactccgtcggctctgtatcccccaaaccagagcatgacactcccagtctccagggggccggtctgaccgcgcatgtgccgccgttcagaccggccttatgcaccggtcagaccgccgtcttgtggtcggtcagactggccagggcacgccggtcagaccgccactatgcgcccctggtcaggccgaacacagtgaatctgtgtgtgatatgaaaagtgtgtgtgtcctctctaatcccattgtaattaatcatcaaaatcattaggggcctagatgcactttcaggtataccgttcggacagtgtgataccggttaggtatcaggtatcacgtgatacttcacaagtatcacctggtagcctgatacctgaacatgtatcatcccgtccgaacaggatactgtcatgtagcattttcgttttttatgctcatttaaaaatatttttgtcatttgtggttgtctaataaactaatttctgatggtgaagagcattttatcatttgactgtcatgcacacacatgtcatcccagacatatatcgtcatcactaaatatcgccgtagctttagcacgagcacattactagttgttattgggccgcaaacgcgctaggttaacgctacggagcacattactagttgttattgggccgcaaatgcgctagctctaaagcccaacatgcccgctggagccactaaaaaattgacgtgtacgtgtgctggtctcgccttctccattgcttcatcttcctctcaaatttccccttcgcgctcctgcgattgcttgctccgctcctcctcgctgaaaatctagggatatgatccccacctttttttcgccgcatatcttcgccagatctccgccacactttgtcacggtcgcttgtatctccatcctccaccaaagatccctaaatctcaaccccaatctatccactaatgactgaggagagagaagtcgagatcccatttggggaatgagcagtccaacatcatgaagaagaagtggaaggaaatggtgaagtatgacatcctccccgccaaggacatcatcatctagcaccctacagttggtgagggttttccgactcccaactctagcgaaattgcagtgttcaaactctttttctatcggggatttgggctcccaacccctggtttcttcccgtgcttgttatctttttacagaattcgactgtaccaccttaatcccaacactatttttcaactcaccatctttagtcacctctgtgaggcttttctccgcattcttccccatttcaatttcttccatcgttggtgcttcctaaagccacatccttgcaaagatcgaccctgtgttgttagcggcgcacaaaccaattgtggtctgacttaaaaagtcaatacttttcacttcctttgaaatctttcaacaagggttggcactccgagtggttctactgttcaaatcctgacctctctcttcctggcttcattgggctccctcctatccatagttcttagtggaacttgttgccctcagacaaggaaatggttgagtcaatgccatcattgcgaaactcacggacatgaggagtaaagggttgactagggtagtgtcgagggagtagatcccgacacaatattggtagagtatgaggatcattgataccaaggtatacacgagattaaggtaaaagagaccggagataaatatttttatacaggttcaggcccctgaactgataggtaatagccatactcctgtttaggggtgaaaatggggcggatatttcctgccggaccgaccgacctgaggcttgcgggaggaatatgggagagaaaatgggataccctatattatccgagttcaaacccgaatccggaaaaaaatatgggttaggatacgagaagagttatatccgcccgtatgtcctatattataaaacatatgtgaaaatctattataaactcacatataaacatgataaaagattagttaatcactatttttatgagctcacatgtaatattatataatttgttccttgatgtatcttttttagcactttaattgtcttcttacattaaatatccatgaattcgacatacaaaaaatatccgtacccgaatccgattcgaagaaagtaatatgggacaggatacgggatgagtgatgtgttatgcgacactacctgtacccgattccgaatttaaagtaagatgtaggttaggatatgggaatgttgtgatccgaccgtacccgtcccgttttcacccctactcctgttcgatcatagaagccggtgttgctcttatatatcagtatcaaatgagtacaatatttgggataacctattctagtcatcatcaacttggcggcatggatgtccaacacgtagttgacgacatggtagtcttcttcgtcgaatatgaactcgagattagaggttgtgttaggtccctcatgtcagcctctatggctccagattgggtctacctagacttgtccctcatgttggcaggtgttggtctgtgttgacgtctcccctctcctcctagggggtcttgtatttatacatatagatgctcccttgtccaagtagaattagggagacaaatatgtatatgattcgagtagcccttgtagcttccaacttgaactctacttctttcttatctggaacactttcgtatatgagacataattccctataagacttagtatatggtgggtcccgtcgagctcaatccaagactattgggtatgccttacctataacactgacaggtagatgttactcaagacatttccgcaacctataaaagaccgagtgcatcgaaccgttgattatgcaggtattgaagaccccactcgggagatatatggcaagtggtgatagccctatccgtccttcgtatccctccatattcggctacgtcatagagctacagaccagacttagcttgacagataagtggagagccggtgcccgaaacaatcaataaagttttacctttaactcaagtatattaattaatccatagaaatcctctctagcctaatcttaccattagttgttgtccttggttgaatcatgtttttagattatacatacacgttccacatagttcgatactcttttgaatactctaaggtgaagtgctacagtggtatcggtgcgcttgcggatttatgtgtgaccgtaacaaatacaaacagtcctgcgtgttgacttggctagttggaccaggtcaataagccacatcagcaaaaacagctaagggagtacaagtcaaacacagttaagggagtcaaattacactgactttaatagttggatcaagataatccggttaaaggatacgagtatacgagaggactgaaagtggacttattctcaggagtagatgaatagtactcgaattcggcccaccaccactacaccttggcctactaataaatactcctacagtatataagaggcaaaagaaaagaaaaggaatccgactcgagcggggtgaggatctaaagaaaaccctagcggcggcgattggtgcggcgggaggcggccatgtcccccaaaccgaggaaatcggtggcggccttgagcggtcccaaatcgtcgccggcgaggtcgactcggtccaaatcgaagccggattctgatatcgccgagcacgacgacagtcccaaatcgtcgtccgggaggttgactcgctccagagcaaaggcgattgaacaggtggggaatcggactgtggaggagtcggcgggagtgtcttcgaacaagaagaagagaaggattgaggaggagacggcgggggagtcgccggcgacgggggctccggaggggcatggcaccttggcgtcccggccactcccgccgacccacccgccgcctacaccccgcgtcagaaaaagctcctgcatcgtccggctcgaaggttttagctttcgatcccctccccaccactgttaatttcttctactttcaattttttgtatacctatcattattaaccatgttaatttctccccatttctcttcttcagttgctcgacttcagaagctaactctccggcgcgataagaaagatgatccctccaccgcggccgctttgcctaccccctccgacaagaacatggtgttgggcatgtctcgctcaattgtccgcgtttcatccccaccttctggtaatttactccatccgtcccaaaaatatggacacatcttagtacaagtttggaggcatgttcagattttactgcctgaatctactgtatttactgctaacttagctactaagtgagccatgtgctaggctgttagcatgccacgtgtggttaattgcgttgttttacgcattccctatctagcattacatcagaaaatcatgctgcatctccacatgggaattaccgtggattttgtgctaaactagctgcagatgttaagggaaaagccggtgatataaaagaaagctaccgagatagacatgtgtagtccaacaacaaatggaaatatgtgttgtttagtgtatttagtagcccaatacaaaatatgtatttatcggctcctagctatgtagctacctgctaatcaactgaatgtttttcagagggaaaattgatctctccgcgcaccggattcgtcgtcattgggatggagccaccaagcgtgctatgatcgtcacgctctccacttacttcaaaaagaagccgcatgagccccaacccgaggtgcatgtcttagctaatccccatgttaccatcatccgagttccataactgttcttattaagtaggggctaacccaattgctaaaaatgacttttcatgcctgccaatttctttaatttcttggtgcaagtgtagaacaccgatttccattaggcaatccccatgtttctatcatccgagttccattaccatttttgttaagtatagtatggtcaagtgattgctaaccgtagctgggctgctgtgcatttgctttgtgtgaattttaatgtgccctctgatttcaattctcaagcgttatcattgtcaaattgatggccttttcttgtatatccttagcatgagttccgtctcttgtgcttaagatgagtaaccattaacctttctttttctcgcattgccttctctctctatcttccattaacctttctttttctcgcattgccttctctctctatctttcagctgcaggttcatcttgcagataagtctattgtgcagggacggttgatattcatgaatcgccactacaatctctccatcttggagatcacgtctgacctaccattgcaggtccctgcttttgggtccgccccaaagtatggccagaaaattcttgccttgtctcgggatgaaaatatgtccctggtggcgaggcgtggagcaatcacgtggtcggatggttctttcatgtggagaaaccattacatgtttgtggattgtgatgttcctgaggtactgatacatttaccttttcttcacacttgctatttgttttaccttctacttagtggtatttatttattttttaattaatgcagggtggtgttggagggcctgtagttgacagttgtggtagtaccattgctatggtatacagagccggccctggtgcaattatcatttcaatctcaattatttgcaccttctttgagatgtggaagcaattcaggtatatactctttttccatcagtattaaaatatactacagattgaatcaaaatcgagcaatttctatgtggcacgtaaacccactgaatcacgatatattcttattaattgaatgtttatggataaatcttttatatctactatgttattagcgattttaaaagccaatgctgaaaaaactacgaaaaaacacctaaaatcaacttaaaattaagttttaaaattcaatttgctaaataataaacatggcctacaaaagtggttggtgcgccaacatgcgcgctcattttctcctaatagactaagtccatcttatctgtagcgctcattttctactatagactaaatccatcatatctgtatgctcattgtctactaattgactgaatccatcttatttgtagctgtgttgcccgccctgtgtttgatgtggatttaagaagtgtggaactagctggtgtgtcactccgggaggagctctctgttaaacataacatcaatggtggctttatggttaaacgcatagctgatgattctgctcttgagcatcttggtgttagacagggtgacgtgatcttttttgaggacgagtgcgggactaatttgcctgaggtgaaatgaattcttgtctcaagtaatagtttaatataaatcaatatttgtcaaaaaatgtgttgtgatttctatttttaaaattctggaacagatcgaagattatctcctatctcttggttggagatacctgcaggggatgaagtcgatggttctcaaggtctgatattacacaataacaaaaaataccactatttttttaaaaaaaggggtaaaagaataattaacagaactgcctttcttgtgtagttgctagtacatgacattgaaggtccatgtaaggagacaattaccttgccctta

SEQ ID NO: 81131 - DNA, 33354 bp, Oryza sativa
aaaaaaatgtcttgatttgcacacctcagagtcctgcagaacaaaaatgagtagaggtgccatatccatttggttaaatgttccatttggggggaattccacctttctggttctgttttgataaccaatgtggaacaaaacacatcctgttgattccattagatatattgcataatcaactctttatatttgttgattcgatatgcataggaaagaaaagtgtcatgcttttgcctacttgctacttttgtcctttgtctttgctcatgtgtgagaaattccagatatccaatatatgttgctgctccctggtccccagggtgctgtgccccctttctcatattgtgattagattgtttccattcaccggatgacaatggcagtcttggcatgtgaatgatgtcctatgcaataatggtgctttggtctctcatgggcattgattccatgcgcagtttgtgaaatattattgcacataatgttactaacttgccttgttatatggtattactggccacacaaaatggacatacaagtttctttcaagtttcaactcctaatcggccatctcaaggaacattttattgtgattatgccgtacattttctattgaagcactccatcttttgaatagagaaggaagtgattcttagctttggaaaatagtaatcatgatgccagtgatcagatttaatattttgaactatggctgcaggtcaagaaagtaatttcttcccattgacctaattgtaaacttactattcaaatccaattccagttccatattgctttgtgactgagcacacctgggttttcactcctaacaggtcgagcactggaggagctgaggggttcactctacaatgaatttcatacttcagaaggggccaagcgccagcagcagaggttttgcggaccaagtgttgcactgacattcaacttttttgttgctgtcgggatcatcatggcaaacaaaatggtctggatcatcttttcacctattctataattctcactacacttagtttttttttcttcacatggcatctcttgtctgtctggcaggtcatgggtgctgttgggtttaacttcccagttgcactatccttaattcattacatagctgcttgggtcctgatggcagtcctcaaggcattttacttgctgcccatagctcctccttcaaaatccactcctttttcctcattatttgctttgggtgctgtcatgtctttttccactggcctagctaacatcagtttgaagcataataggtgagattgctgatttgatttctccatttaacaaatgaaaaggcatatatgcactatagggatgtgctcaatattctgtgtcttcagtgtaggattttatcaaatggctaagatagctgtaaccccaacaattgtagcagcagagtttattcttttcaagaaaaaagtttcccttcgaaaggtatatttgctagagcttagaaactataagcttcatatgctgttcagtattcagttgatctaattgttctcacaatatttaaggctagttcaagtgtcaaataattcaaataagagttgttctaatcgttcgcaggttatcacattggctgtcgtgtcatgtggtgtggctgtagcaaccgttactgatttagagttcaacctttttggtgcttgtgtagcggtagcttggattattcctagcgctgtaaacaagatcttgtggtcaaatttacaacagagtggaaactggactgctcttgcgtaagttgtgatttttgtctgtttcggcaaaaacatattgcatatatccttttctcctaacattcaggttcttttatcaggttgatgtggaagacaaccccaataactgtgtttttctttcttgttttgatgccattattggatcctccgggcttgttgtctttcaactggaatatccagaacagcagtgcaatcatgatatctgctttgtttggttttcttcttcagtggtctggtgctttggcacttgggtgaggcatattatttctatcacatgattgttcttatgttctattggcacactttttaaacgtgagatgaaactgagagaaatacagctctgccaaagcttgttagtagtttatggctttatgctctgaaactttttaactcgcttgctggtgctatttgcagctagccaacaatatcttatatttcaaatgaaaaaatgttcatgcatgcctattgcctagatcattagacatggtagcatcacattcttcatgtcaaatagactcataaaattgaactgcaaggatttgcagtatgcctctaattatctgtttgtaacttcatgttacaactgatgattatagctgataggcacttaggcagtatgttgacatatagaatgtcaactgacaacagaatgcctatgtcaggttaacatcagcagctttgcaaaactcacccaaatttgatcccgaaaaatataggacattgttccgtccatttattggaaaaatgtagtttttatcacttatcctagtttgcgaaacctgtggaatgaacttaactatttcactggattttgtgtgatgcagcgcaacctctgctcttgctcatgttgtgctaggccaattcaagactattgtcataatgctctctagttacttggtatttaactctgatcctggattcaccagtctttgcggagctataattgctcttggaggcatgtcagtctacacttacctagggctgaaagaatctgccagtggtggtaagagagctccttcaacatccaggcaaaactctcatttgctgaagtccaaggttattgtagatggagaaaagccagaaacaaggcctattgattctgtttaagttgaagaattgccatttattcttgtatttttgaaaatccactagaagcattaggtgattgcatttgttgaatatttgttgtcaaccagttcaaccgacctctgagtcgcatttgttggttcttgctagctatgattcttgttttaggcgattttggtcagctattgtttgtagctgaccatgtccgttgtatatatagacacatattatttttccagtgttaagcaattttgctctactatactagcgtttgcgatgtcacttgggtcgtggaattttctttttgtgaatttggagaatgtatgatctgttgccctgattgaatttcatttcgttcaggctatacactgaattgttcttggctgtgtacatccgattggatgtagaggccgggtttatcccattttctaaaaaaaaaacactgaattgttctaactcactgtgttgctcttcaaggagactctcgtgctcatactcacaacatcatatatgctagggaaaatgtacttcaaaatgacctagaaaaatgtacagagcatggcatgctcctagctgttgtgagtggcaccagcaaagaatagtgttcaaatgcagcataaacgttcaaactccatttaaagatagatcaaattaatccacagaaaaaaaaaacggatctccagaatttaccgaagtgaactggcatgctcgagcatatctgatgagaaaggatataaaggacaggtcgagaaaaagttcagattttcattttgaaccagaaaaaacaaagtctgaagcatttcggtttgctcatatcctgagcacttggaacagcagcatcaagatacgagatattccagcaatgtttccttgtagaacctgacattaagcgctcacaacagcaatttcgctccaaaaaccggtaacgtgacaaaggcacgtcctgactaaataaataatacaagttctgaaagacaactgaaacatgcaaaatgatatcgagtgatctgaacatatgaaaactataagctctgaatacaatttaaatttttaaaaaaggaatatattcaggatgctgatgtttccagatggacaaaacgagatcatagagaaaagttttacatttgaatgtacaaagcaaaactagcctaatatatccaaatcctggatacaccaagcagaagaactagccaaatatatagcgatccgggaactgatgatgcatctgcattatcttaggttttgatgtaactgtccagattccgaaaaatgcaatgtcatcaaaccttttcaccaagaaatgatcttgttgacagaaacccttcgaatgtttattacaatgccactggcaatgaatggaaaaaggaacagtgaaaactgaaaaggggctactttgcagtgataggttatgcattttgcttaactcttacaatttgttgtaaagctgccagccaatatccaaccttaatgacaaaccagtcgcaatgtcctgtttcattcttacagttgcttcagagacattcagtatatagattgattgatgctaatatattggcgccgatatattctctcatttagcatttggttactagctttttaccatgagaatagtgaggaagactggaggaattaccaatctttgatttaaaggagaataaggactttaactcattaccccgagtcgatcgccttttaatatcacggtagaaattgcaactgatgttgtttgaggaatgcgaggaacacatgcaaattagttcattcctatggtgacagataaactgtcagtacatacaggtacaacaatgctgttatcctagttttcctatgaatgaatgcatcaatagctattcagcttatcatttgacctgcattaaggactgtaggtttctgctgggaagaaaaagtctagatggttaatcttaaactcaattgtcacttttccatgtatcgttagatttggcttctaatttagttatctagtttccaatcgtttctatttgtgtatcttccaaatggacatagtcacataggcatgttcaaacatacatcaagagcacaatagcaaatgaactgacacacctggtgttttgcaccttggatccttatctctgtcattccactgaatcatacacatagatggctgatatttttcaagctgatttgcacagatattggattggcatcctgatattctgcaggtatttcatcaaacatcataatcaaaatttccccagtagcacttctgaacaccacctgtgcatttccatagggtcacttcattgaactctgacagctcctcatgggcctcctttcatcagaaaataactgggtgattcctggtaggcattccacctcaaatatcagcttgagcccagacatcacttgctgccacaataatagcactgtgcatcagcatcaggatcgtgaaataaggcaatgtagcagtctagcactgcctgcaaatgagttttcactaacaacgaggtcacagaatcttgctatgaatgagctatgcccatattgaagaactgctttccatgccccaatgaaacgctagttaaagagccagtgtgtcaacattacctgcagtaatagaaagaaaattagtaagaggaaaagccctgaaagtacacaaacgcataaacatcatcaacccacaagaacatggcatttggcaccttaatacctgacttaaggcatcagtgcagatgaaatgccatcactagctggcaataatgaatccgctgaattgctttgctgccacacaagttttccaaaatatatattactttctggttttgacagaatatcccatttctcccttcatatacctgccgagaaatgacttatctatgcacaatgtttcgcccctctccactaggtggatatgtccttttttttcccgtaaaagaaaagattaggtgggctaatattagttaatattggccactcccagaaaaaaaaagtatattcccctatttccctattacctaggtaaataaattccattccaaatagtagcctacaaattgtcaactgagaaataactacctctctcacagttcagatttgaaccaggtcatattttgtttggtttgctaccctatcagattttggggttggatttggtgttaccaaaatttgataatagaagtatttgaggcatgtttggtctgttattttaccaaaatctgctaacagaaatggcagcaaacctcacaggctcagaatgctccctagaaaacaattctacacgatgactctatacaagaatgaaacgcaaatctgctttacaggttgtttaaatgtcacaatagtggcacaatgaatcatgctattacacaggtggagctcctgattgcgtagcagaaggttgatccgaagctcctgtttcaatctgatcccacatcttaaggcatggcatccatttctttcccttctctttcactaacaatgcgacctcatcaaatgacagcaatacatgaatgacgatgtagataaacacggcgatgacaagtgcaaaaatgtatgcagatgtcttgaacttcctgcagctgccggctgcatatgccccaaggagaccaagcaagtctaataccattgctgtcttcatggcaaggagtgatctcttgtacttgcttattgtgttgttcagaaggaggatgaccatgaccgttgaggccatgaatgctgttgcattgcaatagaagaataccttgtaccttataggatgggtaaccttgaggattgggtctcccgcataatggttgccttggtcactaggccaaagcccacctggagggagtagcccagcttggtatgtgacagtgactgcaagagttccaatcagcatcaaatctttgcgccatttgtgttctgttcgtttcttatcagtgcttccagttggaccagtcagagtcatggatctttgctggctctcaaaaccagaacggcgcttcttcagtaagtccactttttgttctgcaacttgtagaaccaggatttgaatcatgacatatgcaaatactgcagcgacgacaagaatgacgtagatagatgtcgacactctcctgcagcttccagcagcaaaagcacccatgagactaatcaaatcaaccagcacgcaagcgcgcaaagcataggacttcagacccttgtcacacagcctcttgttaacaagcaacagaatcactgccagagatgccatgaaagcagtggcgttgaagtagaagaaaatcctgtaacggcctggaaactcatcatggagcactggatcgcctgctcggtgacgatcgttgtcactccagaagccacctggtgggcttagaccagattgatatgtgatggaagccgctagaatcgcaagcatcatcagaaacttgcgccgcttctccaaatctttttcttcattttgcagctccaccgaatcacttcgtccatcatcactccccccttcagttcttctgaaacaaaatctcgtaaaacgatggaataagtttggcacatgttcaatttttgtcttcagttgagtcttgagagccatggacagcagaacatgaagcgtgaaataagtgaaaacaacaaggaccaagatgaacacatacactgacgttgagaactttctgctactcccagcagcataggcccccataagaccaaaaaggtctaatgccatggctgtttgcaatatgtgacgcttcatggcaccaacagtaatcagttgactctgaagtaagatgatgatcaccaaagatgccacaaacgcggtagcattgcaatagaagaatgccttgtagcgcttgggattgatggcctccaagattgggtcaccagcagtatgtccattattatcttgccaaaagccacctggtggatttagcccagcttggtatgtgacagtggcagcaaggataccaagcaacagaagatatgtgcgcaacttctcaacatcatccttagcagtatcggaagtgcctgaccttctgttgttcactggattttgtgctctgggagtagagcgcgattcttcagtaggattcctagtcccccgcatgatgaaagaacccagcttctgaagtaaatgggtcttcttttttcccacccattccatggaactctttatgcaaggtattggcaccatatgctcgatccactgaatacagaggtagaggaaaacagcaccaacaagggcaaagacatatatagatgtatggacttccctgcaactcccagcagcataggcacccataagcccaaagaggctcaccaacacacacaaccgcagagcatttgacttgacaacatgatccactgctgtattgctgagcagcatgatgatgatgacaagtgatccagcaaatgcagtggcattgcagaccaagaacgccttgaaccggcgcgggtagtgatctcgcagcaccgggtcaccggcaagatggctaggcttgttgtcatcaggccagaatccacctggtgggtttagccccgcagtgtatgtcaccgttgcagccaatgtggcaagaaccagcaagaagctgcgattctgttccagacgtttcgtcttttcagaatccccagtttctcccgtcttatcggttcctccatctccatgtatactccccagaatctccttccagtgtttccgaatcgtgtagaatatttcacacagccattgaggtgccagatgccggaagaatacgacatggagagtgatatatgcaaagatgccaacaagcaaagcccagatgtagacggaggtcctcacctccctgcagctgccggcagcgtaggcacccatgaggccgagcaagccgagcaccatggcgaactggagggaccggagccaaatggcgtcgcggctcagctccttgacgaggagcagtatgaggacgatgagggacgccccgaacgccgtggtgttgcagtagaagaagacgaggtacctcctcgggtagctgtacctgagcaccacgtcgccggcgtggtagccgtgctggtcctgctgccagaagccgccggggggccctagcccggcttggaaggtgatggccgctgctaggatggcaagcagcaccaggtacttcctcagcttccacaggagatcggcctcggagcccgcgtcgcacggattctgctcggtttggccttgctgcgtcgcttgtgccgaattagcagtagcagcagaagcgttggcaggagcatggccattgctcctgccattgcttgggttctctacagagctcatggagttgagctcaaagattccaagaaaatcttgggttttcctctgaagattgtagcattggatggcttgaagtcgtgcagatggagagatgaacttaactactgatggtttgcaagaagatggagatgagctgctatatgagcaggggtttgggtctttggatacacctccactagatagaagagtgaggtacaacaaacgataaaaaatgaaaaaggaacaaatccaagtcaacggctgtgattagttcagcgcaaagtttggattttggttgaaattggagatgatgtgactgaaaagttgtgtgtgtatgacaggttgatgtgatggaaaaggactgaagtttggatccgaactttggatctaaacacagccaacattgggttctcacttctcagccgtggaccagctcaaactggcagaaattattaatgtgtttggataatgagttaggctgtgtttagttcagcgcaaagtttggattttggttgaaattggagatgatgtgactgaaaagttgtgtgtgtatgacaggttgatgtgatggaaaagtactgaagtttggatccaaactttggatctaaacacagcgttaggagaggtgggattgggaaatggaaatgaatggatggattggatgaaatggagtgagaaaaatgtatggctaggattgaagcttaccctttaaggggtgggaaatcatatcccaaacccattatccagacatggcctattagtatgttgttatgtcattagccgtcgattaaatcacagtaattttactcagtgcagtctcatataaattgaagtcagtttggtggatcatgcaaacaggtctgaatctaatgtgtgcattagttcaaattcagaaaaaaaattctacatttcaacccagtctcaggagataatttggcaaattatgcacttcaacacggaaaattttccaaacaaaagagcaatataagagtcagtcaagtctacatactttattcaggaggcagtgtcttcgttgcttcttagtgactggactcctagttcgtctgctttctgccccctctttcttcctcctttccaattccccttttcactaaacttttaagaatatactaaaagttttcttttcatcattcagatttcttaattgtgactagtgagacttgatcagtactcagtagtatactttagttccaatactgcaacagctatgtgaacaaggaggcttctctttgttttaccagttgacttgacttggggacttttccttgatttctgtcgtgggggccatttcttcagcacacagacgattctttctaacaaccttttggtttttggcaccactagatgaaacaattatgacacggtttgaaggcccatttctgtctaaacaataattaatctgctcccatctaccattggttaggcaactagcttatctccatgagtaacaggaaagcagtttactataacaagtgtcttacagaaatacaacaaacacgccactctgatccgttgctcgattctttaattatttcagtataggtctttagagtgcaatccaagtcatgccgattttttgtatgtgccaaatacatttgcacgagttgccaatccccccttctctttagtccaaagaaaccccaagttgcattattgcataataagttaatactaattgcaatacgagattagaatagggacagtgacctgtttgttttatagtcagggctaacaacccacagttgccactagaaagcaaccttgcgtcgaagactttggcacctaagtcttccacctaaggccctaacatgaaaaataaaagcataaattggtttaaacctttttgaatccaattcttttgctaatctatgaccacgaaagaaccagagaaccctcccaaagttaccaaatgatataaaacaagtcctagtatatacaagcaacgaagcatcacagcagcacaagacgcaattcagcaaagagacgagcagctgggggtgggtggggaggcacgcatagcatacctggcgccttcttgaactgtgaaatgcatcagccaggccagcagcactctgcaggtcccagcgcttgcgccacgacggcccatggtggtcggcgtggcacctcggggctgggccgagaaagccacgccatcgccatgagcgtggggaaaaggcgccggcccatccccttgcacgcatttcgtcgaacacctaccgggtggaccgggggcaccgggcattttcgtcgagcacggagacccccggcgctcccctcggcaagcgcgcagctctcgccgagctgagcagcagccgcgccgcgccgcgcgctcggctcaatgccgcccgccaccgcgcctccgtacggtcgaccgcctcccaccgccaccgtgcgtgtgcgccgcgccgcgcgcgagatattagcgtcacatgacggcagcagttttgcgtcgcgagattagtagtattgatagcatgcatagcagcagtgtgccgcggcccgccgccctggcaaacaactgaatttctttaaaataagaggaaataactggcagtttgaatagctggaaatcgcgaatctcaaataagaggcaataagaaattgaatttgcaaacgaattcagatcaacaacataaacaaccgttgaaatcacttctttaagaaatcgatttaaattatatggatcgatatgtatttaagtaaagttgttagtaaaaaaaatgggtactaggattttaggccaccactgtcttctctttttctctatggctcttcttttctccaacaaaattaacttttggatactcatggcacactttttaaactgcaaaacgatgcgtttcgtgcgaaaactttctatatgaaagttgttctaaaatatcagattaatccatttttcaagtttataataattaaaacctaattaatcacacgttattaccacatcgttttgcataaaaaacttaatcttcatcttcatctgaagatctcttcaggacattcaaacactctttttgcctcaacattgctcctttcaacctctcgacccaccctacctacgcctgccacctttctctcaaaagatcacacccaatggcgtccatagctacgagaacgagttatcccttcttcttgccctctctcaattctcctcctcttcgctctttatttattttaatctttcgtggatctaggaatggcaaaagtcaggtatggcttgagcagatccaggtagctgaggtactgaggaggtgggaggacagaagcgaggctgagctcaacaatggcgaactcatttgttgttgtatctttgacccatgttcttccccagtttatggctcaatttgtgaggtgtgtgaattttgaactggcgttagagacggtttacttatcacgactgctgttgatgtctccaaatacatctccacatgcgaccgctgtcttgtttgtaaaaatgcaacatttctatgtttgttcgttaggaggcagttggttttctcgcatatgcaaacaccattaactatatgtaaaatttgttttttagtgcaaaggaataagtaaaactaagagtttgaaaggatttgctaaaatttcaggaattgtccaaaaatataacctaacttttcgttaatatgataaccatttacatttatggttatgaagataattattaacaccattaccatagaagttgatggttatgaatctttttccgaagaaatacatccaacctgtggaaataggtgaatggtgaaaacttttttgtgctatcactattacagtatagattttcctggatgttgccccccttttatttccatacggtaagtggaaccgcatgggaaaataaagggaccggcaccgggttgttatctgcacgggaaaatgcattttcccttgcatgcgtcttaatccgaccgcacgggataatcctcgttatcccgtacggtcaacttaagaggaccgcacggaaaaaaacgattttcgtatacgggctttttaagtggaccgcacaggaaaatacctcccttctttccctcccacccacttcaaatttttgacatcctctctcttccttttttccccttttatcctccctcaaccactcccctctctctctctaccttatctcttcccggcttcccacctcctccccaccttaactcctaccggcttcccctcctcctccccctcccctccttcgtcaaagcgggcgtcggcggtggccccttccgtgcacgcagcgaggcagaggcgtcgtcagccattcgttgtgcatgtcgtcaaggcagcggcggcgagcggggcggtggcgagtggggcggcggcaagcgggcagaacctcctcctggtcattgtcctcgtcatgcacgtcgtcgctcggctccctcgacgatgacgctgtcgtcgcgtgcgtcgtcaaggcagcggcggcgagcgggcggcccccgcccagatccggcggcggcgggcgagcttgacggtgatgacggtggcagactcagcggcggctgggggcgtgcggtccggcaggcggcgacgattttcacgttttttttatttttggtttttttttgctccgtgtgggcggtataatttgaccacacgggataacgtgcggttgggccaccgcacgtgaaaatattcatttttctagacccctggtttcagacgggaaaacctccacacggaaaaaatcaatttgaccgcacggaaaaatctatcctgtagtagtgtatatatagatattctgaaattgagtacccgtatatccgtatatgctatcgttctgatttcttttatttacgtgccaaacatatttgaaagagttgccccatcccttttcttaatttattccaattttagaaatcctaattgcattattgaataataagctaataccaattgcacacgagactaatagagggacaaatagcagaaggccaacgacccaaagtagcaactaacctttgcatcaaagactttgccacctaagtcttccattatatccctaaggcggctaggctctaacacgaaatgaaaacaccaattgcttaaagcttttgattctcattttttttctataatttatgaccacacagagaatttttttcgataatttatgaccacacataggaaaacaagtaatttcccacaatttgccaaatgaaagtatttcttttcctgtacaagcaggcaaccttcacagatcaaattaaacgcagttaatctagacggtctagaccatggtctagacgaacactgtgttaacagcgtcttgatcatgacggtggatgatccacaacgcgctcgtccaggcagcggaagagggtctacatcagttgcggcggatctagggcgagccggcctgttcatggcgatggatcctggttgagctcgttcactgcggcggcgagttgatctagatgagcgtgtccactatgccactatggtgagaggcagatccagacaagctagtccacggtggtggtgatggttctagggtgggctaggctgctaggttttatgttgttttttaaggttttgaaatgattatcgcaagtggtcctattaaggaaccacatgtgataatcattttaatcattttcaattatcggtaggactgtcaacaagccaagctcgatacaagctcgagctgagcctataaaatattcagctcgagctcgactaccgagcttcatttttaattagaacaatgtatattttaaaagataatcttttaaaaataattaatttatggtttatcatattcatagaagaggaaaaagaataaaataaatatatgatgcaaatacaaggcatacaaataacatatttaatctattaatttattaaatagcaaccagaaatcatatattactaggctcattagaagctcgacctcgactcgacaaagctcgatcgcgagctttgggacaggctcgggctcgactcatttggagctcaagccgagctcgaatcaagcctaggacgagtcaagctcgagcagttcgcgagccttgagcttttttgacagccctaattgacgatagattctcagcatgtgggaatacaatgttttcctaggtgttttgttagaggcgaggatgccacccgcctctacaaataaattttatccacccacagaaacattttccctagtagtacttggaggcaacacatactagcattcaatttggttgaaagtcctctcctggttccctttgaattttagtttttaaattttagcgattttagttaaatgatacgtagtcacgtcccgatagttacaaattttcatctgggaagaataataggtggcatggcatataggagcagaatttaggtctgcgtggttgcattgtgtctccctcattgagcgccttcagctagatacagggctgtacctaattaatacagatatgaaataaaataccctctccttatttatatgaaaatttgcatgtgtaaatcgattaagtacatgtttgagattagtataaactgaattgaactggtaactctcatcctcaaaacaaccttattcaaagtttaattagttagaaggacttagcactttaaatcttcagccaccccaccacaaactagccatgattactgtcattttggagtttccattccattacctttgtcttttctttgttaatgacaacttttatggattgctggtggcttacgtcagcacaattggggtcatccatattctcacatccatgaactttagtatggctgtcacgcatcagtggcgcggggaatgaaaggtgagaagaaaatataaactatgacgacgcagttaacctacaaccaacgtatcttatgcagcggctataaatcatcggccgggagaccctgacagcatcaactcatccttccattacattttacagtttctaagtttcttacaccgtgcaaattatggagcgcaacgacaatccactgcacgccggctctggccaggccacgacgctcgagggttccgaggggcgggaacccatcatccgtgccgggtttgctcgaaccgacactgataatggcggttctgatgtgctattctgtggtagtgaaatggaccacaacaatctgcagcccgcgggctctggccaggccatgacgacggaagcagacaataaccgtgcgtggcagctgcagaagtacctcatgctgctcactatcctagtggcgaccgtgacttacatagcggggctcaatccaccggggggcgtttggctagagaccaaggatgggcacctcaccggcaatcccatcctgccggacacccaacccacccgacactacgtgttctactacttcaatgcgacggctttcgtggtgtcgctcgtgctaatccccttcctcctccagccctgcgtgaaagcggcggcgcagctgaaggcggtgcgtgtggccatggtgtttgatctggtcctcctcatggtggcctacatcgccgggagctgcccggataggccaaccaccatcttcgcctcgctattgtcggtggttgtttttggatgcgtcgtggttcactggctggtggctccttcttccaagggccagctctggcttgacaaaccaaacaaggtcttgatgctactcgccatcttcgtggtgacggtcacgtatgtggcggggatgaggccgccgggagggacttgggaacatgcccaggaggcagggcgaagcgatgccggtgaacccatctggctagagcgccaccgagggcgcttcatggccttcctcgtctcgaacaccatcgctctcgtcgcatcgcttgccgtcgtcatgctggtcttgagcagcaggctgcggagaaacatgtcgtgccttgcacttcacgtgttcatcatcaccatggctcttctcgggctcttgggggcctacgtctcgggcagctgcacggagtggatcttcaccgtgcaagtcggctgcgtagctggtgctatagctgttatcctcccctgcatttcttgtcttcccattgttgagtgtcttttcggtggattcaagagccaacaccactcgttggcaggagcacccggtcgcagagtgacaatacaaccattggtgccaattgttccagtgggagaaggtgaaccagtaatggcaggaacaccaggtctcccccgaatgacacctacggaatcaacaatggttgtgcatagacagcatagtagtgaagcccatgcgaatccattaaacaatggccgctctatgatacttctactagccacactcacggcaacagtgacataccaggccggcctagagccgcctggtggagtttggcgggacaatgagggtggccacaatggcggtgacctgatactcctcgctactcatgctatccggtacaaggtcttcttctattgcaactcggctgcctttgtggcatccatcattgttgtgatcatattgcagagcaaggatctagtcaaccgatatgcgctccatgccgctataatactggaccttatgggactcatgggtgcctacgctgctggaagctggagagatattggtgcctccctatctatcttcgtcttggttgctgccatcattgtattgttagtagtgacctacattgtgagttgcaagtctctgactcgagggaacaatggaaatgtgtcgttagcggagcagaaaagaaaaagggaattgcagaagaggcaaaagctgttgctcaatcttgcagtactggccatcaccatcacctaccaagctgggctaactccaccgggcggcttctggatcgaacatgccgatgaagaacaccataatggagatccggtccttggtgacaaccaccgtggctggtacacggccttcttcttctgcaacacgacgagcttcatggcgtccgttgtcaccatcgtttccctggtgagccaaagcctctctgagattgatatggcgtactgcaaggcgctctactgctgcgtatttgttgtcttggctggattgacgggtgcctttgcctgcggcacctctcgaaggatgcaagaatccatgtacgtccttggctcggccagcctagggttaactcttgccatcctgtacattcaccgttcccatccaatggtcagaaatggggatggtagtaaccatgccgacgatgatactgagcttgttggcgatgtggtcactaatggccagcacatcacaacacacaagatgtgcaagtacctcatgctgatcagcatcctggcagccaccatcacctaccaggctggccttacaccaccgggcgacgtgtggcccgccgctgacgacggggaggggcacgccgcgggcgacccgatcctccgcgacagcgaccggtggcactaccttgcattcttatacagcaactccgtctccttcgcggcgtccgtccttgtcatcgtgctactactgagggtggtggtggtgcggaagctgagctctttcttgccactgatcacggtggtgcacgcggtggccgtggttgatttgctcgcccttctggcggcctacgcgacggggagcagcagggaccgggggacctccgtctacgtcgtcacggtggccgccacggtgctggtctacgttgcgatatatgctggtctgagttcacgccattgtggcagggaacaggatggcaatggaggggtcggctctcgtccgtcgtcgcaagctgctcgtgtttgacgatttgcatatatgctagatgcatgctggctcggctcgtttagtgctctacgttttccaattatgtgtgcttagatgttgtgctacttgtaagaaataaccatccagccatctgatggaaagtcacatgatatgtattgttgtgcttgctggaaatgtgtgagagtttgtatctcgatgttaactattattagttggagtcttccataggtgattgttagtttgtctcccaaataaatgaaatcagttttcatggaacatgttttagtagcaaatttgtatcaaatcggcggcttcggccacggcggcagcggcgtcctggtttccgggctggaaccttggcgatctctctcctctacctctcttcatacctctagctacctctcctagttctagaagcttccagaacttgtattccctagtttcttcttctctttttcaccccaaaacaatggttgcttgtatggtggatccttgctattgaattggaagaattgggttcctaacaatctggtatcagagtcgttgattcgtgggatttctatcatggagtcgattggagtgcacttcagcaacgcccccatgcgagtggttgcttgatttgggcaagggtggtgctcatgacacccatgttcgatggaatgccaagccagcctgaggtgttcaatgatgatgaaaggatatcagagactgttcccatcaaatccaccatgaagaaggagggaatatccatggacaaagctttagaccggcttcttgagaagtttgagttgatggaggccaaccgtaggcaagaggagaagttcaatcaaatactacataagttgcaagagatagaggcttgtaggagcaaggctgctgttggtatttgatatggttacagatagaatccacaagcgcatggatataccgatgcacttcccctacggagtattccaagggtatcgaatccaagggaatgtgtgtgatcagagcttcctccggttcatccaaagacaccaagaaaacgataggccaggatagagaggatttactagtgagaaatagtgtccagggaatcctaacgcaatacttcaggcactagcaacccgctgttcccagatgttgctctactacgtacccagacagggaggacttcagtgatctcgagggctgtcaccacctctacacacacctcaaacgtactgtgggatacgcagcaattactggataataattacctaaacaccacgtctaagcaattaatatctactttagtgtttataactcaccaaagcaatcaatatattttagttgattatagtgaacaataatcccgtacgctaattaggaactaaccaagagataattctcacaaggtaaatctaaattactccagaagaatattatattgaattcagagtaataaacagaataaaagaaataggagaagattactgacaactccggaattcttctgactccttctactccactctcttcctattctagtatacaatatagtacaatagagcctcttataattcagctcaagcttggaagtgtgtgtgtgtaaagtgagggagtgatgtctttatataggggtaggtatgatcgttggcgaaggggaaatgtccaaaatgccccgcaaccgccatcaggagatgatcaggaccgtccacgccaaaccccagcctggatggctgagattgtggttcggctgaaccagatggttcggccgaacctgggctgggcccatctggcctggctcttggcccatcttctcccatggacctcctctatccatttctcggagttttgggtttatttactggtatttggatgaagttcacaacccctccttgtatggatagatgattctcctcattgtagtctgattttcctcccaacatcggggtttattgtctgcatacaaatatataccaacacttgtggaatatgtgagattaagcacctatctctatgttggatgttttattatctgatctttatgcagatgttggcggtatagaatcgacatttaacagccgccaacaaaaccccccacacttagccctttgctcgtccctgagtaaaggttagtgtagaatgaatttcttcaagatatgaatcaagcatataaatcattcacaaccatacctgtacctgtgaattttatctgtggctatcttaccatcttgagtaattgataaatggaatgatcttgattccagtccttcttgattctctgccagactcaagggatttttatgaattttcgcaaactagctcttttcctcatattgactttctctcttgtctctcgaagatgtatattttctttggatcctcaccaaggcaaaatgtgccagaacttatccctattctaaggctaatatgtggagtttggtagggataaatcgggacatacctgcattatatatattgcaaagccaaagatatggactcaagaggatcatcagtcatactcctagatcaagggtctttatttgtggtggaaaatggaaaagtaaaatattttgtggaatgatgaattgaagaaatgattctccctttttcctatactttctctccaattgattctcttggcatgattgtggaagggacatggctatattttatatttttttctgcttttctcaatgtttgagagcaagctttatttccgtcttctcttttttatatatatatagccatgcctttccctccttttctcattttcttttggccaagagcttttccaggagaagaaagcatagttcaacacaggagtttatttgaatggatatttttgtggaaagccaacttccagtgtagaagcttagcttaattttatatgtggaaatgaaagtggaattgaccccttgatcataagagtatgaaggatatctaacaccagtcgcacaaatttgacaaagctcaatataatgtcaagcagtcatatgcattataaggttgatcattaatgtacttgcatatggccttggtaggtataaggtaaagtcatttggaggattgagcctttagaaacaattttattttgaaaacaaattcccaagagtcatgacaagagttgcaagaattcctttcatcttaatcatctcacataaaagaatcacttagatgtataaggttccctaatcatggttggttgttcacaagcacaagttcaactgggaataatgaatatacaagatcaatcacatgaagaatttcgttagttggaaattttatctttcacttatgcttgaatcaattgtttctgaattttcagctctagtactataccatggtggagatatacagatacaagacgtgttcacctacttacctgtgaaaattgagagggattggggctagctttggttcggccgaaccactctggtgcccaatttccctgcaattttctgcagagttcagtgcttccaggtgttcagatatttcaacaattttcagggcgtatgcacgtcagaagctgggatatctcccccacacttattcaaaacctgaattttattaaacataaaacaaaaacaaactttggcaaacattggggttaacaccaatgagccacattatttatagctagtgcttacatgattggaaaagataaaaccaagcacctactactattttattcatgggaaaggaaacatctaattagcataatacttattttcctttcccatatctatgaatgcacgcttgatcttagcgcacaaaccgcgactaagggtatcaaaactattcctaagttcagcgagttctacccctagctccgcattatgatccctaagctctatgttctccttgcggagtttcttcacttgagcggcgagcttgtggatcgagggctccggcgatttcacctcatcctcttggaattggccgggagcccttacaattggagggggcgtcaaataacacttcaccttcataggtggagggctacgggattcctctgccccctccttctccaatgccgtcaaaggccggagtaaacccttaccatacccatcgccgggagttcgtactccctgaatgcggaaacgctccccctttggggtggatggagtaacggtgggtgtggtatacttgtggagcacctcatcccctgccttggtgaagagggtacccacatagcgctcggcgggaggcggtgcggccttcccgtcatcttggaaaaggcatcgtgccttcaacaaaccgagctctcccgtagtcggccgtcgtgcaggcgaatccccccggatttttgttcttgtaacatggcaaggggagagggatcacgctaccaaacggggggccgatcggggccgagaagggttcggccgaacccctggttcggccgaactagggagctcgtcgatcggctccaaaattgcaggggagcctggcacagctgcaaggggttgagcccatacagcgttcaccccttccatggtgtagtgttctaccgggatcaattgattcgccggtgtcggctctccggtgaggtcgtatgtggaattggataaagagccggtgaatggaatcaaggatttgctagccattggtgatttggagatgatggagcaagggaattgggttgagatggagagaaaggttgcaaaaatgtgagagagaggaggaagaacaggggctctggtgctagtacgactgatctacctctgaactcgcatctaaacagactcaggacgagcgggggagactaccattcaaatccggggccgaaccatgaggttcggccgaaccctagtgagtccggcaggcccccaattttctgcctagtcccactaaaacttattctaagcacaaaaatgacaactatatagggttttaagcatgcaatggatgagatcatcatggttcataatcaattaattcaataacgtccacttcttcatctaaagtttcatttagctcaaggaaaatctttaggcgttgaccgtttaccttaaatatgtttcctgattcattgtggagtgtgattgccccgtgcgaagaggtgtcgatgacgtcgaacggtccttcccatttgctgcgcagttttccgtggccgaagagcttaaccctagatttgaacatcagtactttgtctcttggcttgaatttcttgatctttattcttttgtcatgccagcgcttcgtcctttctttgtatatctttgcgttgtggtaagccttttctctccattcctcaagttcagcgatctgcatttttctccattctcctgctccctcaaaatccatgttccaattcctaatggcccagtatgctctgtgctcaagttctatagggagtcgacatggcttcccgtaaactatctgatatgggtacattccaatgggtgtcttgtatgctgtccagtatgcccacagtgcgtccggtaatctatccttccatcctgttcccattttgttgaccgtcttttgcagaatattcttgatttgtttgtttgatgtttctgcttgtccactggtctgtggatggtaaggagtggccacattgtgtttggctcccatttctcgtaggaggtctcggaaggttttgtcatgaaataagaacctccgtcacttatgaccattctgggggtaccaaatctagggaagatgatttatgtgaacatcttcttggcatgcctcacatccgcggcgctgcacggcatagcctcaacccacttggagacatagtcaactgccaccagaatgtactcacagccgcgagacttagggaaaggtcccatgaagtctataccccaaacatcgaatatctcgacttgcaaattgtatgtgaggggcattgcatcgcgagcagtgattcctccttgcctctggcagctggtgcatcttctaacgaattctcttgagtcttcgtacattgttggccagaagaaaccactttgccaaatcttggcctgggtgcggaatgcaccgtaatggccaccatagggtgaggcatggcatcgttctatgatcttgagtccttcagttggcacacatcttcgtagcaggccatcggagcagacccgatataggtatggctcatcccatatgtcacggcgactttcatactttagttttcgttgattttcccctggtggtatgtacttggatactatgtagttcactatgttggcataccatggattggagtcgctaaccgtcatcagcatgtcatctcttaagaaatcattgatcggctgttcctacatgttagtgatctgcagcctggacaaatgatctgctatagaattttctactccctttttatctttaatttctaagtcaaattcttggagcagcaaaatccatcttaagagacgaggtttagcatctttcttagtgagcaggtattttaaagcagtatgatgagtataaattatcaccttggctcctactaagtaagatctaaacttatcgatagcaagaacaaccgcgagcagctctttttcagtagttgcgttattcaactgggctccggttagagttttgctagcgtaacagattgcatgatgctttttatctttggtttggccgaagaccgcaccaacagcgaagtcacttgcatcacacatgatctcgaagggcagagtccaatcaggaggttgaatgattagagcagagacgagtgcctttttgagaatttcaaaagattttaggcacgcgtcatcaaactcaaagggcgcatccttggctagcagattggtcagaggtctggcgattgtagagaagtccttaatgaaccttctataaaagccggcatgacccaagaagctgcggattcctttgatgttcacaggaggaggaagttgatctataacatcgattttagcacgatcaacttcgattcctcgttcggacactcgatgcccaagaactattccttcatggaccataaaatgacacttttcccaattaagcaccaggtctttttcttggcatcgttgtaagactttgtctagattctgcagacaatgaccgaaagtctttccataaactgagaagtcatccatgaagacttccatgatatcttcgatcatgtccgagaaaatagacatcatgcacctttggaacgatgcaggagcactacacagtccgaaggacatcctacagtatgcataggtgccatacggacatgtgaacgtaatcttactctagtcctcctgatggataggaatttgatgatacccggaatacccatcaaggaaacataaaaaggaatgatttgccagccgttccaacatttcatcaatgaagggtagcgggaaatgatccttttttgtagccttgttaagtttcctgtaatcgatgcacatcctccatgcggaattagttcattttgagcatttgtaacgatcgtcattcctcccttcttcggcacaacctggagggagtactctcggggtcaataggaatatgatgggtgcaaagtgcgagattaatccccctaaggtcctggagcgagtagccaagaacagaatgatgcttttccaacacggtaagaaggcgttgagtctcgtcttcagagagcttgtcactgattatgacaggggcttctttgtcattgtgttggaaagcatatcgtaggcctgggggtagaggtttaagctcgagcggaggtcgaggtggtggttccataattggtaggtcgagagtctcaccgggatctgcttcttccttgatgaagtcggggacctcatcttccagaagggcctcgggagactcatgaggaggaactgcagtaacctcttctgctgactcaatttctaggagagtgtcggtcaaggtgatccttgcctgcgagaatggaattgagaattcattctctccccgtgttattttgaggttactaatcggggtgtgttgatgagaagttgctcaatgggcagcccgactaggatatcaaagtattggatttcaaagacgtggaaatccaagatcgcctccctgtcttcaaagcagacaggcacatcttgcacaatcccaaatccttcgatgatatttccgttcggatgcttgaagaatttggttgtcggggtcactaccttatcgcttaaataagcgaatgcaaaagattcagagacgaggttggccccgactgttggactgtagagaatacctacgtcgttcccttccagatggcaaggaatgattcggggagcggtatttatccgaattactttggatgaaagctctgcctcccttagccattcgtcgctcattatggatgtcaactcccggacagtttcttgcaggaacccaagttccataggatcaggaggtgacaaaggaacgggtggttttctcttgctaaaatagttcagggtattgccgtagtcttcgtcaaaaccttccctgaacataattgtggcacaatccggaatctgaatttcttcattctcgacggacggctgctcaggaaccttctcattaatcgagctagtagaagtagatggttcagcaagtggctcgatcgttagaggcacctctatcttggacacggatgcctccagctggggttcattggactgtgtcatgaaggaagtgttttctagaatgtgatccaaaatcgtttttccttctgacggcgttttatgcatgaacgatcctccagcggttatgtccagatagaatgcagactcatccaaacccgtatggaaatgttagagaagcacatactcgggtaaggacagggttggtccggactgcactaagttagtgaatctggaccaagctgcaccgattgattcgtttttgatttgcttgaaaccgagaatttctactcgaagggcagtaatacgagtaactgggaagaaggcaagacaaaatctgtctcgcatcttttcccagctaccgtttacacatccaacggtggaggtgtaccattgctttgctctctcttgaagagagaacggaaacaatttccaccgcacggtttcttgtctcatgccacgaatcttaaggcatgagcagacttgttcaaagtctcgcagatgatggtaaggattctctagatcaaaaccagaaaaaggattttccttaaccatactaattagttcgggacgaatttcatagccagttgtataaatgggctccgatgaaggaggtggctcatagaattcgccccgaggagcagacagctcaaaaagaggttgctccatggtcgagaagagttgacaggaatacttctctaggatagcgggggtgaaggtagaataaaaaaatgaaaaaggatatgaggatgaactgggttcggaaatgatcagcaaccgttccccggcaacggcgccagaaatgcttgttggtatttggtatggttacagatagaatccgtaagcgcacgaatataccaatgtagcacttcccctacggagtattccaacggtatcgaatccaagggaacgtgtgtgatcagagcttcctctggttcatctaaggacaccaagcaaatgataggccaggatagagaggatttactagtgagaaatagtgtccagggaatcctaacgcaatacttcaggcactgtcaacccgctgttcccagatgtcgctctactacgtacccggacagggaggacttcagtgatctcgagggctgtcaccacctttacacccacctcaaatgtattatgggatacgcaacaattactggataataattacctaaacaccacgtctaagcaattaatatctactttagtgtttataactcaccaaagcaatcactatattttagttgattatagtgaacaataatcccgtacgctaattaggaactaaccaagagataattctcacaaggtaaatctaaattgctcaagaagaatattatattgaattcagagtaataaacagaataaaagaaataggagaagattaccgacaactccggaattcttccgactccttctactctactctcttcctattctagtatacaatataatacaatagagcctcttataattcagctcaagcttggaagtgtgtgtgtgaagtgagggagtgatgtctttatataggggtatgtatgacggttggtgaaggggaaatggctgaaatgccccacaaccgccattaggagatgattaggaccgtccatgccaaaccccagcctggatggctgagattgtggttcggccgaacctgggctaggcccatctagcctggctcttggcccatcttctcccctggacctccactatccatttctcggagttttgggttgatttactggtatttggatgaagttcacaacccctccttgtatggatacatgattctcctcactgtagtctgattttcctcccaacatcggggtttattgtctgcatacaaatatataccaacacttgtggaatttgtgagattaatcacatatctctatgttggatgttttattatctgatctttatacagatgttggcggtataaaatcgacatttaacagctgcctacagccgccgaggagatgattgcagccatcagggcaaccaccgctgtcctcaaggctacatcacctacaacacccatggcatcacctcctctagcacctaccaagtgtttgacggaatgccccaacaacaacatcacttgggtggcggcgaattcaaatcacattggtgagatgcttgctccaacagctgcctgggagctaggagacaggaaggacatggaccaagctccctacattgccaccaaggacctccccaaggtcacgcccaccaagtgttcgacgctatgttctagcttcgacaacaagcccgatctcactgtggctgtggtggttacttgtgccacctctgtcaagtcattgatggagttggtagctactgacagcaccaccagcggcacccacatcgacacccctgatagtaccaaggcgatgcccaccaactgtttgatgtttggtatgatggtcaacactggtaccatccagactggggttgtgttcccactctttcttgacaagctggacatcgtcacagtgctaagttagcccacgctagtcagggcacaaaggttgggttttgttttcttccttaaaatgctggcgcccggtgggtgttcgatgaaatgtactagagatgacaagttgctgatggagtatttcaacaaaaatccatggccaccaccttggttaggtggagtgtttagagtatgtgggctgaggcctttaccatggccgggattcaatttttgtaggacagtggaacatctagtgccaccatggccacctcccactaagtaagtgtctttctatggtaatttccaatattgtggtgcttcccactgtgatgatgattttagcattacattgggctggattaaaaccttggcctccaccccatgaagatgacctcacatacattttggtgaatcaaagagaagtggagttatggaggacaattttggttgatcacaataaggaaggattattgatgatcattgagttgtatgtcctagacttaaatgactgctgcttaagttggagtcacttgattcttgcaagtgtgcttgttgtggagctgagcagtactaggcagtgtggttatgagatcatttccttcaaaagcaaccatgttgacaagctgaaattatttggcatgtcaattaatgttttggaacagtgtgaacaccttgaaggggacttgatcagattaatcatcaaagaaaagctgatgccatggaattctggtatggggatctgcttgtgttgtctattggtaatacaacttccagttggcaagctaaaatggaatgtctctgtcatttcattgttccatcttttgattactaaagtcaacgagtttccaagagggatcacaacaggaggtaaatcaacattatggacatcttctgaatgcacttgtgttgggctgcacagaagatacccagtgttattgcctttctggattagcagagcagaaaaatgggttatgagacatattggcatgacaatattagttcctgaatcatggcagcaagcaagttacaaggtcctatatggtgcagagaagttgttaaatttgaatgctgaagataaaagttacacgagggtgaagagctttgaggaaggtgctagttcagttcaatataaggtatgtccttttgggctagttcctgcatcggtggtacttgatgatgtggcgtatactacttcaggaaccacttggcattacaaatgcttgactgataaaatgagaatgccgagagctgaagtgaatcataaaccaatgtggactcgatatttgagcaagcaggggtgtcactctttgcagcataccaaaatgttgagccttaatgttggcaagaagatcaatacattgctcctgctatatgtcacacaagaaagatttaaagggattgagaagttatcagccaggggagccaggggatatatcttattggcttgggacaagccaaatttaaagaagaggggattgtcatgtattgttgggttgatcatgagcttcgtcgactattctccaatccagcccaacaaggcccaactagagaggcaacaaagcagcaccaacaaggtgctaggaagccatcgaacagaacaggcatcggcggcttcggccacggcggcggcggcgtcctagttccgggctggaaccttggcgatctctctctacctctcttcatacctccagctacctatgctagttctagaagcttccagaacttgtattccctagtttcttcttctctttttcaccccaaaacaatggttgcttgtatggtggatccttgctattgaattggaagaattgggttcctaacaatctgtcacatccatcttactttactttcagccttctctagctcttactttccaggagaagattattggtttgtgtgccttatgacagaaggcggagacatgtaaaccatttttattatctaaaaatgcttctaaaaatcgatggtagtgctgggatattgttgcctcttgccattgagaaggattatatctcagttgtacaactactcgctgaaaaggacatcagacctggtattcctggttagagaagcaaaacggctttgttcgatcattaggagaaaggatcccccactcctgacccctatttctcctgattccgacagttcactttcggcgaggtcccgcaggagggatcgccaattcgccatgagaagagagctgatggcccatcctctcgtacttatttcgtcgaacatctttcgtgcattccggtggccggggcatttcatcgagcaccaaagcccccgggactcgatccccacggcaagcgcagctcccgtcgagctgagcagcagccgcgcgctctgctcaatgccgccaccgcgtttccgtacatcttcccacccggccaccaccgctgccacatgatgtttgcgcctcgagatcataccgctaaatgacaacaacagtttgcagtttcgtgcgggttgtggccggccgcgtggcacaatggtgcaaaactggctggtattctatctatttctaattgggaaaatacttatcgtgttgtgctagagttatgagttaatgactacacctattagaggaaggtcaatagtagcgctagctaccggtgacaaaaataccatgtcagcatgttgcagctaataatcaaaactagcccatacagtaagtgagctacactccatctctacatagcttccaatcactatgccggaccatgctagctgtgacgggcctaaaccatcacctctgacggattcagcccctcgacagagattagtggtcagtgatgactctcttcacctttgacgggtaaagggccgtcagtggtgaccagcccctatgacgggccacgtatagaacccgtcacaggtaactattatctcaaacggcccattagtttgtgagccgtcagtgatgtctataatccagcaaaaaaaaagaaaaatagattgcaacccgtcacaggtgtaaaaaaaaccctagcaagaaaattggagcacattgtcaccgcatcaccatcgccaaaacctcaaattgacaatatagcaatcactgacagttcatcatcctccatcaccgcatcaccatctcatatagcaatcattcacaaaaggggatggcaagaatttatcatacaacaatatcatatcattcacaaaaggggcacactggccgacagttcgtcgtcctccatgacgaaccagcgacgtgagatgcaggtggaggcgccaaacaaaaatcaagaaacaagaaaccaccattagagcccacattctcaaaccaaacacctcaaatcaacaacaataacaacaacaacaacaacaacaataacaacaacaagatttaagtaaaaaaataacaacaagaagaaacctcaccagggtggccggtggatagggatggaggaggtggtacctagcattcagatctgcgcatccccggcctcgtggaggtcggatccggcgggtagcgcggttggtggtggaggtgagggaggcgtcagtggcgttggcggccgggaggcagggggaggcgtcggtggaggtggaggcctatgtggcggccggctagcgcgggcggaggcggaggcgtggttggag

SEQ ID NO: 81132 - DNA, 3703 bp, Oryza sativa
  unsure (1)..(3703): unsure at all n locations
gttgcatttgtagcagcgagctccgaggatgacgcattgtctcggaaaccgatggaaaaccacaccgtgcaaccctccacgccatggtcgccatgtgctccgcgtgttttgattttgcgtgtttcttgagcagaaaatgcgtgccgccccagacgacaagctcgtgttttttttccccgttgggcttggcccattacgagccctcctataggctcggtgggctaaatagagcgtagagcccatgcaaaattcatctgtacatgtccgatgggtacgcgtatgcctgtagagtgtagagtagggataaaaacagagcggatacgggcggataatgctcataccatgttcgtttttatattttttgccatatatagaaacaaatacggataattttgaatatgaataagaattgaatatgatcggacacgaatacggaaataatttttttctcggaacacgaaaaccaactcaacttcttatagaaacaaatatcaacatatataattagctcattttatataaaatgtaatataatttataaatatattataaaaaggtaaataatattaatagtgtgaactagtgttaagatatgaactactgttaaaatctaaaaaagctatattaaaggtcatagatttataaaaaaataaggtatgtctcatggcttctgtagatatccgaataacactgttcactggatatccgaattattatccgtatccgatagaaaccccgataccatattcgtatccgtatccatgagaaaatattcgtattcgtatccgaactatctgggaattatccgatctgaaaggtatccatattcgttcttattcagagcatacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaactatagtctttttgaaagaggggtagtactaatagtatgtttatgcaacatttgtagttttgtactaccaacttgcctcctgcactagcctagctcacccatcccatcctcgagccaacgcaacaatctctgttagtgaaggccgaaagacagggacacctttcttgtattcctccgaaacctttacttgctcttgcaaaagaaaaagaaaaagacattttattttccatgtaccttcaccgtaattaacgtgtaccactacatgcatgcagtgacgacagtcagtagcgtgctccacgaactgcacccacacgattggtcgattcatttgaccagaacgggcaacccatcggccgcgaacagtataccaaatccagccatattaattaaatctcgctcttaattgcgaagcttactccattgaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagttttccaggttnctttttcccccttgggggccttttttttccccccccccaaaaaactcttctttttacgcagncgcagcaagcaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaatgggagggccactcggcgccatcataggcaggcacccggcggcggcgggcggcggcgggggggatgagctgggaggtgtcggcggcggcggcggcggggatggcatcattcggcacaaccggaggtgccgggatttggccttcctcgtgctcttcgcggccttctgggtcgccatgatcgtcaactccagcttcggattcaaccagggcaacccactcaggtgaggtgacccgtgacccacccactcgccttcacctctcctctcctcaagattcgccgatctgtgctgtcggtgctgtttaatttcggttccctgtagctagatgctaagagcgttcatccggggaacttttcctttgctgggtggtgattaatgccgcggtacattttgagctgttcttcagacagcaacaatttaccaagaacggagcattttcaggtgttacgggctatgttccttgttggatgtgtttgggtgtttagtgcataccttcgcattcttgttggctcatttttttcgcgcggatcctggtcaattcttcaacttgatgtgttattttcaggctttcagtctaattgaactgacatagagtgagaaaatgagggtgccacttgctactatggaacattcagatgacttttttttaggctattaaatactttaatagcagatcttgcttatttcggaatgaaacttctagctcccgactttgttatttgtactctgaatcgaataatctttgcttgctttgtttcaacctcccaaccggataggtaaagaatcccatttttgctttgcaggagaaaaatgtgcctttagtggttactcttatatattagagttgtgtggtccttggaattgtattccctccgaaaaaaaacttacagcccagttatacaggatntgtgctccctaaaggcaattcacactacggttatatattaatagaaaccaaaacccactactgagtgctgaccaaaagaaaatttgtttagggataaaactcagtgctgtgcaacttttgcatggctatcattttactattattcagacactatgatgagtaaccatactactcctatttagtacatgctgcatgtgtatctaagtaatacagatgtcttatattgttttgatgacacaggcttacttatgaactagactacaaagggaacatttgtggcagtaggcatggtgacccggatttgcatgagcttgatgttagatattggatgaacccaaaccaggtgcaccacagtggggtcaaggacaacaagattaaccttgctgatgccaaagccatctgcctgatggagtgtga

SEQ ID NO: 81133 - DNA, 6849 bp, Oryza sativa
agattttcttttctaaaagactatataatcctatacacttgttaaattttgcaggaaaaaatgtatttggagagtctactcaactgagcgacatgtaggacaaaaaagctaaacaagtcatcaaagaaaaagaactaataggtatttatttgtgtgatatatgattaaaatcagtcttcccaaaatgcataaactcaaaattacataggcacacaactaatattacatatgtaatttcagtggaataggactgtaactacctatattttcagattttcttttctaaaagacaatatattcctatacacttgttaaattttgcaggaaaaaatgtatttggagagtctactcaactgagcaacatgcaggacaaaaaagctgaacaagtcatcaaagaaaaagaactaataggtatttatttgtgtgatatatgattaaaatcagttttcccaaaatgcataaactcaaaattacataggcacacatctaatattacatatgtaatttcactgtaattggactgtaactacctatgttttcagattttcttttctaaaaagactatattttcctatacacttgttaaattttgcaggaacaaaaaagtttggagagtcttctcaactgagcaacatgcaggacagagcagctgaacaaatcatcaaagaaaaagaactaataggtatttatttgtgtgctatatgattaaaatcagttttcccaaaatgcataaactcaaaattacataggcacacaactaatattacatatgtaatttcagtggaataggactgtaactacctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacatgtcctatactgaatctaatgcaacatgtcattaatagtccacgcgttacactacaaccttcccaggtaagaatatttctagttatattaaagtacatataatatggatcagtaataacaaatattgcaggaagggcaacaaaacttcacaaggttgtttcagacaccaacagcatatcatgtaagcaaaaaaaaaaggagcattgcctatattttgatgacatagaaagaaaaaaaaattatacaatcatgcacctataaaaaagtatacatgtactaattttgttattactaacaatgattaattattttaatcatgcagaactcaatgatctttaacaacaagcagattttccccaaacttgggaacaaatcatgcactgccaagcattgaatggaactaccaggaatttgatgaaatttacaacaacagcagtcacaatacttatgaggtaatattaacaacaaatttttccaaacttattaataaaaaactcattgctgtgaactaacatttgtttgaaaaaaatgcagatctcagaatggacaacaattgaagatttgtatgaattgaagaacacacatttcaaatcacaggtatatatatatatggttcaaaaataaacagttatattgacaagcatagaaaaaaaatagttaaaattaattttgctactaataaacatgcagggaaaatcaagcagtttcacaaatggagatgaacaaccagcaatatacacaaacaatgaacaggtgaaattgaaaacttgacagtgtaattagtagatatcatgcattattcataatagagcttacataatagtactatttaacttttgacaggaaattagtctatgcatacaagatcaacatatggacaaggagaatggaactgctcaagaaacagttgaagaaattcaaatacagcaaacagagcaacatgagacaatgccagaaagcaatgaaacatcaaattcagaacctaacagcagagaagaactaaatgaagaggatattgataatttcttgagaaatgatgaggatggcaatacacaaattgacaaaaagcacatacctgagcttggaatgaaattcaaaacagacaaagaagctcatggcttcttcaacttttacgcttatttagctggtttttctactgtgataactcatcactacaagtcaacaagtaaaaagagaaatggtgagattacaaagtatacatatagatgcaacttgcaaggaaaaaatgaaccagaggacaaaaatgcagaacaagaagaagaagaacaagaagaagaagaagaagaagaagaagaagtggaagaagaagaacaaatagaagaagcaacagaacaagaaaggcaaactaatgttcttaaaaagactggctgcaaatgtatgatgatggtggaaaaaatgtttgccctaggagatgtatggcaaatagcaacactagatttgaagcataaccatgcactttgcccaaggagagaggcaaaatttctgaaatcgcacaagaatatgacaataaaggagaaaaggctaataaggacattgaaggagtgcaacatacccactaggagcatgattgttatcctctcatttctgcgtggtggcttgccagcactaccctacaccaagaaggatgttagtaatgttggaacagcaataaattcagaaacaagaaacaacgacatgaagcaagtgctggcttatctcagaaaaaaagaaatagaagacccaggaatatcctacaaattcaaactagatgaaaacaacaaagtgactagcatgttttggactgacgggagatcaactcagctatatgaggaatatggtgactgcataagttttgacacaacttacagaacaaacagatataacatgccatttgcaccatttgtaggagttataggccatgggacaacctgtttatttggatgtgcattcctaggtgatgaaacagcagaaactttcaaatgggtttttgaaacatttgcaacagctatgggagggaaacatccaaagactataatcactgatcaagacaatgcaatgagatcagccatagctcaagtgtttcaaaacacaaagcacagaaattgtctatttcacattaagaaaaactgtagagaaaagacagggagcatgttttctcagaaatcaaacaaaaacctatacgatgaatatgatgacattttgagcaactgcctgacagaagctgagtttgaatcactctggcctcaaatgatgagaagttcaatttgcagaatgtgaattatttgaagataatgtggaaaaatagagctcagtttgtaccagtctatttcaagtatgatttctgcccttttatacagagcacaacactaagtgaggggacaaacagcagatttaaaagacgagttggaccacaacatagtgtaatgagtttcatgaaggaatatgagaatataaatgatactatctttgacactttgtacagcaaagatttccaatcaagaacaaagaagccaaagaccttgtggttcaactatctcattgaagagcaagcatcagaactatacaaccttgaaatattcaagaaattccaactagaactaaaggaaacattgagtttgcaagtatcagtgctacaacaaggtaaagtttatgaagtgtttgtgtcaccaaacagcatacagaaagaatatagaccaaggaagcatatagtcattgttgacttaccaaatgaaaactatagttgcatctgtggaaagttctcaaaggatggaatgttatgctcacatgtcctgaaagtaatgttggacctgaatgtcagaaaaattccagaaaaatacataattgaaagatggagaaagaaggaaaggaaagaaacaaaaaagcacatcatgcagaaagaaaatggagataattcagtcctaatgtttaatgtgctgtctaggaaaggagctgacatagcttcaaaagcatcaaaaagaaaaagaacatatgattaccttgtagatgaacttgacaagttggagaagaacattgacttaatgattcaacaggaagatcaaactcaattctcacaacatcaagacagtggtatagaaattgcaaatgcagagcaacaagagcaagaaaaagatgttcaagaagagcacatagaagatcctgatacagcaaatacaaaggggagaaaaccaaaaaggtatagaagaatagtggagaagataatagaaagttcaaagaagaaaattgaagaacaagaagatgcagaagaaaatcagaataaagcaaggcaaaaaggaataacaatgaagaaaaacaaacagcgaattcagcaaccaaaggtaatgctgaaaactaaagaaatgtcatgtacaatgaaaaaaagataaaataatactaaatatttaattgcaggaaaaagaaaggcaacagaagacaagggaacaaacaagaagcagaaatcaaaacaaggctgaggaagcaaaagcattggagacagaaaaaaaagaatacatatatgacttttatagttcatgtaataggactgaatgagttttatatgtgctacataagtttctgtatgcatatcatatactatgtcaaatagaaaactataactttatgatgaaatatattctatatacacatttgactagacataaagctaaaaatgctgatgtgtgacactattcaagcatcaatagcacggtgattgcttggaaaccttgcctgcaaagaaaattaataatataaaacatatcaaaatttgataaataaaacaagtgtataaagcattatttgcaaaaaaaaatttgtggtgaaaaaaagaaacttactgaatcaaaccaattgacaccaacattttcaacttcggtttgcaacatcttgttgtttggatgaaaaaacatctgattcgcatactgtacgcggatattgttgatattttgtccagtgaattgattagaaagaataattcttggagaccaaatttccatgaacttcattgagaatatgcctgaatcaaaactacaaaacataacaaaacaataactaaacttattttgaattttttattacatctgagcaacaaaaactgaatatcatttgagcaaacaaaaaactgaatatcatctgagcaacaaagaatctactggcataattataaaattatgtcactaaactaaatgcagattttggtggtcaaaaaccaatcaaaatatcatcttccaaaaacaatacaacctacaaaaatgccaaaaaaaatttgatttctcaaaaatcagtttgaatttttttttgaaatgacataaacatgcagcatctaatatatttcaattcaattaccaagggataatttatcatacaaatatcaataaaatattgacagatttaaaaactaacctgtattcttggcgtggaacaggtgggaacttaattttaaaagtgctgaagttcattggagtgcgttcatatttatcccacacaatctgcaaattttttaactgcaattcatacataacaataaaaataattaccagcaaattcattcatatcaatatagttgttaaaaagggaaaaaagaacatggaaataaaagtacaggaaaaacacattaccagcaaaggcagaattggttcaaaaaactcatcatctggttgatgcaatgaatctaaaaacaccagcatcctatcttttatatcaacaacgagaacaaaccagtgctgaccatgtagtatagggaaaaaaagctgcaaaaaaacaaaaacagaaacaacccatacagtaaaaataatgaattacaacaaaacaaaataaacataattagaatagtaaaaatcaataccatgtcacaaaggtgtagtggccgagcactagcagctccaaggaaagattttttcactttttcttgatcaacaaaatcagggtcaagaataagttgtgcctagaaaagatatattgtacaatcagtttggggaaacaaaagacataattttaaatttttttacaaaaagatgtaatgtacaaatcagttagctcacttacaccaatggatgggaagaaataatgcttcttagattttgatggatgattgttttgaaacaaaaagcggcagaaaactgacatgacaaatggcaaaacaacaccagtctttttgagagaatggccaaagctagaaaacttggctctgacattgtcgatatcaacagcatcataactacataataaaaaaatgaataaatagtaaattaataatagatataaatgaacaacacatttttaagaaaaaaatcaaaaaaaaaatacagatggcaaattaatctaaaaaaatggctgtggcaatgtttctgatgcttctgctacttaacttgtaaacaaagggttcagctgtaaaaatgctattaactgagttcagtggatgaaatctagaatcagacaaaaaacatcgcaaatactctaataatgaattatgctagcaaaagacaaatcagaacatatcatgacagagacatagaagcaaactgattgataaataacagaatagaa

SEQ ID NO: 81134 - DNA, 33690 bp, Oryza sativa
  unsure (1)..(33690): unsure at all n locations
tatggaattaactaaaaaaataataaaagtaatcaccttagagcattatgaatgtataggaagtattttaataaatctaaaaataacttatatatatatatacacgtatatatatatatacgtatatatatacgtatatacgtatatatacgatatatatatatacgtatacgtatatatacgtatatatatataccggtatatatatatatatatatatatatatatatatatatatatatatatatgataatttgctcaataaaaaattttttaattaaaggacttttgttttgatataaactacttctataatatatgtgaatgaattttaggctttacttaatttacttttatatgtctaagaagaaacttagtgaaatctaaaagtaagttagacgtatcataaaagtaatttgtgattttttatcaaaatataataatgtgagatcttgttgtaaagatttaattattacgaacacaacggtataatcggattgtaaatcggatgagtaatttaagagaaaattttatttgaagcatagatgatatgaatatttcccctacttgcttaatggattaatagcaatcaaaactcctaaaatactagcacgtgggtgtctctagttaagactaactggagaggcctctccaattagatttaccgatagggaaggttaccagtgcaagaagataaacttgcctgaaaacgaagtgttttaccagtgcaagaggatcaacagtagggatgaaaacggagtgaataatttccatctgctccggataaaaactgatacggatacctttcggatcggatagttcggatatggatagctatacaaatatggatattgtctcccagatacgaatactgatatgttattggggtttctgtcggatacggataataattcggatatccggtgaacagtactattcggatatccgcagaagccatgagtcataccctatttctttctaactctataacctttaatatacctttatagattttaatagtagtttatctcttaacactagtccatacttttagtattatttcaattttaaaaaatatttataaactatacttcatttttatataaaatgagctaattatatatgttgatatttgtttctattagaagttgagttggcatttgtgtcctgagaaaaaaatatttccgtattcgtgtccgatcatattcgattcttatttgcattcaagataatccgtatttgtttccgtattcaagctatccgtattcattttcgtatccggtaaaaaaaatgaaaacaaatatggtatgagcattatccatccgtatccactccgttttcatccctagtcaacagtggtagcgagcttgctactgcagagaagaagatgacttgtttgtttgctgctattagtttaatgatgtgagctagagtaacaaaatctgtgttaaacttgttgtaaccgtgaagcttgatgacacttattattttcctggatgatttttgaacatttggtggtttgccaaggtacctatggtagtataaaaacaattttagcataacttgatcaattaagatggcaactttaaactacacgtacatgtcataccgttgggccttatttgtactcgatctcttagctagctctaaaaagacaatggaaaaggtactaatttcaccatcaaatacacaactaccatgcttgtcaaatcggggccgagtaaccgcaacaagaaacatcaccttctctatgaagtatatgcttttaacccctctttccggtcttggttcaatgttgatgaaatagtatttctagtcctgcattgtcctatagaactatttctcatcaatgtacacaatgttacgcactagcttgaatttaaattaagttcagaaatcaatcatatattgttaaggacgaaactgttgtgatttgattagttctgtaacatggagtattacacatcttgttctcaaatctgaacatgtattgaacattgcctttaacaatataggattgattttagaaattaacttaaattcaatccaatgcacggcaatgtgtacacagataaaaaaaaatagttctacaggacaagacagaactagaaatactattcaccaataatgtcgaaccaagaacggaaagagaggttaagagcaaatacttgatgttcattgttgtggttactcgacccaaatttgacgagcaagtattgacgaaaaatccgtgctcggtcgatggtgccggaactgtgttagcacgaactaagtcgacaacagcaacggcctaggagatctgctttgctccagtgtaggtccaaaaattgataagatacgggtgtgccagccagtttgatcctacaactgacaagatatgtaaacaacagatcaaatagctgattggctgacaagccgacggagtagttccagtcaatgctgatactagccgatgccaatagggttttgagcaatcatttatatgtccaatgtagatacgatataaagacaatcggctgatggtaatgtaacaaaataacaatataatccggtagaaaccaatcagctaatagtgatatgatagaataagcgacctgatccaaaggttaaagcatacatcggctggaggtctgatgtcataaaatccacaagattagataaacattaaaacctttgttgcgattggctcaaaccgacttatatgtaatccttgtaagccgatgcaacgtccatataacttatcggctgaaaccccgatgaaaccgttactataattaaaaacaggttagcctttatgattctaagcacagctaggaatgatgcatcgcggagtatgcaaagaagcataaagtctaaacaatcaagcatttgactaatttttagggtggtgaatatcttagttaatttaatctagctagataatttagccaatactaacatagaccctaaaatgaatctcagctgatatgatcaaattaagattctaaactagattagctaagatatatgataaatatgtagggaaatatatcaaccgaaccgaagcgatccaagagatcgaagcgatgcagccttgaagcacaccaatgtagccgatacaattgtctgggccgatggaacataggacttaccccttcgccggagatcaaaagctaatgcagccccgcgtcaggtgccatcttccactggatgataagtaaaatcctcggaaaagagggtggcgatgcggcgaaagtagttgtattgatatgtaagatagtttacaatgactccatgtgtacatatttatacccatgggtagatacttattggacaagaaagaaactttcctaaaaataaaaggaaactactaaatcctacctaattaatagatagaattatgccgccatgccatagtcttcacgattctttcttaaactcggtctcttctagggaagtttcaatcggctaaatgtgctcttttcttagccgaatccgctaaagaatcttaccaatttttggtgttaacaacaaggtaaatatgtatttgatgggaaaattggtatgttgctctccgtttatgtagaaccagctaacagatcaagcataaacaggtgtcacatcctgatttttgtttcaggatttataaattatttaataaattattattataatttatattaaatgttcattaatttacaagtgaagctaaatgtgggaaataaaatttcctaaatataaagcatggatggatttaatttttattaaattcttcatggttaattatactctctggaattttcttggatttttttcggagctcaattcctaattttaatcttacaaagagcatttcagtaattacccacatattaaattaattattaaatggtctaattataattttttttaagtactttgagtgtccaagtattttcaggatttttcttgaaattatttgagcattggaagtatttttaacaattcaaagatcatttaagtgattattttaattggaaaagtaataaaattctcctcccttgtccttaggctgaatcggcccattcctttccttcctctctcttccgccggtccaacccgagcctgcatcctctcttcttctctcagccaaagtctggtttagctccctcttctaatcaggctgagaaaagaaaagcccggcaagaagtctacttttcctccctgatatactgttcatcttccagctcaggcagagcccgagccagccgtgccgtgcacagtgccgccgcctcctccttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgatctcccgtgcctcgtagcgccgccgccacgtgctccaccccgccatcgtcgccggccgagctccatccgtgtcgcgccgccgcctccgccgttgccgccggtcgccgtcaccgccgtaaggtgcgccgaggtgtgggcaagctcggccgctccctccccgctgtcgccggtcaccgcagctccggcgccaccgccgaccgaagccgcccccgccgtccacctcgtcgccggccgtcgtcgttcgtcgtttggttcgagggtgagtaccgttgggttcgtctcgtcgtcttctacgtgtacatgtcctccaaagtcgcagccgaccatccaatctccggcgaggtcgccatcttggtttggccattgatgaggtcatcatgacgtcatcatcgtttttctttttcctgtttttctaatagattaaatattcggaaattcataactaaatcatcgtaactcggttttgagtggttcaagttgctaaattcatctaaaatcatgatctacatgtttgtttactttatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaatacaatcctttgagcatgttgatcctatatttaaattccctatttatttcaagtgtgtatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaataggatgaatcatatatactacattattatttatggatatatttaatggtagctcacgatggttaatcgtgttatgataattaattggtaattaaaatatgattaatggtgggttgtgagcacatggttttgaaggtcgtgttcatggcaattaaggaccggttcacgagctactgttgttgtgaaacattaatcgtgccaaccacaagccagcgtgggcaacggctttaccttttgtatagcatggttcattgcggagcaccagactgagaagtggcggagataagcccatgggggtcgctggggagtccatgccttgttttataagggggtgattatgatccaggaatggtgcactgtggtgagttgtgttgtacagagggtattgtcacagcctctattcgggtaccttctagtatcgcgacacatggtagacatgatgttgaggctgtgtcttgtgggtacagtggtacacctctggccagagtaaaactattcgaatagccgtgtccgcggttatgggcgagttgagcaatgtttttcgtgattagtctcatgcctctcacaataattattgatgctataactggtaataatttgtttagctcctggtttagagttagatctgtacagccgggtatggttgttcagaatggttgggcctgagcagcatgggcgtgttgttcagtgttgattgaaattaatgattaaattactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagttgcctgtgggagtggagctgaagccatcgctagaccgttaattccgctgctgtttttcttttgttttgtaagtatgtaacgttattattatgatggatttgtatattaaattgtcagtttatgtacctcggctgattcctggacgaggattttatgcacaaattagttcggaaattattagtgaatttccgggcgtgacaataggcctaaaagtatgacattcgtgtatattttaaatttgtgatcttaattgatcaagttatgctaaaattatttttgctaccagaggtagcttattaataacaaagacgatgatgtccgttactaaggaaactagccgataattccttgacaacaaggttttgcctgcaatccaggtaaagtggaaagccaaaggaagaggaatgtccaaattactccaacaagacaacaaaagacgcacattgacgtaaaacgatccaaaattgtagaaattcctcaaatagatgggtggaacatatgactaacatgccaacctccgaactcacctgatcttaatgcactatatctttttttacaacaatctaggcattgttttagaacagccctcctaacaatattgatcaaattgtaacaaaggttgatcaagcatatcgcaagtaccctttggaaagggccaaccagattttcccaacccagcagggttgcgtgatggagatcatgaagcataatggagggtaacgctataacatcatgcacatcaagaagaatacattgaaaatgcactgtaatcttcccataagcttgttgtgtcctatagacctatacaatcaagctgtgcaattcatcgattggatgaagtactgaattgccactgaaatactctctcgtagaaatctaatgtttccaaggtctgaaatcaacaagttccgatattgttaggttatgcaatctaatgttgtaagcatggagtgctgaattgtcactgaaatgtgctatacatctaaaatctgaagttgtcaagttctagaattgataacttctaaaattgtcaagttatgtcatatgaacttgtgaacatgaagtgttgaattgtcaccaaaatactctagtactgaaatcagaagttgtaaagttctaaaattgtcatgtcatataatgttgtcaagttctgaaattgttaagttctaatttttttaatttctcaaatctgaaatctgaaactgaatttaaaatgaataatgaatgaagattagatgtcaagttctggtttctccctacttgacagccgaacaaagtgcaaaaagtcggaccggccatcgaattggtcgagcccttggtttgaccgtctggtcatgcagttcgactacagaaccgagccttcatttggtgtgaatattgttcactaattaggtgcatgggtggtccctaattggcttagggtgagtttgtttgcttgcattcctttagcctggcccatctctctcatggaatcagagtttaaccttgatgaggagatactgtttggttgtttccatctgtttagtttggctgggatgagattttgtttgattacttgcatgatagatactgttgggaagagattttgttttgttggtcgtatggcattgagcatagacctcttcatttagttgggtgagcttacctctacaatatcatatgacaagtttatattacctctactatatagcaatagtgattctccatataattgatttttttttcaattttcatagtgaaattggtagtaaaaaatagacttcttcaaaaacaagtttataagacgaaccggtcaactaatctgtaatttattacctgagaaaaacaaataaaaaagaaaaaaaagaaaaagatgggaggtagaaataaaggggatcgtctatagatggccatatggcccgagggcacgcccaaggcccggtgatttggcctggcccaggcaccgcaagactcgggtcatgcccgtgccggtccggcctaacagccgtgccgtaccgtgcctggactgctatctcggcacgctgggccagcatggcccggcatgaagtttagggatgtgaaacaaacttattttcaaccatatgtaaggcacggtacaaagaatatagtggagaaatagatatattatatggcatggcccaaagagtagggacgtacaatagacttattttagctatatatatgtcaaagcccaaagatgagggacaggaaatagacttattttaaacaatgcacgataggccgcccgtgcctttgggccggcatggcacggccagactactggtgggctgtgcctgggcctgaggtgcagcctgtgggccggcacgacatggctcgaagtgccggctgtgccgtgctggcatgatcatctcgggccgggctgggccgagcgggccttacgaccatctatgggatcgaacgtggtgcctcgttgtcattgccgtcaactcgcctcgcatccggtctctctcctctgacctggcatctccgacagggcctcctacgctcaccgccgtcacggtagtaattggatcctgtggcctcctgctccagcctccaggccatccaatttggtgcctttggcttccaaggaggagagggtggtaggagtgaggaagaagaaaggtgaggaagagaggaatctgaggtagagaaagatggtgtaggcccaagcggtgatgaccacagccctacctccttgttcccttcgattgctgctcctccaagactccacccccaccactcacgaagcagccagatctgaggtggcacccgtagcacctgctgaagaaaacaacgatggaggcgtcgatgacttgggaggagtcaagcatgcaaatggggtgagggaggtaaggggatatgcgacccctcttgcctactgcacgcgcgcatcccgctctatacatgctcgtccctacgccaacatggcctcggcctagacgagaagtgaatctcaattcgagcgttcccctcgggcctggctagagaagcgattttgcacgcatagagtcagccgtggtggctttgcaaacacccatccactgcacgtgtggatgtgagccaaccctagtgtaggtaaccaaacacacccttagcccataggtggtgactggtgagctagtggggcctagtgggcaaccatggttcgacgcatgcatgacttggggcctagtgggcagcgtctctttctagccgggaccatctgctcgttgggaccacctgttcagaagcctctgattcactggcttttgaccaaaaattatccggttcatccgagatagcttggtggcggtggcggtgcctgggtctggacggcggcggcgctcctgctcggaaagatggacacagcaaaatctccccgaagggctggcatgcatgcatgtccacaacattagagaggtccctatgaagctacacatgcgaatgttgaatcgtggctcaccggagaagaagataacgacaacagcgacggtggccgaagttgagaaagaaatgttagattaatgggctaggcccaattaaatcctaataaattccattggcccaccttgaaaatctaagtgaagagatctcaacttaaatacggagctagtggagagtctatgttgattagttgagatggtacgctgacagccaggtagggcggggagaggcgaggcaagctgctactgctgttctctctctcgttttgtaacggacggtaataaacacggagaattgagatgttcttccgactcttgcacttcgagttcctgcttgagaacttgcacaggtagcgcttgcacgggagcaggaacttgcacgggtagcgcctgcgcttgcacgggagcagaaacttgcacgggtagtgcttcaagcgcgactgctcctgttcttcgttcttcgatgacaacgttgcatcttcctctgcttctgcttcaccatggcttctattggagagaacggaggagacaacatcaatgaaggcaatacgaatgcctcaacatcttctgcaccattctctggatataagattctaattttattcgattttcttctcgttatttacatgttcacaatgttatccataggatttcaatcctatgtgaatgtcaacgatgtctatgcttattttaccttaaacatgctcatgtttatgtttagccttatcactagatcgcttctcattgtgtatgtcatgtttatcgtcttaatattttagattaaaatatatcgaattataaccaaatttccaacaagaaagagaacgatctccccattctttgcatctcccgatggggctattgaggggtaacggaaaggaggtcgaggtgatgaagatggcgcggtggtttggcctgcaactgtccacggccgccagaaacggtgatggggatgcggtggagtgcgctccagagcgtccgagtgcgcggttgcattcctgtttaaccgctgcatggaatagcacaaaattagatggaacggacacggcatcgagagtagatagaggaacgcaaaagaagaggaaatgaccgcggctccatggtgttggcaaccttcgtcttctcggtggccgacgatggagatgagggcgacggagagactgagggcctcctccctcagtttggtcggctctggaatgaagtgtgagcagaagcaaccgagtagggggaagttggaggcgagatcagccacggccacatcctcggacacacgtcgagcaccttgttctcccggcttttctctctcgcgcgtgtcccctatgttgagcagtgatggaggaaagtggagtatgatgcacagagaaggggcaagtctacgtggctgctaggtgggtccagcgcatgataggctaggatagagtaaggggtatggggtgggggattgagtgaaaatcgattttcagttattgtcatgattaattctcccctttactttgtaaattcaatagtttaatttgtgggaggtgcctagggatcggtcgcccgatccaaatctccaaaaatcgggcgctgatattagcatgacaacaggtatatgcaaaaaccactttaaactaatttttctcttaaattatttatccaaatcatgatccgattacaccattaaattcgttgcaattaaatcttcaaaacaagaccacacatggatatattccgacgaaaaaaaattagattattactgaatttttttaaatgttgcacgatgttccaccaggtatatcggaattgtttcactaagtagatcgaaaatatttcaatcatttaaatcgggcgttgtttcaccttatataaaaacaatgtttcagcaaatagtgaaataatgtttcagttcactgcaacatttgatccatacatagtgaaacattataagtacactaggtgaaacacttttggtggaacaaaaaataaaccaaattcccttaataaagggtttccaaaatatttgggtgatttgttgcaatggagtatttcagttcactgcaacattagatctatacatagtgaaacattgcgagtgcactaaatgaaacttttttggtgtaacaaaaaataaaccaaattcccttaaatagagggtttccaaaatatatggatgatttgttgcaatggagtatatgctggagacacgtggcaggtgggggcagggactgtggtgaggcccaggtggcatgcacgcgcacttgaggtggggggcgggggcagcacccgatttttgctccccccgcccggtcgaccgatccctgtcattctcctaatttgtgggtgggataaattagagttttttagatagatgatggtacctagattccattttctttggtttcacacaaaaattatgtgtagtttgctctcagaaaaataaagaaaagggctcggtagaatctagtttaaatttttaggaggatcaaactaaagaaataaattctgcaaaaattatatttatttatgataattaacctagtatttgaataaattattttccttatacttatttatgcattttaattcacattttggtgaggtaagattttaaacatttaggccccctttgattcaaaggaaattcataggaattttaaaggatttcattcctatatgaatatttcctatatagctctttcaattaaaggaatgaatcctatgaaatcctataaattttctatggaatgcctaatgccatgcaagtttcggaagaaatctagcatgaggttctacctcatggaaactttcctatgggtcttcatctctcctgtaattcctgtatttttcctgcggtccaatcaaatagtcatttatgtgtttttcctgtattttgcaatcctctatttttacccttgtattcatatcaaaatcctgcgttttttctattcatatgttttttcaatcctgtgattcaaatggtcccttagggtttataattaatctagtattttactggtttgacttattaacttaagtgataatatttgaccaaaattacagcgaatacacactggatagtatttatgtgaattttgttctaaagatttttagaatttcatctagtcattcctttatatgtgttttcatttatagaaatgcatctgagcaattttataaaatttataattgaacacttcttgctctgagatggtgttatttaagcttagtttcatacccaacatgtacacaaggactcaaacctagccatgatatgcatatgcttgctcgcactaagtttgtaaaatttcattttgggttggagaggaaaaagtttatataatttgccctcaaattccttacattcaaaacttagattgacctcagctaggtttaaaatgaaaattttaagctctcaaaaatggaaaagttatcttccaactactttgtcaagaaattttaaacccctataattcgggtacgttacatcatttaacacaaaaatccgaaccaaacgcttgacatgactagtcattcaactcaacacaatgagtttacaataactaggttgccaacagcgtggtgaagcaatttaaaattttagggtcgttacacgttgcaacatgatcttaaatgggttaggttttacggtattttttgagacggttactctgagaaggggataaaacagtttttttagattgtttttctttgaagggaagaaaggacaacaacggcagattctctgcataagagcacctaatgtaatgtgagagataataaatagagtactgttcattccttttggagggggaagtgcaattcaactcaagttcctctacttcaaaactaaaaaaaaaaatccaaatccaaatcaattgatatatttcgaggaagaaatggggttacctggagcctgttggattcactcagttatgtgcaaattaaatgacctacttaagttacatggaatgataccatggctaataagcaaagttcagggcaggtgtggtgctgcattgctacatcacgcagcagacggtcacctgaaccgtaaatttgacaaattgacccctttagaaaacttatttcagaaaataggccatgcaaaaacttatttgcaaaaatgagccatgggtattttctgcgcgggtattttaattatgaatgaaaacggtcagaaaaaccctaccattttcattttcatatttttttcttctcgaaaacagaatcggaattgtagacttgaaaatggtaacgatatcggtaatatcggtacatcagaaacgggacgtcggaacggaatataccgatattggtaggaagtcgaaaagtcatgtcgaaataagtggagtgtggcatagcacacatttaattatgcacgaagatgacttttttaactttatttttgcatcatcacactctacataacactattatatgatgattaattatatgataataagtttaatgaacaatataaacaaagttcaacaatactacaacatcgattagttgaggagaccaaagttcaggaaaatccacatgccacgtcataggattaacaacattttccctggtcacttcccattttttgtgggctgcaagtctaccatgcttccttccttcacgagcttccaatgtgttgggctggctgagccgctgggaacttttggaattttgacagaaattaccgtacaaatacggttaccgacaaaacggacggaaaaacctccatcccatgtccactaccatttccgaaagatattaccatttccatttccaccaacgtcggctacatataccgactgaaacggtcggtacaaactgaaaacggcagccggaaatctcggaaatttacgtaccgttttcacccctagtatttttttgatatttttctttttcatttgccacctgaggttttgccatcccatgtcctaaccgtcggatcaagagttgatgtacgaaacattgctgacagatgattgatgactaagttttgctaacatataattagtttctgctcttaatatcgctgacatatattttgactaaaaatatatctaaaattgccaacatatagcatgtcttgttacctagtattgccgacatatagtttgccaataacttttactaacagagagtctatcagtaattgtttatttttattgaaagatgtctattggtaatattgtcatgatgtagtgtggttcgatgcggcatcagcacgagcacttctggatattgtcgccgcactcatgtgggattgccagtcagatactggagaaggcggggattacgtcaagtccgcatggcacttatgggttgggccacacacgtgcgacatatggcaatgacaatgggaagcaagactgtaaggcagagcaaatccggaaagattgcctcagttcgaattattctatgcaactggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacccgaagcatcgaaccaacagtcacccatgacttctatgtaccactaacggaggagtaccctccccaggaatttgtcttaggaataattactaacgtggaggaatacccgtactgagctgtcaccatcagtgacccacctctactatcccgcagcatatattcccagataatgatacttaataatctagacaccacgtctacattattaaatactactctatatccctatgaatgacatagagcaaccgaataatcggacattaaacccacacattgcacctctctggtaggctagctacacaactataacgatacagatataaagtaaagccgatactcagataaactaaagtaccgagagtatataaagaataatattccattaattccgaaagtcttccaaaagaataaagaagagctactagagccatacccgaattccttcgaagactccgagagctgttctattctactccacttagcaatagaatactaaactaaagtataaagagaaatgttgagcttgcttgactgtaggggtgaaaacggtaatggtaattaccggccgaccggcgttcgtttctaactttgtaccggccgaaccatatggaaatggtaatagactgaaaaaatatggaaatggtaaaaaatatggaaatggaaacgtaaatggttttgttgttataccgatcgtctccgtatttaccatatttttgtggaaattaccgtttcttatcatatggtaattaccgtatttctaaatatgttgatatttataaggcatatctctacttgacccacagtttagacattgatcgactcttcaatcaaatccctaatttgagtgaatggctaaaatgaaattaacttataatttatatagtatgagcttgaatttatttatacatataacatacttatgtaaagttaaatatatgtttttatagtttattatttacatatttgttaccggtttccgatctgtaccgatatgtttccgtccatattattccgtttatggttttccgatatttccgatattgttttcgtttccgactttaccgttttcgattttgtttccgagaaaaatatggttatggaaatggttgaagctgttttctgattgtttccgaccgttttcatccctacttgagtgtgtgttgaagtgaatgaagcctccttcttttataggcaggtaatgacggttacactatgtgaattgtccaaattgccctgcaaccatcattgaggagcaatcaagagcatccacgtggaaggccgggatgagaggagctttccagggtttggccgaacccttggctcagccgaacctgggccggctcaacaggcctccgcactttccagggtcggtgacaggtggattcttagggcggttatggcagttatggcggtttccgggacggttacacctgacatgtgggcccgtcttacccttaagcttgcttcggagtgaagtgtccatttatgtattaatcgctgcaaaataataatactccaggtacaagtggaactacattattgtcaaataaatatgcattgcaagcatagctaattctcctttattttagttatattgacggtcgaaattggtctataacgaccatcaacaatacccataattaattggagccagatcaaactgaaaattgaccactttgatgaagattccatctaaatatatcatgctccattattaagttagcattcacatttgaaccacacaaattgtgcgatctaattaagttcaaaccaactaatgctctcctaaaagggacattaagtggaagataacgattggtatagaagataacgattggtatttgtcctttaaagatgaattacctaaccacttatcctcccagaatctaacttgttcaccattattaataatccagtaacccatatttagaaaagaacttttaaccttcatcaaacctgacaaaaaatggaaatccccttgtttcctgtcaacttgagttatagatttaataccaagatatttccttttcaaaagattttgccacacacattgctcatttattaatttaaactaccacttacttaataaacactggttttggatctctaaattatgaacaccaaggcccccttgatctttaggctgacaaataatatcccatcttgtcaatctatatttatttttatgttcatcatcttaccaaaagaaatgaggtctataataatcaattttttaaagaacccctttaggaatcttaaaaaacaaaatcataaacataactaaacttgataactcaaagttaatcaaaaccaatctcccacctacaaacatatgtttacccttccaactactaagttttctctcaattctttgttcaattgttagccaatctttattattaagctttctaaaatgcataggaatgacaagatacctaacaagaaaacctcctagtttgcatccagaaatatttgaatattgctcatgacatttctttgctcggccaaagcaagataattcactcttgtgaaaatttgtcttcaggccagataatttttcaaaagcaattaaaatcaatttcatatttttagctttctgtaaatcatgctctaaaaaaatgatagtatcatcagcatattataagatagacaaccatcatcaaccagatgtgggaccactctagaaatttaaccatcatcttttgctctattaatatagctaacatatcaacaactatattaaaaggaattggagataacgggtcccgttgcctaaatcccttataggtttgaaattttggttccacttgatcattcactttaatgccaacatgtccaccttggataaaaaaaagcaatacaatcacaccatttttgagagaaacccttcattttcaaagtttgttgaacaaaagaccattttactttatcataagctttctcaaaatcagtttttaaaagtacaccactcttttttttctgatgcaattcatgtatcgtttcatgaagaataacaatcacctccctaatattcctcccttgtataaaagctgtctgtgtgggactaataaccttctgagccactccagaaattctatttgtagcaactgtagtaaaaattttcaaactaacattaagacattaagtaaacaaataggcctatatgtttgaattttcaaggcctctttgcacttgggcagtaaccaaagttaagagactaaagaggtaaactaccactatgaaaatcattaaataaatcaaccaaatcggacttaataaaattccaaaaaacctgataaaactcagctaggaattcatccggactcagagctttattatgttccatttgaaaaatcgtatctttaatttccttctcaaaaaataaatcttgtactaaagcattattttctaattgagaaacttgtggaatatcagttatttggctttcatctaacgttaaagaagaaacttcaagacagccaaaaagacctttataataagtggtgatatgcgcctttaaattcgcatcaccataaattacccaatcacaatcctgtagcttataaatccttgttttcctatgcttaccatttgctaccaaatgaaaatatttagtatttgagtccctttccaaaatatctttagtattagctcgcagataccacttaatttactcttctattagcacacaagataacttattcctcaaataaagtcttgaatcaagctcctcttgagttaacaaagttgattatgtttttttatcaagaaaataagataacgagacctttttcttttttctatagaaaccactagtctatttggcccatcctcctaaaaattatcttagtctacgaatcttatcctgccaatgctttaaatgagtattaccatcaacaacagttaaccaaatttacttaaccatatccacaaaaccatctcttaacagccaattcctagtagacttaattataagagttaattatatatgaccaaatcaataatatgtcttaaaactattatcttttttcgttgttatttttaaagggtggtttgtgcattataatgtctttaccattaatggtcggactatatataattttggaggaaatatgactagttaacatgggcatatgtatctcatatagaagcagacaaggatcatcactatggataatgtaatctatattatactcatcaaatagtttgttcatgaaatctttagttatggcataaagtgcatctggaatgacattgtgcactcattttaccgcacagaacattatcaacctgtgtactagaaaagaaagcattaaaaaaattagatgcttagtttggagattaggatgagatatcagtcttcactatatatatactatcaattctatatatagtgagtatatttaatacaataccatctagatagattacatattctcgggatctgtttgttctgtacatttttttttcaccaatttcgagatgatatggtatctaaatctatattctcgggatccattcgtcatgttcatttttttgtcgctaatagtattctcggttctaaatagatatatatagatactccagatctattcgtcatgttcatattttttccccaatttcgagatgataggtagcgggcccgattatgaactctagagaaaggcccagaagtgtaagtattggtccacattccataatgtttttttttctagcccataaataatcctgggaaaaaataaaagaaaaaataagttagtttagtacttttaatataaatgtgtattttattttcttgacatactgtggacagagatatattataacccttacatacatatagactaaatgacaaattgctatatgtttagaagtgcacatgtgcaaacatacctatacattaacccttacatacaccagaaacccaatgtgttgacatcgttatgtaggttgaactatacattaacaatacaagggtagcccaaatgggactcaaatagaccgagcatggtcatgtacattgcaaaataccaaaagaagtagattagatagcggaagtgaagcagcggtggtccaacgtactccacaggaatcgacgggtgaacctaggtcccgactccaccgtcttagacatctcttcattagcatagttctcatatagttaactccaactcctttctaaaagatttagttaagtaaggtgagtaccaaccgtactcagcaagccaccactatagaatgcatttagtgcacacaggaattcaaggagttcgaggtgaagagagacgaacgtccttatacaggggatgccagggcatggcttcggtgcacggcggtgtgcctgcgaccagcgcggcacacggctggggtaactgtaatagatgtgttttgtatataactatagatggaaattgtaaagggaatttgtaaaggggattgcacaactgtaaatgatgtatatttggacttttgatttggctctgggtcgaaatttggaactggggtttggaactgcaaatatggacttttggtttagcccgcactcggatcgtttgggtggaatggtcagattcaattcggccgcttagtcgcctaagtgctcaacttaggggttttttgtgatcactcgagcgaatgaaaagacaacaatgccgagggttctagaagtgacgcttggcatacaaatccgttggatgcggtagggtttcaaggatagaagtataatcgataatgtatgaatcaacgtacggcaattaaatccgtcgaatgattttagagtttcaagcgaaaggccttactctgtaatttcgagtcaaagtgataggggggaaagaatccgtggagagccgagtcgaatagccgaagcaggttttgatccgatcgcaaggttccaagggttcggggaaagaaacgacattgcgaaaaaaggaaaggatcttgggatttcgattcgcttagcatcgaagcatttagcgaaaagggaagacgtcgatcggaggatgtcctttaggccgaacgatttaattgaggtaatccaacgattcaagggagggacggggaattgtaattgtataggagggttgagaggatagagaagggattttaccttgagaggcaattctgcaagaactactaagagttcgaataataccagacactagaacaattgtttcgagaggggttcgattgagagggagaatcgaactacaaaattcgaatcctgaggaattacggcaagagggtggattcacagggatggattaaatcgagatcttggcatgaaaatacaaatgcacacaattaacataaattccattatgcaggtcggctaggcctttcaatgaggaaaactagacttttctgtgagttctttagaaataaactcttttaagattttagtttataaatagagttttgctagtaaattccttctagtctttatttgtaaataattcccaaacacttataatttcaaaatagggttttcagaagttaactaatattagcccttatttgtaaaaatagttttctcgggaaaatatctctcaaagtatgttttcgaaatatttagtatttgtttttatttataaaacaaatatctcaaataggtttctaattcatagaaaagggttttcaaaaagacaaatggtattcgcaaatattttcttaattaatatatttcataatcatggttcttttaataaataagatttgaatccaaaatatattttgttcctagatttccgtcctcgtggtccaagcgcaaccgaaaaatgggagataaaatccaacatgacggattttgaaaaagatttttgattatcctgaatttttaatttcacaaatcaaaaccgaaattttcagggtgttacatagccagccccaggaccagccttgatcttgacattattagcaccgacccctccaaattaaagctggtggcaaagtgaggcgcggcctgcagaaatattaggcacagttgtatgtatattactagtatatatacagattaattatgttaatgagcatgtacgtacggtagtatgcatcgctgccgactcagatgccccggcggtttcttgaagcgtggagacttctcgggcgacggtatcaatgtaggcaagcgaggtgaatcgaatggaaccgaagtggaacggacatgggggcggttgaagcatatgatatttttattttattcattaaaatattttaattttttttatttttaaattattacagaatctttctctaatattttttgggagggcactttttataaaagaactatactatgagaagtgttttttatgatgcgggatataattattaatcaatgctaacgtttgtatgaagaagggttgactattttgcaagggggtcacctgcaaatggtataggtgacattttacaggttactccttgtcctcctctgggatggttgtaaggagtgttcactaaatggttagttttactctgtgcggcggttagtatacgctattatatgtcaaagtcataaaaaattgttcttaggagcgttggtggtttaaatatgtactactttgaaaataaaagttatttttaaaatattttaatagataaaatttaaaataaaaatccgagagagcacttatctaatggctaatagaaagatgtctactaatatgatggttggaaactcctgtgaaggctctgtttgactaggctgtaaagcttggcatattagcagtatgtaaaacaagataactcattagcatatgactaattgagtactaattactacaaacataaaacatggatttatttaattttcttaaagaaacttctataaggggtagaaaaaaaagctcatgtctcagatcagcttggagcaagctaggcctttagcttgcgagcttaatgagccaacttacaagctactcgtttagctcattagtattaagtataagagatcacttcatatgtatgctgtgcttcctatttagtgtttagtcatttaattacatccaaattatttatatttagtaggttatttattagtcaatgattattattatatttgtatatgataaaatggtaaagttgaaattataagaatgatataaatgcattaacgagcctaacgagcttagcagttctaagaaacatgctaatggaaaatgagaaaattaacatagccaaaatcacttccgaacgggccttgtaaatactctctgtggagcacctgtaagtcgtcgttctataaactatacttgggcgtacaaactataaactaatctcaaacatgacttaattgccctatatttatattgagttggagaaatggatcacttatttacaaggtaaccactatcgagatactatatagaatcgttttctatttgtagtatcatggaatcggtatactataagattttagaatgtacatattttatatcaaatatatattatattagataaattaaaccatataatattaatgttgataaatttaattggtttttatgaaaacttgagcatatttaatcacaatatttttcaatccattttatgttattaagcaggatcgcagtgatcgtaaaatcgggataataactaaaattttatagaatcatgtgaaaatgaatagtaatatcgatatactatgaaaattgatactaaataggaccgattttgtttcgtcattgcactatcgtaaaatactgaaatacagatcccaatactaattaataaccttgcttatttttaagagatgccccaactacaataaagatctcaaaacataaaaaatagctctatatatatatatcgaatgaggctctcttatgttatgtacgttagaaggacatgggccactgacatgtggggccatgatggtgggccccacccataagggacacatgtccctctgaatttacgtcatatgagctgcttccatagatatcagattagaacagagatgggagagtaaggccctgtttagattccacgcaaaaattttacatcctctcacattaaacgtttgaatacatgtataaagtattaaatatagtctaaaaaaataactaattgcacagattgcaactattttgcgaaacgaatcttttgagcctaatagctccatgatttgagcaccacattaaacatttgctaatgatggattaattaggcttaataaattcgtctcgtggtttattgacggattctgtaattagttttttattagtgtccaaacaccccatgtgacatcctatataatatccaatataatacgccaaaacgttacacccctttaacaccccctaaaaagacttgtatttgaaagcacgtgcacatgaccgttgcttgaccgttacccaaacaccccatgcggcatcctatataatatccaatatggcacgacaaaactttacacccctttatctaaacaccccacttgtatttgaaagcacgtgcacatgattgttgcttgaatgaatgacgtgaggccactcgcatatatgcatgcaacggaacacatgattttggctaattaattaatactcacagattagaacctactacttcggtttcaatcatgagtttccatgcccaattttaatgttcggcttatttattttttttataattacgctagttttacacctctgctcaatcagtcatcactcatcagagagctcaggcagaaacacccaacgagctagctatatagctatagctacatatgcagcgcgcgaggctagctaacgagctaactaaaccaatgaccaatcaaccatcgatctttgcctttggttgatcatcaggaggtggcggccggcgacgcagccgctggaagagggccctctggcggaggttctcccggaggcggacacggtcgtggacggcgtccggcacggcgcgggacacgcaccactgcagccggtggcagaggttgggcatgcacaccgcgccgtgcccgatccaccgcgccgccgccgccgcgtaggcgtccgcggtcggcacgaacagcggcgagagccaccgccgctgccgccgcttgctccccttggcggcggcgtcgtcgccgccgccgccggccttcgcgacgccggaggtcatgttggtcgccacgaacagcggagcctgcaagcatgcgcgtacatcgcgttcgtgtgtaccattagttaataggactatcacagttatgacataaaagagggtttatggacacaggtacttcaaccctcctcacgacttagaaagttgaaaaatttatcgataaattttcttctaaaaggttatcaaacgtaaatttagtacaattataatatactcatattataacttacatataactacaatataaatgatatataactttttatataaatttaaaactgttagatttactttaaatttgtgtaagtggagaagaaaaaaatcacaacgtgcacataaagagatttggtcccataacctcgcttcgtgaaaatagcatattactgcaagattttaatatacaagttgtattgtatttatatacaacttacaatataattattctatatttgtaactgtcaaatttttaaaataaaatttgtcaacatatgtataacaaaactgttcattaatagattatgttttatatacatattctgcaccttgaacgatcatcaagtgacaaaaagttatactatgatgatatggcttatctcggagtatcaggtatggcttaaatctgtcgttctttataacttcaaaactaagctcatgtttgagttcactgaagataaaaattaagtatgaacacgtgaaataagaaaactattagcgtctgatttatagatagttttacaataaattaataaaagtatacgtgattttataaaatttactcatataaatatataggatcggcgccttttgacttgaatcaagttccaacttccaaatcaacacatggttgtttgtttactttcgctgttacactgtcactcaccacgtgaatatactgcagtttcacatgcgtggatcagaggatggaccctactaattaatgacagttgggctggcaaggatttgacggtacggtgtgcatcaaattaattgttggaacttaaggctagttggtaaaataaaaaattttgggaatcacatcggatatttgaccggatattagaaggggtttttgacacgaatgaaaaaactaatttcataactcgcctgaaaaccgagagacgaatcttttgaacctaattaatccgtcattagcacatgtgggttactgtagcacttatggctaatcatggactaattatgctcaaaagattcatctcgcgatttacatgcaaactggcaattagtttttctttttatctaatatttaatgctccatacgtacgtttaaagattcgatgtgatgtttttggagctaaacatgcccttaaggaaaagtagaggaattctaaaggatttggatccattgaaaaatttccctacatggtttttagggaatataggaattgcttctccaaaatccaaatttttttagggaatataggaattgcttctctaaaattctttgaaattcctatgaaattgctcactttgaaggaattttagaaaaaaaaactaacataaggcttgaccacatgttttctcatccttatgactcaaagttcctttacttttcttatggtattatctagggctgggcacttagcacttagtttatatggttttctcggttcggtttcttaagtttgctgaaagttcggttttcaagaaatacgaaccgaatttgctaagaaaaaaaaggaactaaaaccgagcaaaacaaatcgaactacttcggtttggccttttcggtttacccaaggggcatttaaattttttccacttttaaatgtggcaattaggcatttgccacttgctgtctataacatgtgggtcctcatgtgttaatgacatatgattccagtgataaatctttaattaccatttataagagtgtctaataggtaattattcctaaattggggattgaattgattaatcctacatgaagatacagatgcgttcagtttttatgggcttatcggtttctagcaacatcaaaccgacaagggtgtgtttagttcacaccaaacttttccccaactcccaatttttcatcacattcaaaactttcctacacacataaactcctaacttttttccaaactaccaactttcctcaaatttctctccaatttcagaaactaaacacagccaagtttggaaaaaggaaaacgaaagaccgagaaaacccgactgttcgggttggatcggtgctcggttttcgagaagtaattgtacccacctctagtacttcctccatttcaaattgtaagtcattctatcatttcccacttaatgaatctagatagatatatatatctagatttattaacattaatatgaatatggaaaatgctaaaatgacttacattgtaaaacgaaaggagtattatcaaacaataattattcaaaatcctattaaatatatttcatgtaggatttattgacatgatatcctattcgtatgatttttctcgtgtgcttttaaatcatacgttttaaagtagccctaaatttgatcgaccggttatttctagtcatccccattttgagaagcgaacagatgaaagcgttcgtcaaaccaccagcaatacatgaaaaaattgttttctaaaaacttaaacaagagtacaatatatacctgacattgcacgtcgattcctttgctcttgtattccacgtaaaggctcctcgagaactcagcaacgtacctgcagcgtaagtgaaagtacaagaagaaaaaaaaaattaaaaccagctagcatatggaattgtggatacagaacattgaatccaattagagcagtatactggacactccaattatatcgagtagtactagctagtactatatttaatacatcattattaagcgagtgtactccatatatcaggatatgatgcattgctcgtcaaatgatttaaatccaacattaattagtctgatggcattgggcagatactgaagtcattaaccatcttcagatactgaagaacacaagaacaccgttcaattagtctgatggcaaaacaaatatatttgcccaaactgctagctattattcaaaattgccgagattaatatgcttttatatatactattagaatgcacaaaagtaatttttgtggggaatattagtaagacacaaacaaagataattagcattaattagtataccgtttagtggcggcgtagacggagtagagtgggaaggaagggatggcctccgtggagccggagccgatgttgacgacggcgcccctcccccgcgccaccatccccggcagcaccgccgccgtcacctccgtcaccggccacaggttcacccgtattattctacccacgcctccgccttcgnctcgtgcaggtacaccgggcacggtcgcgccacgcccgcgttgttaccaccaccccgacgttcagccccgtcaccgtcttccgcagccgtcgcaccgncttcgtcccctccgcggtggacgccagggccaggtcaaacaccacgctcctggtctccacgctttcgtcgcccagcttggagatgacctacgagacgtcgcggagcttgacggagtcgcgcccgacgagaacaaggttgagggccccgcgggcgagctcaagctccacggagcgcccgatgccggacgttggccccgtgatgacggcccaggcactgtatcgtcgacgtaggtcgcgcggtcggcgcagtcagagtcagaggtggtaggcaagtcgcaagtctgagtgccgcgccgtgaatggcgctgccgatgaccaacgcgacgaaggcccacgccggctgctgctgccggaggacggcgtcggcgccggcgacggcggcgctgccacccatcctcactctcgccgcggattgaattgagtagccgcctggatgttggatctgcctaagctggagtagttagcaacggcaatataaaggcaaagctggatatgctggagcgaacgagcgagattaatcagtacagtacgctacattatccagtgaatagtgaattagcacggtggtttttactgtttctatactgcggctacaatgaaaaactgcaaaaacactgttcttcactgtagcaccagactcattttgggtgtgtctagttcgcgttaaaattgaaaatttgattgaaattggaacaatgtgacaaaaaaaaattgaaagtttgtgtgtagaaaaattttaatgtgatggaaaagttggaagtttgaaaaaaagtttggaactaaacaagggctttactgtaattccctgccgttcgcttgcaaagttagaggagccggatccctttccaataattgggttagcgaatggtgacggctgagtttgtttaaggccctctttagttcccaaaagaaaaacttttcacccgtcacattaaatgtttgacatatgtatagagtactaatgtggaaaaaacaattatatagtttgcgtgtaaatcgtgagtcgaatcttttaagcctaattgcgtcatgattttataatgtggtgtaacagtaaatatttgctaatgacagattaattagccttaataaattcgtctcgcagtttcctgacggaatccgtaatttgttttattattacactacgtttaatacttcaaatgtatgtctgtatatccgatgtgacaatcaaactcaaaacttttccccaactaaacaaggcctaagtttgtaagataaaaatgatcatgctctattaatacatagtacaagacaaagatagtgtcctctttattaaaaaaacaaagagaaaaggaaaattttggtttttttagctgtttcggcatcaaactctatttttttaaaaaaatatgtatatatccaactgcaactatgtggatttatgtttgcctcttatccctctcttgctaataagtaatcttccgcacgaaaaacggagcggtccgttagtgcgtgattaattaagtattagttattttttaaaaaaaataggaaaatacgatttttttaagcaactttcgtatagaaatttttttaaaaagcgcactgtttagcagtttgaaaagtgtgcgcgcggaacatgagggagaggggttggaacactaagcaaataacacagcctaatttttttaacaccgagcaaataacacatctccacgcctcatatccacgctggattcaaagtttgtttgttagattatattggtttaattttttttatctcatccaaaatagggtcaaaatggttctccaaatgttattaatataatcgaggatccaaattcatagatccaagaagctacaaatatccagtttcaagtaatcttggatctaaatttgtgactaacagaaccttaaataatttcagctagattcgtggggtaaaaaaaattaaagaaaaaagtatgaatcatcccccacctccctgaataattacgacagtacaaattaccctcgaaccacaaaaacagacatttgataccctaaactattgaaactggacaaattacccccttgactcaatccggagtggttttgctcctacatggcatacacgtggcaccaaggtggcaatccaatcataaaaaataataaaaaactatgggcccacttgtcatgtactcctacctcacccccccccctctctctctcttttctctctctgccatagaggagcatggcgggcgcgcggggaaggcgggcggcgactgcgaacgtgaagcacgggtgtcggtgacggcatccgtggcggcgacacgcgagatggagctgcgcaggaggcggacgacaacgaggagggtcgtcaccgctgctcctcccttgcccctctccttctctttcgactccctcccatttcctgcagtgcgtcggtggtggttgtccgggtggagaaggcggtggcggcccaggcggagaaggcggcgatgtcaacagtggtccggaaagagaaggttgcggcagggaagggtgggcggcaggtgtgcgtgcaagcgatcgccgcctccgctgctgaccactcggtccgcctcctccccgcgcctccgccacggccgccgacgtgcacacgaccgccccttctgccactccccgcctggcctgccacagccccatcccatgcactccaccacgctgtgcgtgccaccatgagcgctagcgtctgcgccgaccgtctgcccccgtgccgccgctgcacgcaagagagagaggaagaggggaagagtagtgtgaccagtgtatcctaaatttttttaataaataaaatgctgactggattgccacgcgtatttcacgtagaataaaaccgctctagattagatcgggggggtaattcgtccggtattaaaagttaagggtgagcaatgtatggtttttgggttaagggggtaattcggtcgaccgcgatagttcagggggtaattcgtactttttttcaaaaataaaaaggcaataactatcatacctcatagcccctttgaaataaagaatttctggaggaacattggatcctattgaaaattttacgattttgcgttttaaataaaacgttagacaattggaaagactctatgtcgaaattattaagaaaaaggtgagcatatccagggtcaaacacgggttgcgtggagcacaacggctgcacctcgccatctccatggttcttcgccggtcactatggatttgttacttcaccctatgtttttcatttagttaaaaatattattagttgcaaaacatacgcgaaaaaattaggacgtacgctgctgcggtaatcagttggcctaaaacactatttttcagggaatcattagcctaaatactctattttcattgctttctagatccacaattaaaaaaagcaaagcccataagcccaatcagccactccctcccactccacacagctcacaaaccaagcagctcactcaccaggtagtctttcatctcctctacattatattttctttaaatctgttatccgctttccatggaccactgagattttgtttgaactggaatgtgaaatcaatgagattgaagtcatgtttgctaattgataaccaaaatataaaacaaataaattcaaaagttttaatcaatgtccaaacaattattcaataattggttggtcatatttaccgagcaagccattttgttgaaaaatgagcaacaataatgtaatcgcatgtttttatgctatgaaaatatctcatgagatattcttgctatctatttcactcgaattatttagagtattctttagaaatttagacctgctatgtatttatgtggatgtaggctgctagaatcagcctgcaaattctcgtaggcacactcaatatggaatttcttgtccgccactggcaagcggcgcagacaataggaatgtaaaccattttcattatcttaaatattcataaaacaagcaattgataattgtcaaaattgtgaatttatttatgctatagaattagttagttttgccaataattggctctatgctttttgcttaagttttcgttatatgaaattattatataagatcgacttctaatttctaacatgtgtattggcatgtgcccatgagcccatcgctatagactgcacacaattcacatttgttcgtgcgtgcactgaacctgccttgggaaggatgtagaggcaaaagaaaggctcatgtacctattttttaaaataatattattttaatgaaaatcacagaaatgatggctggccggaattttttcgccaaaatagaaccctgccgaatagcagttcgacatgatcctattgaacagcggaggagggatgggaggaagctttcgacaggccctgtcaatcagcagcagtttgacaaggtccacatctggtagtgtgcaagacctgtcgaattgtggttgctcgacaggcccaacaatcaaccctatcgaactggcatcttgacagggccctttatatgttccactcattttcattgaggccatgtaaacataaacatgcaatcgatatagtgactatctcacattatgtacaaatgtcatatggcaatgaacattatctattatctctgttctaaaatataagggatttcagtgatacaaatgcatagtaaacatctcttttatattttgagacagaggtagtaagacaatatttcttaactcccgtgactaacactttccgctctaccctttacttctctccgcacagtgacggattgatgtgaccgtgacaactgtgatcaaaattaacattttcctcttaaaaaagcaaaatatatactacatccgcc

SEQ ID NO: 81135 - DNA, 21173 bp, Oryza sativa
gttaattattggttatatatgtaatgcagaaatgatatatatgtttttttttctgcaccatagtgtactaaaaaaattatagctgctctatttattttgcttgcatctggctcagctcatactccacccaaattaaaacagcaaaagaaaatatgaaaccctttttttgtgaaaagaaaaggtggcatgcacggtggaaacaattaaatgggattttggtcaagactgcaagaaattaattagttcctgtgataactgaacatcaggtaatcaggtctgtgaaatgtttcaagccttcaagaccattctggtctccaatatacttctctgtttttcttttactgagagctagtatttactagttggtgtggcttatcagaatttgcttaattgaagaatttacaaacaagatgcttaattcgactgattaaacacaatgaattgacgtccattttaagaacggtagtgaaatgcagttccaaaataatggggacggaaaaacaaatttaacaatttatatgagaccaattgtaagccgaccgctgcaagttaaaccattcatggtgtatttgaaaggaaaaccgcttaaaataatttgtttgcttaaaattgggacaattaaaatgtgtgtgcattattggtgcttgactcactccaactatatatgtggaaataaataataaataaataaatatatatatatatatatatatatatatatatatatatatatatacgtacagagaaatagatataataggatattgaggatgtaattaactctgtgggtttgaaacaacatgtacacgtgcttatctacaatatctcaatggacggcatcaattaattatatatgctaatttgtaatcaagtcggcacacaattggtcagtactgtacactatatatgctccaggatgacctgaccaaatagtagatgtctcaagaattaattatatatgttgcaatttattgcttttgtcatctctatatgtggataacatattgttatggctatttttatgtcagcttatagtctctatatgatactaattgattttattttatttttggagtatataggacgctgagagacagttgtatgtcctcctcagtccacatatatatatttatatatatacacactgtcatataccatattttgttttttttccatccatcagtcaagaggccagaagtgtactggttgatagggaccattcgatcggtgtcggatgatatttaattgccatcttagtggctcaatagattagttgaatatgacatcgaattggtgtggagtcaaactttattaatgtgttgataaaatctggttcccctgcatccatactagtgattgaaccctgaagttctttaatcttagcttcccctagctaggcatgcatgaatggttgttcattttgcacatatatttgagtgcatgctagctagggtctaattttcttcctcatttcccttttcttggacatcatatttgtaccatatacaaggcacattgttatgttaaaaaaaatatttggttggcatgtacttattttatataatgtaaattgtttacatcttccacatcggtacacacaactaataagttttgactctaaaatagaagatacgaggttatacaacaaactcgcatctccttccaattgcatgataactcctgagctaatgaaaataaataaatcacacaaaactctataacaaaattataaagaaactatgtcacctaaagtaggataaaggatccctagctattgattttcaaagtacatagtatcctggtcccttgtaatagcattatagaccaatagtgaaccaagtggaagatataaagatgatatgcattgaattatttttttataaataaaaactatataactgtggtaaaccatactgactaatacagatcattggctccaaacaaaattaatttttaattagtttagacactcccttgagacaattgtcaaaaacatttctacatttcgattgggaggggagagctattggaagcaatgaaaagacaacgccaaatataccatgccatatgttattgaaagaaatgatgttgtatatatgatctggttggatgtatggtagctatactagcagggcagggtgcctatgcgttgtaatgattttttttatgaaattattagaaaaaatataggagttctgactaggacatattagagttaatagttgatacatataccaaattattttaattcgactgtatatagtcagtataaacatgtaatgttcattttatctaaaaaaaaggaaaacacattcacttttttagagacctcattcattctagaggggatcaggggcggatctacactataatcatcggtgtcaggcgacaccgacgacttttagcaaaacctatagcaaaactgcttatccatatactataacatcatgttctaaacataattagcatactatgacaccgatagacacgttatgacaccaacgaaccaattttctggatccgccactggaggggatgatcacttgctatactagagaaccttgtacagttaggaagtcatgaagaagtataaatattgggtactgaccaactctgatgttgcttgaattttgaattgttacactgacaataagggctcacatgacagtgagtagctgatggtggtagattcaatgtcactagactcaccaccattggagtcttatagaattatatagatatatgatcaagtctcttttcttagatgtcctaattaaggccttatatatagttgttattattggtgtgtggacaatcaattttaggacaggctcgaaaccatatctaaatggaatgactagtatccatttttaaaaagcaatagtcaaaataacatggtccatcgatcgagggccgaagaccgcaaaaagtcgacgatctatacaattacaaaagaacaaatgatgtgcacgatatttaattgataaattatcaattgtattatggtatgtttgtcaaagtatgatcacaagataagaaaactatattggccttacccgtgcaattgcgtgatgtgcgcgccagtttatgctggatattgacctatagagtgatttatttgattcaaagcactatagtgacattcattttttaaaacacaactagatcgtgtagcgattaactggactaatccagcattattagtcattcattatctagaaaaacattattagtcatatattttatagaaatgaccttataattcctcctcttctacagcctacggctagctatagctaaccatttcaatgtcaagatgagaagggaatttaagagcctgcaaattagaggtactctcacaacagaatatatataaggagcccacagtttaaaaaaatcaatatttacatattttgactaataattaaattaataatatatgtttagatcgtacatgtggcagcattatattcatatttgaaagtattttttatatgatattaattttagagtcgttgataatacgttatatgaaaagaaaagtcaaaggcattgttcttttcttattaacatgcatattttacctcgtgcgaaatctttttatatagaagttgttttaatatatcttataaatccattttgtctccggtgaccttaaacgggataaattaaagttttacgttggagactatgtatgcaccaaatttacacactttaaagctttatttatattttaggatggagggaggtactaaacgagaagtatgcatgagagcatgacactaactagctagaagaacactagcaagatgatgcaggtgtcattcattaattaaactaattaatcagaagttaattgagatttgtggcttgcttgacacatgtatactatactctcccagctaagctgtgtactactcctcaagatgacaccaccaccatcaccagcttttccttcttctctctcttctccggcgtccataaataccagcgccaccctcctctcctccatcatcgcagccaactccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcaggtacgtacaataccaccactcactcttagcctagcttaatcgattagttttttactccctccatttctccgtttccccgtttcatgttataagatgttatgggtttttgaatatatagattcacgtttcacgctataaaatgttctgggttttgaataaattcatgcatgatctattgatgaacttttaagagtccaaaacattttgtaacatggaacggatggagtggcgtattgtgttgcgcctacgtgtcaaagtatgcatgcttacatggcacacgtatttaaaacattgttatgcatgtatataactaatgttctctatggtttaattttttcttaatgctacccatgcatattctataataaataaagtgtgccggactccggtcacagaagaatatatttgttttaatgtatcagtttaacttcgacgataattattattgttcgaagtacaaattttcggcatatttaatagtgtggccttgttctatcaaaacataatttttcgtaagagattatatacttgtataacttatttttggattgtagggatcctttccctatggttttacttcaaaagatgacttacatttggattggtgataaagaatatacaactaagtagacaaagttatatctagttcattttgaaaagttcaaggctcttttttcaacgggaaaggagtatcctatataagatatattatacagttaactctgtgccttttaaaagctctgttgacagtaaaatctcatgtagctggttcatccaaaaaaaaaattctcatgtagctgggcatacacgagctttttttttttttaagaacttacatacacgagcttaattacttctctcgatccttttgcggatgcgcttggttgctcgtaataaattttgtcacaaatctttgataaccccaccatttcccaaatttaagcatacatggtggtagaactatattcactaagttttacagtgtcgttgttacaacaataaactaatattgcaaatattgcaatagttacaatataattaatttcttctatgtattatgtactgaaacgcatatcaatcacatgcatggcactgcatatatggtcttaaactatatatgaggcaacgtgaataatatatattattaattaagtattacccgtatacacacacatacacatataattaaagattgtcatttttattatttttgctagacccctcgtccctgtgcatcactaaagtatttttattgaactagctgacctctacaggggtttaaagcttgattacttaattaaactgttaatgaaagacgactatatatgatccaataatatgttaattaagacggtgcatgggtgtccggtgtccctgcagtgtgagatgaacatgcaaaaaaaattaaatatatatcatgctgtgttccttaactaaccggccacatctacatattcatgtcataatcctgcatctgtctcactgctgatgtgatgccgtccaagcagtagtagtgtgggttggtagcagtaaaagggttttgtcagcttggttaggttttcctatctacaatatatctatctatctttttcatgtgttgtcaaaatacagtgagatatgcttacatatttctgcatctgagtactgctcaggggtgatgcaacgaagcatcaggtacatatctatatatttagagggctcagggctccatcgtttagccttcagtttacaggcataagaaaaaataaattttatagttaatttttaggttttttttatcgtaatttattttttcagtatttactaagaacatgtgtataaaagttttatctatatattattttttaatcactaatatactgtttcgcttataactatatagtagtataaggtatagacttgcatgatgtctatctacatgcatgcatgggatgcatatgtaggataggcttggcttgagagatgtctagctagctatgggtttttcatcagctacagggcaattaatttatagatatgcataatatattgtgttcagaagtcaaaagaaggccaagttggaatcatgcatacctgcactgcactcatgccagttgcaagcttgcaattgcaactgggcttgcttcttttcttttcagctggtttggcttgcatattttccatgttatgatcttctgatgtagccttttgactatatatcaaggatggactaaatgttagtttacacaataaggaaaaggatggaaatgttacactcatgtcatcatatactataacttaaggtaaattaagatcaatttacattaattttattaagaaaaagttgactcaagaaagctgcagtttatgttataattttaacttattatgttagcatatggggttttcatttttaattcttcatagtactacttcagtacatatccatatgtatactgtcattttcagacacaggtcccatcaattaaatcacggaaatgcatgagtacatagttttcaaaacaataattatcacaataatggcataattgatgctatgatggacaggccaatgataagttagttccaacaatttaagatcatacatagctagtttctaaagcaaaagaaaagcatgcaactgatgggacataacaaacttgatagctccacaaaatgggcataagaaattttctgatgaaagttaggtatcattgtctaaccaaatagacattggaaaaggatcaagcataccaattgatattttcatttttgctctaaaaaatgactacataagtggttttgaaagcgaaagcgaatattgccattggagaaaatgtctaccaactaagacaataatatatcagattttccttaactatctttgtgtatgctgaatgagagctcacatactaggagagattactcaccactcactgactgtactcagaaccaggtagtggcctaatcagagtttgctgagagaaaatatgatgaaatggacaagaaaaccctcacttaggtagttagaagactcctctcagggtccctctccaacaaactgtatatatttgtgtatcaaccaatctgacatatatgcagtggtttccaattaatggcaatatccaaccaccaactgatgcagcaacagagtgagtacttgaagcatccttatctaccagaaagctctgcaagcttaattagcaaagtacagcaggttttcatgtagaaaatgatgtgtttagttgggatatacatgatatatactttttgaaactcctcttagttctctatcaccatacatacatcagccattaatatataatatccatactagtacaagaatattaatcttaatgccttaatcaactcaaaagcctaagcttaattatcacaagcacatcattttggaaacatattgatagcaacatgccagtgaagtagtgaacacaaagaatgggataataatgatcaagaatgcatcaggttaagaacagaatggctaggaaatcttcacagtaaccattttgctatatgaaaagtgcaagacaagaaggaagaacaacctctttttgtcaaatgcaacagacaggggcccacatggaagtacacacatgtctgatgagaataaaatgatccaggcccctaaagagcatatctatgctatccatataaagccaaacaaaagaaaggaggcacacatgcaaggagtcctctttatggtaagataaaatgaaatgtcccagaggttgtgtagtggcaggggcagtgatacttgtgatccacgcactgatgggtctttccatggagcagtggaaaaaagtatggccaatcctgtcaacaacacatttttgcccattggaaaatttgtcacccctcggctgcatgatgtactgctgattctgtggcctatccatgcatcacaagattcacaagaaacgaatatatcacgtcttgtagatggtggtgcacaagcacagaggcatacacatatacccatcagtgtatcatcttttctaactcatcaggcaggcatgccgagggagggtgggtgcagcttttgatttgctgcagccatcaatcagtcaaagaccttgctcctctttctccagcttctttttacttgtcatggcacatccaacctgattctgtgataacagcattcttttgataaaatcaatttcaagttgattgtgctcacttgctgatatcctccctcactctgttgcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggtagtcacagtaaatgactagagcaaaaaaaaacagcattacatatatcagaataaggtttactattatcaaaagaaattatttcatagattataaaaggaccgcaaagaaattatttcatagattataaaaggaccgcattgactatcatatgatttacaaattatgtggctttcttccagttattcataaaaaatgtttctttgctcactgcaaaacacacaggaaagtaatatatatttaatcatttgattcataaggctgcagcactgctgaacaatgtttcttttgtcaaaaaaaatgcaacactgatatgtttgttattttcagactcaaattcattgtattgctgcaattcttaccagctgacaaaaaaatctctttctatcctgcaactaccgctgttttactcaacttaaaaaaacaaatcactaaaacatgatgctgtaagcctggacatagttttgcattcctgacattcttcggcttatcctttctttggcctttatttcttcaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagctaactatccgtgttccctttgtccctctaaagcacaaaagtaagacctaactacagagcacaatagatagtttttgagaactatgatctattaagaaatcttaagagaaatcagaatacttttgacacatggttggcataagctagttgcaagtaattctgcaaaccacaccattattacactagattaaatttcatacttcaggacagtcaccaagtgtcaactcaacttacatatggtttttcctgtgaatgggagataattgtagagccaacatcacatcaaacaaaatggagagttttatgatatatatatgttcatgcactgtcggaaagaacatgatattataagtcagttgcaaataagagggtagtaaaaaaaagatactgcctaacggatgcacctctacctcccaatttatatttcaatgcacctcctaatttctttttcaatggcagaaacagaaaggaaccaaaagatacatatcattaaagaaccgtatgcatatattattaataaagaatgagtcagtgataagcaattattgtgatataaatcacagcaaatccgtgaagtggtctggtggcggtcaattatacatgcagttttctattttcaattatacaactatacaaagatattcacttcgaaacttttcacttctttatatagtagtgtgactctctcaaaaatcaatacatactgaagcaggaaaagattatatttgatgatcttactgaaggatgttggttgcatggtgtgtacctagttcagccacccccattcttctttaataggcggttaacacagtctttaattacgaagttcaagcccttgcttgcaaccagagtcaaggtcagctgcaggcaagaaaaccaacaatagttttactcttgtataatcacaatccttcccattaatcttccctgcatggtgtgtagtcacaacggcagatgatgactgcatcaatgattcctcagggccactctaactacccaaattcatgcaggctgatataatctgtaaaataaaaaaaaaagagtgatcaagtaattcatggagataagaataatcatgaaacctgacagcactgttcaaaaaataaaaagaaccctcaaagcattttcattatatcacttaccagcatgtactatacacaacagagtagatcaaaatccaccattacatcaccttatccaagggctgtgagcctgcaatacgcaaaaataacagtatgtcaacagaacattttctttcatgaagtcaacggtaattcttggaagataaaaacagagataagacattggttatgcaaccaactaaaggacaaagtagctccaatctgatggaactattcattgagcttgctgtttataacaaaaagggaactgatcaaattacaaccaatctcaaaaataatctagaacctgcaaaataatgctttagaaatgattgctctaagtttactatataaagtgaattttgttccataagtatcaatttaagtgggacattgcagaaatgtctgttcagcactaataactaaagcagaaactgggtgttgtttaaaaacagtgttcaaaaagcatcctttaatgaatgtcctcaacttcaagaatcataaagcaatataaatatgagcattccaaccacatgtatatcaagtcataaatattctgttcagaagggaatggtaggactgtactcaggtttcttaatttgatatctttaaatcgttcagaatcaggttgggctatgcctatgctacctgaacttgccaacaaagaaatcgtcagtttgtcatcatccaaaaacaatctttttgaaacaaaaggggaacacacgcgcaccaggcttacttgtttctcaaatattgcagagatgcacctgattagtactgaaacagaaacatgtccagaaagggcatgcttcaaaattggagaagggcacactaaattctaaagggaatggcatgattactacatccctgaaacaaatggttggctcgcaaatagcaacttgaaatgtcgcaggctgtcatcaatttcatgtggcttcacgcatcagatggtcagataccgatgatgatagctcgcttgcggtgccaaacatttagccaacatccaggacaagaaatgcccgaatatgtcgattacttcatccaccacatccacacaaatcatgctagagtgcacaaaatcggaccaggttccaactgtgcctccagcatcagggagatcgacaatgtagtcatgtgcccacaatgcttagacattcaaaaacctgacactagatttggtactctactaagttggcatgtggcagcgaacgattctcacacagaagaacatttcctgcacaaactgcatcttctcggagcccagagctgcgcacgagcaatcaatcggaactgcaacgaaaacctgtgcagccatccactacttcacaacacccgcgcggctacaagacatgcccttacctttacctgcagctacagcaaccggagcagcaggagattcctgaggccgccggcctccgcccatcctacgcgcggcccaagaacaccagcgccgccggtggcggcggcggcacggagaccctgacgagccaaaacctggtggtcgcggttcagcccctccggcttggagcagctccatccccgccgccgccgccgatccccatttgcgcagccttccacgtgctttccgagttgatataaggctccctcactgtcccgccacgccgtcgccctcggcggcgagccgccgtccttccgccgctcgcttgctccaagagtgttcggcgaaatgcctgaaaggcaaacggaagagagagagcaaggaaggacggactatgctttgggctgaatggtttaatctggaattggaccacgacatcgagattaggaataggttcactttagatactccatttgtcgcccattctgattttcatcctcagtgcgaaaaaccgggatataacgcattctccaacttacaaaaccagtgcaaacaagatcttcatcctacgtggcgcttacatgatcgttcgattcaaaaaataaaaagagaaaaattgaatactaaaaaaattaaaaaatatatgtcaagcccatatgtcagtcaaaaaaaaagtgggactcacatgtcctccatctcatcccccaacctctatcttctctctccatcggtgagcgtgtgcagagagggacgaggcggggaggccggcaagattgggcccacgatgctgtcgttgataaggtgggctcatgagaggggaggtggaggccgaggcgccacttcctcgcgagctcaagctctactatctcttcgtctacaaccgccgcctgcgtcaccgctccgccacggccttgctgaaggctaccttaggatgggctcatgggctgctcttggccatgcgccccatctccagcggtggcggcggtgcgaagaggggtgcaagagtgccaccgcctgcggcaccgctccgccacggccttcctgaaggctaccttaggatgggctcatgggctgctcttggccatgcgccccatctccagcggtggcggcggtgcgaagaggggtgcaagagtgtttctcttgatttgtttctctgacaaccgcggtgcaaaaaacggcaaggctgaagaaaggtgttggtcgaggtggcggtagggacggctcttggtcaggctccccgtcaccgtccaatataaaggttcgaacatccccttagggttgatttagtctcatatgtattgctggtatactttgtcagcaaataaaacaccatcaaagaactattaaaactattaatatcttggtatgatatttggctccagaccttccttcattggaaaatagtttcaacattgctcttagtctcataagaaaattaccttatgtgtcaccgatgtcaaagagaatcccctatctatcccttcttatctctctccctagttcgttcaatgccgctatcttctcacttgcctttttatcaagtatgccatattatcaattgagttattctaaacgtaaaccctaaatataccaagtgtgtaattcaacgacatttttcatcgtcacatgtaatataagtaatactccatccgttcatgtatgatcgacgtattagcgctggaaaagttttatatctttgatcgccgtatttctcttccaccgcacattcttaggataaacacgtgcatcgttttgttctatgcatgtaggcatgcaacaagtctcacgtattgaatgttcaccattttccgtttgcatgtaggcgagactcctcgtacacatgcagctgcttgtggtttcttctccgtgcgcatgcaacatttcaacgtgtaattgaattgcgatctccttagtcactacatcgatcacacatgaatggcaatagtaaaaattccttatataccactttttttgagaattccttatatgccactcaaacttcattagttcctttatatgccatcgaaaatatattgctctcttatatgccattggaatgaaatttatggcccttttataccattgcgttagtccgacgtgaatgggctaccaagttaacttaaaaatactaaaacacccttgcttctctgcaaccgaaaacacctaacacccaaaccgatgctcaaaaaatttaaaaccgatggataaaatgactaaaatcgtacaagaacaacgccgtttgttcctagaatggagttcattgttaatctcgcccttcttcgttaacaatttttttttataaaaaacatcttcatcggtttcaaacacttgcggctaagttttttctccaactttcttaactcattttactcattttccgcatgtacgtttttcaaactgctaaataatacggggtttttttaagatatctatacgaaagttgctttaaaaaacatattaatcaattttttttaaaataataaatactccatccgtttcacaatgtaagtcattttagcatttctcacattcatattgatgttaatggatctagacatatatattcatctagattcattaccatcaatatgaatatgaaaaatgttagaatgacttacatcgtgaaacggaggaagtatttaattaatcataaaaaaaagttttatgtgcgtgggagttgagttcccgaacataccccgatcaccgcaaaccgacctgtaatcctcacacgctgctgtctccgaaaaaaaaggggcaattgtgtttctgcccttgctttacgattcaattgtgattttacccctatttttttgggtttgtgattttgcccttgtttttctaaaatgaagtgccgtctacccctggttttgacagaagtttggtgggtccggaatttcagaattaaacgaagatagaaaatgttattatcatttttgaatgaccattctacccttggttcaatgaaagaaccaaatccccaatccctatcccgatttccactccaaaacccggcggcggcggctacgcgcggccagcacgcggcagggaggagcggcggcgggggccagctgccacggaacagcgcgcggcggagttgggcgcgggcagggaggcgctgcggcggcggcgtcgcgcgcgcatggaggcgcggcgcggcgaccggtggccccgcggtcagcgcgcggcggagaggagcggcggctccgtcggccagcgagcgagcgagcagcgagcaggtagcttggcggcgggatggcgctgttaaaggatgtaggcaggcacggcggcgacctcgggctggagcgcaggctagggacgcagggaggcacgacttgctgccggcgggctggcgctcctaacctcttgccggtgcagggacggaggcctagcgctattgaaaatacaggattaggagacataatggagtaaatcttgtgcatggtggaaatctgctgcaaatcccctgttttctttcccattttcctgtcttgtatctacgagagatttgtttggtgaatggtgatttcttcctgtgatgaatctttttggtgaatttttgcacccgatgcaagttctttgaaaatgctgcagaaatatgttaaattcttccaaaatttgtcaaagtttggtcaaattcgaaatatatacacattatatccagaaaggagaggcaaatgtgtaagggtatacaagtccttctactgctaagttgacgctgttaagtgatgctaacagaataggggcaaaacagaccttcgtttgaaaaaagtaagggcaaaatcacaaaccctaaaatgttagggtaaaatcacaattgcaactcaaactgaggtcaagaacacaattgccccaaaataaaagttcctcacacgcacgcccacgtcagcgcatcacaggaaaggccagtacgtcagccgcatcacgccgcggagggcaatcccgtaaattctcacgctaccaccatctctccccttccccccaagtctcgtcccttctccccgacgaacacgaactctttcccctccacctctcgactcctccctcgcttctccccctccgcaagtctccctccctcccccacaaaccctacctcgccccctccctccttcgatcgggggagcgctccattgcggtaggatccgatcccctttctccgccgattttttgcgattttttttgattttttgggtgatttgtgtgtttttttgcggggggattgtgcaggcgaaggggaagggggagtcggggatgttcttctccggtgacccgacggcgaggaagcgggtggacctcggcgggcggagcagcaaggagcgggaccggcaggtgctgctcgagcagacgcgggaggagcggcggcggcggctgggcctgcgcctgcagaacagctccgccacgaagatccaggtatgttcgaggcttcccgcgcgaggggaacggtggttttggggggttgtgaggcggggcggcgtcgctaggtttagcggggttttctccagcgcgtggggacttgagttgagttgcggcctcttgcagtggcggcgttcgggcattatttgcttataggtgttgtggttcgtgtggttttagtggtggtgggtagcattggcatgttggaattctcagcattaggtgatgtttgcttcaagttgtttttccttttccaatttgtgttatatgacgagttgtgtggagtgagataagttaatgtagttatggaacttgcgaatgtgtcattgtgtaggttaagttcagtggagtgagatgagataattatggaacttgcgaatgtgtcattgtgttggttaagttcaatggagtgagatgagataatgttgtcgtgcaacttgcgaatatgtcattgtctagcttaagcaattctagtagaagaaatctgtttattttttttcattgtttagcttaagcaatatagtataagaaatctgttttttttttttgcctgacgaggcaatgcgcaatctggtctgtgtagagtggctgaaacggtacttcctatgtatcaacataagacaaacatgtttttatttcccaaaatggaatttaactaattataagctgcagaaatgcttcagagggaagagagatttggaattggcacgttcggaagttcgagggaacttttgctctacttttggggagcactgccagagggttgattggtaagtattgccatggcttaaagcctttaacctatgccttgagctagctcattgactatcttcctactcaatcaggagcagtttcggtgctaattctgatttccttcgtcaattcctgttcttcttcaatgcaaagaaagacagtgatattgctatactctgtcaagtctgcaatttgctgttatattatgtcaaacatggtggtaagtaccaatgcaccatactactaattaccattgctcttctactatgtgcaaaatattatgtcttgctgtttctagtgctatagggatattaaatctatatatattgaccagagaagatttaattctaattatatccctatacaatattgccatatgagcattgtatgctcaaattctcatttgtgcctcgcactggtgatcatcttcctttcttagccatgaccctacttgtctgtttgtatgtttttcagtggcatctgaatgatgattaaggatattaaatttctctgaacctttatattatttgattttatttgcaaaacatgaggcttttgtctaggttgtgggatgtttgctatggcttgtattcttgtccttatggtgaacctttcaatgcattattccttttttttcatgcaccgagtgtaattgccttcctttcattttcgtttaggagatgttctaagactctttggtggtacaaattactcctcactggaacctcttgtgattcacagggttaaaaaacttgcactcatttgtgtgcaaactgtacatcagaaaaggtgagttcaattacagtaaactggtatatatatgtattgttttctgttcttgttttcaatcgcataatgcatattttatttaattgtctggtggataaaaatcacttatgttattctattgcttgcattatgaagtttctatggtagaacctggtaaacatgatgagtttcacttaatgaaacacttctatctcgagatacatgttcaattcaatgaacttcttttagtggaacattgcattgcaaatttgcaatctcacttggggaattcccacttatccttaatgtgaacttctgttttttgtgtcagtaaaggaaaaaaatatcaaagatgtgttgcaattgttgattttgctttctcttaccatccatgatccatgatgaaatgaacataattgtgtttgacttctttattatatttctataggcatgattggggcagtcagcttttgatgccgccagaaagcacaccaaagccttgtggttcattactcgaaactgccgcttgcttgataaatcctaagcttgcatggaactgcaaggtagttgggtatcttcagcggaagaagatctattgcttatttagggggattattatatccataccggtaagttgtgtttctgtattacggttttgtatttgtctactatcagtgcctacaccttttaggttacttgttgaccaaaatgtattaataagtgacaagtccactttctattgaaaatatacctttcttcttgctcaactctgatggtatatatcattggtcttgtctctgaattgatgaacatagtaaatctttatgattctttttttgtgattatgattcagcaaactgcaagaaatttggagcataataacaatacatctgctctggagcaagttcttatgcttattgcttcacatattggcgatgatccgtgttgttgtccagtagtggatccaagatggagtttctcctctcagcttctatcgattcctttcctctggcatcgtttatcacacttcaagaaggtgagttgttccatatttttttatcatttttttctgaagatattcatgtctgggaaatatagaaattgcaaaatgagatttcctatcatacctagtctttaaaatgtactggtgttatttctccattaattgaaaagttttgattcttaggagtttgtttaaataattagacgtttaaccagttattgcaagggtggtatatttgagtatctgatcatcgttacttattacttcaggttttctcagctaatggactcagcaaatattatatccatcagatagcttgctttttgcctagctgcgctgatgttcttccaaatgatatatcatctaatcatccaggttatgcatgtgttcttgcaaatgttcttgaagctgcaacctggattttgtccgagccaaagtttgcttctgaaacagtaggcattctacatctacctttcaagttgcagcaccattttgttgctttcagcattatatgatcatactaatattgattaaagtgagaggtcaccaaaaaccttgactttaggaaagagacttttagatcttgttatggtgtggtgtttatagagaaggcatttggatcgctttaggtccaatagctatattgtagtccctgtacaatattttggaagacacttagacccctctaagctccatttgctttgctattttatttaattagggttttgaacagggttggaaaaggttaagttggttggcaaacttaattggtctacgtacacagcattccttatcttagcttatcatccttcttgaacagtcagttgtttatgttaaaaaaaactagagagggaattgttgctttatgtcaacagtctgcatgcacgatcaattcttttttcatcttaaaattatttatgatgcatgcagttctttgattggccatacatgtatgaacatggaactaatattattttatttttctcgcaaaataattttatactatttattttttataactttttttaatataatgtatattatgattaaaattcatatgcaatcttcttgaatatgccaagagccatccctttcccacttcgttctggatgttcatttgtggatacttgaattcttaaaatgcacattaaattattttgattatgaatatcttacatatattttatttccaaaccaggcggctgacatcattgcagtctgtacatcactgctggacgcgttgccaaccattacatcacctaccggaagtaagtatcatgccagtaaaaatattccccattatttgataatatgacttgctaatatcatgcagtagcattttctattgccatttgtttctatcagagattcttgtgatactgagtaacacttgcaacatatcttctgaagtctaagtaatacacctgcagaagtttgttggaggcatgcttatgtggctcaatatttgcccctaat

SEQ ID NO: 81136 - DNA, 50178 bp, Oryza sativa
  unsure (1)..(50178): unsure at all n locations
aattaagtattaactataaaaaatttaaaaaatggattaatatgattttttaaagcaactttcctatagaaactttttgcaaaacacacaccgtttagcagtttgaaaagcgtgcacacggaaaacgagggagatgtgttgaggactcacggcaaagaacacagccgcatatatttaaatatacggttgcacaggacatacatagcttgaccccttttatacacaaaaggtaatatgtaaataaatgttgccgtcagacccatacacaaagtggtgtatattcaaccgttcaccgagatacctagatcggctaataccgtctggcacccctcacttaagtcgggttcgtcatccggctaattaacacaaagaagccacacatctcaaataaagaattaatctcaccaaagggacctcaattcaccagaagtattaattttccaccaatcacatagctccacataggaagcttcacacaagaccacaaagatagtagcacaacttcagccaccttagtcaagactctatctcaccttggtcaagcactcaaagcatggcgacagcaatggcagcagatgcatgcatatgagctccaaccaattagtgaggagtgagcagctcaggagaggaggaggagagaagtagggagtgagggaatagccaacaaatcagcgaaatgcaagattgtgccccatccattgcaagcaccaaattttgaatcccctatgattagtagccaaatagttcttggccaaatactcataccatcactatgtcggctaggaagaggagaagagaaatcagcaaggagggaatgtgatttacccaaggaagaggaaaggccaatgcatcggcgaagatgaacacgggagcacaaccatggacgaacttgtcacctaggcaaaggtgaatccctcaatacttggctttccttttttttttagcacctagcaaccaagcatctgttcccctacacctgcaaatcaccattagggccatcactaaattgcacccatcactgcacaagtgctagagccagagagatgagagaaggagagagagagagcacccgcagccgcagccgtagctgcagcaaccaccaccgccacagcagtagccgcagcagagctgatccacactagcaatggtagatcggtagccatggcttggatgatttagttggggaagggagaagtgccttaggaacagcagcaaggaagaagaagcggaggaattactgctgctgctgccttatctgttcgagagagaaggagagaatggaaggggattaaattgctagatgtacactactagactacacaagtcattaaattgaacctgctaccggaatagtattgtgcagttcaagcttagagttagataaattagctattaaacataagaaagctggcacaataaaataaactctgcagagcacattttaattggagagcatttgtatttcttgtgctgaaattttattgaagcctcagcgtatataacaaatttcaggaaagaagctagagttggaacgtgtcaattggcagtagtatattatttcagtttcgatcacagaaaactcaggcaagtccctctcatttgatcatgttgatagagataattctatttcaacttaaaaacctatttcataaaaatatttctcctagtattgcatcaatatatattttctagaataatgatatgaacgatgatgatatgattgacaagccgatgatgatggagatcatcgggatactagtatggtgggtagggggagctcagggatgagatgattgatgatgatggcaggtcagggctctccctacatacggtgtataaatataaggactaatcaccccatcattcgtatcagagaaccgtatataccgtgtcaaccatagatccgtcttaagatgggctggacctagtaccttatcaagtttattatactccacatgggtacgtagtagtagaatgggagatgatataaaccccatgaatgccgatgaagtgcattccaagcgcatatagtagcgcggtggtgtggagagctgataggctctacacaaacgtggagtgtagtaaattgaagtaggggaaaagttatgtactcttagcatggtgccgtatctagtgaagtgcgacaatcaaacatgttaagagtagctatgggtacagtgatacaagcctgcgcagtgctaaattaaatcgtgattcacgcctgtctcctggattggagtctacggggagttgctacaaactctattcaatgtacgagtgtactctagcttttataaatctccttttgaaaactcttttacaaaatagaaatatactttacttttgatgacaatgaaggtgatgatgttacgtaaggtatagtattgtagtatatagagttatatattattattcatgcgtgtacattttgctactaatgacttgctgagtacgaaagtgctcacccttgctatataaccccctttgtacaggtttgatcccttgcaagagtgagctggattagagatggccttaatactcctagggacgaattaaaggtagctctaactattcctctgttgcgatctctgatggtggattattatttggcaaaataatggttgttaaataataatctatgttctcgcacatttatctttagtgataaaagtgtggggcgtcacaaatggtagcaatgtaaatccttcataccatctttttggatcttagacatatgatgttatcacaaagaagttactttctacgattttgattcaacctgcagtatattttaatactgacagaataaagaaattcaaaactgatggaaaaatattatatacctgaattgcttccatatctcaaagaaggtgcaaataattgagattgaaatgataactgcaccagggccgtctatgtataccatgccaatggtactaccgccagtgccaaccacaggccctccttcaccaccctgcattaaataaataaataaataaataaatactactatgtagatggtaaaataaatagcaagtgtgaagaaaaggtaaatgtatcagtacctcaggaacatcacaatccacaaacatgtaatggtttctccacatcaaagaaccatccgaccacgtgattgctccacgcctcgccaccagggacatattttcgtcccgagacaaggcaagaatttcctggccatactttggggcggacccaaaagcggggacctacaatggtagttcagacgtgatctccaagatggagagattgtagtggcgattcatgaatctcaaccgtccctgcacaatagacttatctgggagatgaacctgtagctggaagatagagagagaaggcaatgcgagaaaaagaaaggttaatggtgtattgttacttatcttaagcacaaagagacggaactaatactaaggatatacaagaaaaggacatcaatttgacaatgataatgtttgagaattgaaatcagagggcagagtaaagttcacacaaagcaaatgcacagcagcccagctacagttagcaatcatttgaccatactatacttaacaaaaatggcaatggaactcggatgatagaaacatggggattagctaatggaaatcggtcatgcacctcgggttggggctcatgcggcttcttcttgaagtaagtgaagagtgtgaggatcatagcacacttggtggctccatcccaactgatgacgattccggtgtgcggagagatcaatttgccctctgaaaaacatacagttgattagaaggtagctacattgctaggagctgataaatacatatttttatatcgggctactgaatactaaacatattttctctctgcgacacattttcccatttgttgctggactacacatgcctatctcggtagctttcttctatgtcaccggcttttccctaagcatcggcagctagttaagcttgatcaataactagttcagcacaaaatccacggtaattcccatgtggagatgcagcatgattttctcatgtaatgctaggtagggaatgcgtaaaacaacgcaattaacgacacgcgacatgctagcacatggctcacttagtagcttatagctgcagcaaatatagtagattcagccagtaaaatctgaacatgcctccaaactcgtactacgatgtgtccatactccaaactaggttgccatattttgggacggatggagtaaattaccagaagatgggaatgaaacgcggacaattgagcgagacatgcccaacaccatgttcttgtgagatggggtaggcaaggcggccgcggtggagggctcgtcttctttatcgcgccggagagttaacttctgaagtcgatcaactgaagaacaagaaatggggagaaattaacatggttaataatgataggtatacaaaaaagaaattgaacaagaaacagtggtggatcgaaagctgaaaccaccttcgagccgggtgatccgggagcttcttctgacgcggggtgtcgtctgcgggtgcatcggcgggagtggccgggacgccaatgtgccatgcccctccctgtgtatcacacctgccgccgccgccgccgacatctgcgcctgcttcttcgccgtctcctcctcaatctctctcctcttcctcttcttcttgttgttggaagagattcccggcgattccaccgcctgaatcggaagaaccagtccaatctgctttgctctggagcgagtcaacctcccggaccacgattcgggactgggattgctgccgtcgtgcgagcggagatcggaatccggcgttgatttggaccgggtcgacatcgccggcgacgatttgggagcgtcgtggccgcctacggtcaatgccgccaccgatctcctcggtttggggggcatggccgccccccgccgcccagatcgccgccgctaggtaattttagggtttttgaaaaaaaataccgtgcgttgcagggttattttaatcttattattgtttttttttctagaaactatatacgagatttttattttaatactacttcatccgtttcacaatgtaaatcattttaacatttcctacattcatattgatgttaatgaatatagatagatatatatgtttggatttattaacatcaatttaaatatgggaaatgctaaaatgatttacattgtgaaacagatgaagtagttccttattgggatgatgataataatgtcgtttttttatggtttggcgagagtcataaaacaattaggagtctaactttcgtcccaaattagcatgtgatgtttttaaaaggatttcttatacgactccttatgtattttcaaaagcaaacgaatttaaaaacatactcagatacggacgacgtaccaaagtatcagcagtatcttcaatttttataatagtatattttcaacattaccaaattttaataatgataatttttggctcaatcaaattttggtaaattggttattgcgtttagtttgaaaccttgtcaaatcttgataaaatttttaagattagaaacttcttgtattatcaatgtttagtaaggtcgtattggttagaatatgtttgatttgttaccttactaattgttattcctttcttcccaaatttatcatcatatataatagcaggggcggaggtagtgtatgggagggagtgtgggagggggtgcttaggaacctgttgaagaaatttttttagttataactcaccatttttcatcatgtgtacacctccctcaatataaacttagacacacacattagcttaaacttgatcaaaagttgactaaattaagaaagaagctccgcccatagagtaaagtatacgaccggtccttaaatttggagcaatgtataaattagcacgtgtttgaagaaaaataaaaacattgttagatcgtggtgggtatacaattgattttatcacaacaatccagtagaagaaaactgtgcaacagtataatcacgtccaaaacaaatgcattaatagaaaatatttaaagaaaacatatttttttgaagcttgaagcaaataatccagataaaaacaaggcatcttttatcattattcttttgggtagtttttttttaatatataatctgcccattctaatttaagtaacctggacacatgtggatttatggctggttattcttttgtacccatagagagagaagagtaaagctttgaatatgcaccaataatactcaagtaattaacaccaaattaaagatgacattaccaccgcatatgtacatgtatgtattaatgtatacatataaaactaatgtatactcatgtatatacaaccgtagcacatatacacatacatactactatacgtatgtacatacacaccgacacaatcaacaaacaaattaaatagccaggtcccgtataaaataacccctattttatacgtgtcaaaaacacgaaacaaaggaaaaaaaaagagaacaaaaaaacaaaagaaaaaaatccgtacacgtatacagcgcaaataatacgctttgtatatgtattacacctctgatgattaattaagcctaatcaataattaaataatgaatcaagaatggctaatcaatcaatctttcgtttgctccagcacgtccaccatgagctgcatcaccttcacctgcacctgcagccgcgcgatgtagtcggcggcgcggaacaggagctcctcgccggaatcctcgccgccgccgccgcccggcacgagtctcctcagcgcctccatcttcctcctcacctccacgcaccgcctcatcctcctcctctccttgttgctaccggagttcttgcaggccgccccatgattactcgccggcggcggcatcaccgccggcctcgacttcgccgccgccgccggcgcggcgtcgcaacggccattgttgatggtggcgtgtgcaaccattgctagagcagtagagcttatattagcgaagtagtaacaatggcgatgattatgatgatgaagatgaagaagaagatgatgatgatgtgtgaaaatggctaagtatgttagagagagggggtagagatggttatatagaagggggttaggagggtacaaggctggagctaggttggaaggttgggggtatatgtgggggaattaggtggcatgaatggaaagttagagattaattattgatatgtgatcacaagcttaattaattgcatgaaacatggctagctattagatgatgtgtggataatgctctttacatgatacaaaatgttatgttaattagtgtgtgagagtgcatgcatgcatgggagaggaaggaggctagctttgcttgaggatgaggccatgagggcatgttctcctaactcaaggccacatgccaccacatgatcatatcatatataccttaacacagccaacaacacaacacctgtctctctctctcatgtatccaagcacaccaccaaaccaaccaaccatgaattagcatgcatgtaagtgcatgcactagctagctaagctaagctcccttttgatttgcctcctcatcacaacaccctggctatacccttgcatcatcaactctctaatatctctatgcatgtgttgtgtgtcatgtggactgctgccacctcagcaaaagttcatgcatgcatagagagaaaaagtctcctctcctctcctgcatcatgtgcaacatgcatttttttaaaaaaaagatgatatacatgtatatacttatgtagctagtgcatggtatataaatgtaccttgtgtgtagttaagtgtgtttagaggatgctattataatatagaatcatagattatactcacattgtgtgccaccatgttcccctatggggagctgatcatgatagccacccaatgtgccatgcaatcagggcaaatggagatattaatttgcaatatattgcattgcacatgtagattaatctccctgatttggggcttgattttgccatgttctcttctcatgctctcccacaatgacaaatattctcctcttggccaccactacaataatatgtacatgcaatgtacctcatgatctctgatcctgcatatatatatctgacgagccgacgacacgtgtcactcgcgccagccgtcgatctgtctatcaacagcgcgatttgcggaacaagattaactatagttggtggtgctgcccatgagcaagcatatgtattgaagatatatgtgcaacttctaggaagattccatggagaagattatgcaattgatcatataattaatgatgatcatctagttagttaattatgttcttttagtgaaattagttaattatgttgatgcatccatatgtggctgcagttgagcaacagccagcaggtttggttggttggttagttaaggttaattaagaatgcaattagattaattggaccgtacaaggggataagtctaccttagaaacaaaggtcaatgtgatttgagttattagtatatagttttggtgtgaaatactactgaaatggacgtcaatttccaggtcttagtttgctttctccaatacgcgttttgttaatcaatcaattagtttattatccctcattctgctgcaaatgaactgcacatgcatgctcgattaatttttcccttttgttcttgataccttaagctagcagctgattcacaaagattgaaatgatttgaataaacaaatgaaaatcgtgaaagttctctgtagaatttcaaaagattctgcctctttcggcagaaatctgttgtagcaaaggagcaaaccgaagcagataataatacactttattgacaaactactaactgtcacaaacttgagcgcgtcaggtaagtttcagatcctaaatttgtgtaaaatattgccattatcacctagtgtcagatcagattattatctcgatgaatcaagcgaggtaagaataatcttcgattaattttccccttttctcttctgataccttaagctagctgggtcacaaagattgaaatgatttgaataaacaaatgagaatcatgaaagttctttgtagaatttcaaaagattctgcctctttcggcaaaaaactgttgtaacaaaggaagcagataatgcactttattgacaactactagctgtcacaaacttgagcgtcaggtaagtttcagatcctaaatttgtgtaaaatattgccattatcagttactgtcagatcagatcattatctcgatgaatcaagcgtggtaagaataatctttgagaaatatttgcactaactaattcctactcgtctcattggaagaaaaaaaaaaaggaacattattctgaattttacaaatgagcccctgacgacctgacgttggcctgaattttacaaatacgtgtttctgcgtttgtttcgatcgggaatttcacacaagtccctgtttatttcagagaatcctacatttttgcaaatgagaccttataaaatagtattattccatgtcagcccttttcgtatctcctactattatacgcgatcagatcaagccgttgattccaagatcgacggatggagatgcttctccggtctccaagatatttccgccgccgatgaggctatcgcgattggctcagtgaagctgcagccaccggagaagccatggcgccgccgacggcgaggtctctgctcgcctcccacgccgccgtccgagccgcggcctccgctcgcaggggccgcctcgccggcgaccaccacccgccgcaggtcgcggccctccggcgcggggactgggtcaagctcatctgcggcgccagcttcgaggtagtagcacacttccgcttccttccctgcaagcgactgagttgcgagttgtagaagtggggatggaggagcagcgctgcgaacggagtagatatgatgagaaatgagagagagagagagagagatttttttttttttgctcttgtcattttgttaattttgcaaagggaaacccagctcaattgacctgtcaaggaacgatttctgatgaagttggtgcaaatccctcgtctcggggacatcgattttgaatttatattgagtaatgaaactagcaatggtgatagtgtgaatggaaattgtgaaatgcttgggatgtgattttcttgttcttgtgtaggatgctgccgatgtcaggaatctctcccttgtatacacgcttgccggaggtatgcttgttgctctaattataaacatttttgtggagcatatatgtagcatttcagaattcagactggcatcataacataatgggtggtgtttgaaaaatatcatgtcaacttggtaaaatagctgttttcaggaggtggttttcctagcgacctccttttgtttcgacagcttcttgtcggaattcgaagtttgtaaatttgtgcatacccttgatcttaatgaaatttggtccgcctctccttcggcagacctggcaaaaacttggtaaaatagctgtatattcagtgattccattgtgctaggttaatctactcttgataatcatggactgattttgtgtatgcagtggattgcattgattgtgcagcagacgcatctgtggtgggtgcagtgaatgaaggtattgatgtagcagcctcaattgtgccagcagttcaaaggccatgggtgatggttagtgttaatgacgattgcagagatcttcatttccgtaaagctggtaaatgatgtgctctttacaaaagttgtactctatattttgagtttatttttggatatttgttaatgccactttgaaataacagtctcgtttttattatcctcatttgagtatggaaaatttgaaattaaaagaaagttctgctgtatcatgttaaatgaacttggtttcctgctttcactagcaagacctgttgcatgtttatggatttctgaatacctttgttctttgcttctaaaggtttccacttcctttctcttttctctagaatttgatcctgaggattgcccaccagattgctcaaagccatgtgagaaagtctgtcctgctgatgcaatattgttagagagggttatgattgaggaagagcactctcagtctgatccttcatgtggaaaacttgaggtatcaattggtttgtttactttattctgcttttgtttattctcttcatttcattttatgacctgacctctgatgtcttgtgtagggtggtgtaattacggagcggtgctacggctgtggacgatgcttgtcggtttgcccttatgacagaataagtgagcactgagtaatgcattccttcgtttttcctttatggcatcatgacaatagtttacatgacctttgttcccacagtgttctttacatgtatatgtagcatccctatgtttttaagcataatctgatacttccacgcctttgtgtatcttatagaagctacaagccttgcttgaaaacatttcaggagctatgtcgtatgttcgagatcctgctatgactgctgaactgttgaaaaggaatgatgttgatgcaatagagatacataccactggaaagtacgtaagtttttctttgatgatttttataccaagtaacatttaccttttctccattactcagaccacttaatctgaactttttttgctactgtaggggaactgatatgttcaataccctctggagcaacttgggtgagtcaatcaataatgtgaagctgattgcagtaagtttgcactttgtttcatgatggatatgtttcctattgcatttaccatcataatgaataaaaaaaaaactcatacctttcaggtcagcctgcctgatgttggcgattcaacagttaatttaatgaatgcaatatacacaacaatgcagtcccatcttcaaggctataatctttggcaggtttgctatgaagagaacaaatgtatcaactgcagattctaatttgtctgtacatgatcatactgttcataactatacttttagcaatttgaaattctattaggacaattattttcttggtgttggctagttgattctacattctgtttttctgtaaatgctttgctggtccacttcatgtcataatctgaaccttatccatatccatatccatatccatatgctcaaaatctgaggttattcaagttaccttatttatacaagcagttagatggccggccgatgagtggcgacataggccgaggtgcaacgagggaaacagtatcctttgctgttcatttgtcttcaatgtcaaataggcctcctggtaaacaaagtcaatctttagaaaaaaaaaaactcgttatggctttgttatcatccacatttctaagtattttctaataatatggttttgaaggcttctatcagttggctggtggcaccaactcatacaccatagaatccctaaagaaagctggtcttttccaatctacaacttttcctggtattttgtttacttttttttaacatgtcaccggattttgtttactttgttccttttcttgttcaacttatgaggtcaaagaatactttaggcaaaatcacattttaagcccttgaactattaaactgtgtgcaattaaacctatgccttttgaaactgagcaatcaaactaatgttttatattctggtaatatgtttatttaatccatgaactatccaactttatttatcttactgaaacttaggggcagcaacctctggagtgactgattgtcagcaagcctttattggagggatagcttatggcggctatgctcgcaaggtttgctcttgatattacatttacagtgttttttattggaatgatactaaagtattcagcaaatacctgctagaatagaaaggctaaagcatagatactgtcagtggacgcaccaacacctagcaactagttaaatgaatgttgatctctatttttcttatttatgagttgcatttctcatccgataggattctaagtgaaatcattgctagaatagtcttgtatgtcatgttttgctcattttgttttttcttatgagttgcagattgttggaagagttctacgcaaaataccggcacaatttggccatgcacgcattgaggaccacccagattatctcctggaagcattacaagaagctctatcactagtcgggcctgtgaaaggttacccaaccttgccaagtctctgaaactagtaaatggcatctccaagttctcatccagatataggataactttgatccagttagttagtatggaagttgcattgtgaaggtaagccaaggtgagaaggtattctgccaactgattgcccaatgaacagtttgggagttgggaccaaccatttctggctaagtggcaaaaatcagtaatccaacagtcagcagatcaatcactaacttactcttaagcttggtaagtaggagatattccatctgagattggatgtcacaacatgctttccataaagtccatgtaaaactccataagaaaggtgtaaaaatccatttgttgtttgcatgtacaccttgaatattctatatagttcagtggacaacgaaggttttgacgtggacatgtactatagaataaaataattcaactttgttgcattttaaatggtccagaactccagattctagatgccaaaatacttctagaaaagatatattgcattttttttcttaatatcaggtcaattggatgtggatgatctttggataaggaatcttataccatgagcggtcgctctcgcaataggcacatgacgttttggactgatggtgcacgcatatattattatgtatggtgtttttactttcttgttttgtaaatacaaattgaacaacttgcacacatgttttgcttttttttcaagggacccaattggttgtcttattgttgattgagaaagaacatgtgcaagttgctaaattttgacattttatcttggagcaattaaatttaaagttctacaatttgggtggcattactatattattgatggattataaataattgaaaaggtctcttattatgcgtttggttgaaaatatggaccataattaaaactttgttgcttgttttatcaccatttttcctcttcagaaaggaagtgcacggtcaactcatcattctgcaaaactagctgcgccttttctttttgaaaaaaaaaatcttagatagaagaaatacaggttcatgactattttgaagaacaggaacagacaaattaacacttgaatactgattgacaacaagctaacaagataagaggaaccaaacaaaaaaaataaatggagaaacacatgcatggctgactgcttgtcaacgtggatcatcatcatacagatgctggccagctgtcatgcagaaagagcacaactctagacaatttctctcctttttcctcacatgaaagtaaaggccctgtggctcaacaaataatgtgaagatctctcattttcattttccttcttttccctagagaaagtagtagactgcaccaataaatatcctaacagttactcttcaattatatgttaattatatattgtttgactcttttttaattaaatttctataagtttaatcaagtttgtagaaaatataccgctattttcaatacaaagtaaacatattgccaaggtatatttaatattaaatttaatgaaactaatttggtgttacagatgttgctttttttcccaaagaactttcataagcaaaatatcaaacgacttataattttatgggggcgaagagagtatttattaagaaagcataacagctttgattataagccgtaacctttttagcaattaaaagtaatttatgtgtaatatatttacatatgtgtttttataaaatcaaaaatcataaaaataaaatataaatttaaaatttaaactttgactacgattgataagccaaagagcaaacactataacttttttaacacatatttgcatcaacaaatatcctcttattgaagaaaaataaaagtttaataagaaaaatagattaaaaaaccatccctggcatcaagataggcatgtctaaaactctggatcaaacaaatatgcttatgaatttcttgtttgagaataaaatagtgaaaagagaataaagggagaacaagcaggcgagtatttctaccttgcttccccatcccttccagcacagtgacctccacaagccaagaagctgcaagagcaagccaagccaagccaagaacgaagcagcagcgagagcgaggtgagcagcgagcatggcgggcgaggcggcggcggcggagcggtgggtgggggcggcggtggacttctcggaggggagccgcgcggcgctgcggtgggcggcggacaacctgctccgcgccggcgaccacctcatcctcctccacgtcctcaaggaccccgactacgagcagggcgagaccctcctctgggaggccaccggctcccgtacgctcctcctctcccttctcttccacttctacctcccatggcgctcgcgtagtcgcgttactgttcttgttggttgatccatccatcccatccgaatcgaagtcggatatgatctgcatgatgatggattccacgcgtaggctctgttcgatgaccagatcgagaggattaatcagtgatgcttttcagcttcttttgctgagtgattcagtgatttactcttctcagtcactgtggactgcttcttggatttttgcttatttggcgcgtagtagatgatgtttcttgattggttacttaagtttgggtgatttctttgtgtgaggttgggttagtttgcccattaccataatggaatcgaccgttgatttaccagacaccattttgtgcaacccagaaacgatgattgactagtggattggccgataatttgttgctaattgtgtactgccagctcctgggatcattcaccttgatatccttcaggcaaaccatagtgcatcatctttgtctcatcaaacatttttgcaagaacaggttacttggctagttggctagtggcagaatcacggcctagtgtacttaccattaatgggtgactgtgtatcttcagaatctttacccacatcctgctatatctccagtttaagattcggtgaacagtttaggaaaaatggtagatagttcatctttcatatgcagttgcgcacaatgtccatgtttcgcattataaagatagatgtcacaagctgtccaaacttttggagtttgctcctggtcaaaaaaaaacttttggagtttgcagctagagtatttacctacactgcacttaataatactgtgagtattgaaacactcatcagtgaaatattttgtcatgtacataaatggtaagtattggccatgtatttgtgctttgcgtcgccagcgcacgctagttgcatgtgagggattatgttatgctgatctcttattaaggtgtgtgtttgcatgatgcatttccaattcagactacttgcaagtgaaggattctgttttgttgatatgttattaaggttattctgcaattaattattattcactcagtgctgattattctagtctgcaaacaaggactgcttaacatcttgatttcgttgggtttttttaatatacagcattgattcccctctcggatttctctgaacctacaattgcaaagaaatatggagcaaagcctgatgccgaaacattggacatgcttaatactgtggccaggcagaaggaggtgatcactctctcaataccatatggttcaattaattggcactcccttgcaatattataaggtttttggttcttttatacaggttgtggtggttttcaaagtcctttggggagatccccgtgagaagctatgccaagccatcaacgaaatccccatgagctgcttggttattggaagcaggggtcttggcaaactcaagaggttgtaaccaaagcttttccccccattgttattgatgcacattgttcacatcattgccagttctaacctttgcattcctcttcctggttccttcagggtgctgttaggtagcgtcagcgactacgtcgtgaacaacgccacttgcccagtcacagttgtcaagacagccgatggttgatcctattgtcataaatatccatgtgttatatagtctgcttaaatctttgtccatctatctgaaacatattgaaccaccatgcagtgtaattgtaataataaacgaagtcaactgaagacgctcagttgtactttgtgcttgcactctctgagcctgactatgaaatggatcctgctgtttttcttagcaatctgtgctgaacttgagcaattttttttcctgttttttcacactgaatgtcttatcagagcacggttcatgcaagatcattcagcatggatcctgctgtttcccatagcagtctgtgttgcctgtctagcaattctgatatgcaatgtgacgcaagcaacttgagcatgttcttttttctgttttttttttcacactgaatgtcttatcagggcatgtgcttcatgcaatatcattcttcagcaagggcctcaattttcagaggctcctttgcacgtttttgaatcttgatctatctttgagatgagatgatagcatgggctgcaatacgtgttccaacctgtattccaatcacgaacagacatttttgttttcgattgtttgtgatggaaatcttggaattggcaggactaattttctgttgaacctcatgatcttgggagtattatgctacttgtcacaatgagctgattgtgacagggaagtaattgcatagagaaataatgcaaattctacactggaaaggcaatatctcagaaaggaaggcagcaaatatatgcatggtagaacggtgagcagccataggaaatagaggttcatcagccatgacaattctcatcatgctgaaatgctaaacatatggcctaatgccatttacatcaacaaccagcatcacagatacgatacaggtatgatcagtcatcacgacaccaaactacagacagcaggttaaggctaacacatttcaaatccattcatcaaggtagcaaaatgtgcagcagagccaccattagaagcagttcatagtggtccaagatagtcaccagccagggtagcaaggagctggaactggcgatcggcttccatccagcggaaccccatgaccttgaagcgcacgacggtgtccttctccagcttcgagtgttcattcatgaacaccgcgttctccccaccaatgtacttgaagtcgctcatcgtcttctccgacagaaagatgctttctatcggtccagatttgaggaaaatgccatgcttgaggatcttgtccacggagccaactaagacctcgcccttcataggcttctgcgtgatgcaggtgaacgtcaccgggaaaagaacgtctccggtcagctcacgcactttcccttctgatatcgccttcagctcactcacagcaatgtagtaaccatgatccttggaggccttccggtttgctatatcctccagaaggcggacaatgacagccttgcggagcaagagaccctgggggctcagctggctaggtgagatcaacacattcaaagacatctccaccttaaggaaaaccatggttgattgcctgtcaaaaagacccaatattcaagatgtcagcctatgcccatgcaacagtctttcaataaaagtaacatcaacaaatgtttaagagattgcggcacagagctaggaattgcatccccttctgctaacaaggatgaattgcacacttgcaatgttgataaaaggaatataaaatttcaaacatattttcaaggacatgacacatcaacagaaattcctcatgtctgcatgaacaaattcagtatatacacaactaggagcatcagattaaacggcaaagaaaaaaaatggataatgattccacttgatggaaaagactgggtatatttggctttggccttgtaacgccaatacgccatcatgtaaaaccatgatccaaccttttaggtgtatacacttaaaaaatttcaatttaatggtattcttaattcaatgctgcactttttcaggaatgtaacatctatgatatgcatatcacacacaacaagtgtagagaaggaaccagatctaccaaaagagttgtgctataatgtcctcctacataaacttttcacaaatctagctataatgtcctcctacataaacttttcacatatctccaagaaaaatatagtcaagggaaatgagaaaaccgcaaaacatttgcgcagcttgcaccatcagcatacatctatttgttttagcatcatcagatctgtaccagccccatggtctgaccagagataccagatccagtgcctaagttgagccggtccaccgcagagatcctagttggcccatacagttttcaagttgccaaggcaactcagcccacagttagtcctaaatgctagaaagagcccacagctggctttgaaacccagcaactacaagagtgagaacaaaccatttgagctaacagttgcatgtttcctgttgtgaaatgagcctacataagacagaagctccctgaattcatacaacattactacaatataagatagcagctccatagtttcgtattgcgaatgcacctacataatacaagacgttatcatcatacagaagctccacaaatccatacacttggataatacaacaagcatgtgattcaactggtgacctaattagggtacagccactgaacaacactggtttgttcccgctagtgcatttgcctactctcaagtgcacaccaggaagaactatcaagatttcctataacttaatatactagatagatttctcccatcattaacatccaatgctacacacaataagaatataacctcggataatgaacaaaaaagactccaccgatttatgaaagtcgccttgagtttgtgcagagcattttaggcgcaaatcaaagcactccgaacttgggacatggggggttcagttgaacccccaaattttttggggaacaaaaagaaaaaaaaactgttactggttgtatttaagagaggtttaaggctgtaaaaaagaggaggaggagagcttcttccagatctagactagaagagaagctagggttaacgcaagcaaattcccggtgggagagagagatgaatcagaaagaggacgtggatgctcaccaggatccccctccccctcccctgcgatggcgatcggcagccgcggctcgtcttggctggcgcaaggagcggaggagacgacgagacgggagattttcgtttacgccaagggggaggaggatactcgagtatcttctttcttttttttatttatcttctttttttttacttacttaaaagtgcacatttttgcgaagtttgagatggacaatctctcttctatgctaatatttcgaaatttttggccaaattttagaaatttttgtcccagagttattaatgtcattaggataattatacagtactaatcgaatctaactagtcggcgatggtatgttattggtatattgtagatcttgacaaacttaatggcatattatagaatatgaataaattcagtgacacacagcggattctctcttaaaaataatatagtaaaagcgtttctttatttcattcaaaacaaaacattttctacctaatgttaggagaacttcaagagaaggtaagaaaaagaggaggttggttactagcccaaatagacagaaactcatggttatgcttaaaatggaaatgagggagtccttgttagtgaacaaaccaaagtgtgttgaaagcatggcaacacgaaaatataaccatgacaccatcacaagctcacaaagatggaaatgttgttgtatttatcattggcatattgctctaggcccacatatcattctcgacatgcaaaatgttactttccggttcattacaaattaatctttatttctctacggttaaatttcagttcaaacatttaaagtgataattacttgtcgttcaaaccatcaaaatgttgaaagcgagaaaggttcattaccaaagaaatgttgtcttgaggccaaacggggcctaagggcacgtttggatcctgggcaaggctcatcctaacctcgcttagtaaagctacacgtttggaactggtaaaataatctggcttttggttttggggacgagctagctttgcagggcaagaaaattcttgctagccagtgagaaccgatttagctctccttcgacggcaaactccgttcgcgtgaaaatattggaacaagggcgatgcagacttctatgaaattggcgccgtaaaattagcgatgtttttcaatgactcacccaatcttgtcggcctcttcttccagatcttgttgtgaactctcgctcgctcaaattttgttgtaaattgccctctccaccaacccataaatacaacgaacaatcagtctggatctaaaaggaaaaattgatttatggaagaactcagcaacaagaggaactcatctgtagcagctagccattaatccttgccacaagaagcaaaaccatccaaacagaggagctacaacaaggctagcaagttggcaaatagatggtttagtgctgctaggctagctgggcgagcgaaccgaacgcgtcctaagttaatttgtcctattatatctaacctcgacacttgtactgcacaagacactagtgcgctcccttgaacagctttttttatggctttttcactagaagctgtaacaactttggtttcttttggccatctttcctccaattagaacaggattgcatacatcttaacagcaaagagagatgcaaactattaaagtttatcatcacaggaaaacttatgacatttacaactttgaaattgaaatatagcaagataaatcaagtagcctttccaagtttcttttgaccaaagaagagaaaagtgccaaagatctacatgacccagagttgttttattcaaaaaccaccattcgaaatgaaggtagctagatgcatgatgagggaaattttgttgcatatgggtgaaccccaaagcttacctaatggcattgtccgtcagcatttccagtgcgtccaaacctcaatgagacgcaccgtagataacttatgctcatgcgtcagatacacctaatttgaaccgacggtaaaggattctagacggtgccgtttgtagcggctttttcgctacttttcttggtgagatagaagacagtgacaaaataagttgcaaaaacaacaaaaatgtttatacacatgtacagcatgagctctacggtgtccctggagagcacaagctgtcaccaagccataacaaacggtcgaactgatcttgaacactggatccaatgcatggtttgttcagtgctcaaagagaacaccagcaaactttccatttagaccctcacaagccacaaatatgcggaaaaaaatgtcatattcaccctccaaaaagcttatacaaggacttgtttgtaattatcttaaaatacaggtgggtaattgcaaagtgagacatcttcccttctataaagagcaagcttagcttggtgatcaccaccactccacatctcttctccatcaagaatcaatcactcgctcgtcttctcctccattggagctctcgatcgagcttagctttgcgcttcgttcatccatggcgctcatcggcacggtggcggccgaggtgctcatcccgctcgcggcggtgatcggcatcctcttcgccgtgctccagtggtacatggtgtccagggtggccgtcccgccgcacgacggcgtcggcggcgccgggaaggtggagagggagagcgacggcggcgacggcgacggcgacggcgtcgacgacgaggaggacggcgtggactaccggggcgtggaggcgaggtgcgcggagatccagcacgccatctccgtgggcgcgacgtcgttcctgatgacggagtacaagtacctgggcgcgttcatggcggcgttcgcggcggtcatcttcgtctcgctgggctccgtggggcggttctccacgtcgacggagccgtgcccgtacgacgcggcgaggcggtgccgcccggcgctggcgaacgcggcgttcaccgcggcggcgttcctcctcggcgccaccacctcggtggtctccggctacctcgggatgcgggtggcgacgttcgcgaacgcgaggacggcgctggaggctcgccgcgggatcgggcgggcgttcgcggtggcgttcaggtcgggcgccgccatggggttcctgctggcgtcgagcgcgctgctggtgctgttcgccgccgtgaacgcgttcgggctctactacggcgacgactggggcgggctgtacgaggcgatcaccgggtacgggctcggggggtcgtccatggcgctgttcggccgcgtcggcggcgggatctacaccaaggcggccgacgtcggcgccgacctcgtcggcaaggtggagcgcaacatccccgaggatgacccccgcaaccccgcggtaagccacgccacgtcactctcctcgtcctcactctgttaaagattaagttaacacacataaaaattaagttaacgcacatgaaacgagaaagctattagcatataattaacttttctttaagataaaggatttaaataaaacccggcttctacatcccgaagaatgtacacagccaaccaaatccatacaaaaacactaaggctagtaaacatgattaactaagttttaattattgctaactgataaattgatatatctgatagtttaaagcaacttctgtataaaaagtttctgtaacgtatcgtttagttgtttaaaaagcacgctaatacgaacagaggtaatatctgaattttaatcagaaaagaacatgaccgaaccaattcgatctcatattttaaaacaactcaaagctgcttgcatgttgcatgcgagctcggttcgatctgagccactgcactaatctgaaagcaagtccagttggcctttttttgttgccttccttaaacattactaggaagcatgaaactcacgtgttcagtgttctctgctagctggcacaggcgtaacgcatgatttttaccggatttattcatagaaatataggagagagattgaaaatttattgtcttgtttggagaaaaggaattatttaaaaagtctcgctaggaaatatttaaattgtggacaaatttaaactgaatttgacttagaaatttaagtgaattcaattcaaaccaactttctttttaaaaagatcgattgaaacaaatctattttggcagttgatttgtgtatgcatccactttggattgttcttttgactgaatagctcaatatctgaatatttgtaatgattatttgaggttacaaacgaatgaactaaatattgttttcttttcgtttcgtattataagatattttgggtataatttgaatagatttatgcatgaattcagatacgtacaatatgtatatgtgcgcaaatttatatagatattagtgaatttagatgatgtatgaagaggccaaaacgttgtataacatataacggagaaaatatagagttgagatcgattttggtttgaaatagttttctcgaaagaaattatatatacaagaagattttataaaatgcttttatataattgtatcgtttaaaaaaccgtttaaaagtttgggaagcttacaaattcacccccatcgttcccttccttcaaagagaagtgatacatcatatatggttttgtacgtgcgtgtggatatgatgtgcgcaggtgatcgccgacaacgtgggcgacaacgtgggcgacatcgccgggatggggtccgacctgttcgggtcgtacgcggagtcgtcgtgcgcggcgctgttcgtggcgtccatctcctccttcggcgccgaccacgacttcgcggcgatgatgtacccgctgctggtgagcgccgccggcatcgtggcctgcgccgccaccacgctcgtcgccaccgacgccggcgagctcggcgccgccgacgaggtcgcgcccgcgctcaagcgccagatcctcatctccaccgtgctcatgaccgccgccgtcgccgccgtcaccttcctctccctcccccgctccttcaccctcttcgacttcggcgaacgcaagctcgtcaaaaattggtaaaagaaaaaaaaaccttacatagtgtgtaatttatttttttttggtttttttaaaaaattataattacacggcagacatacgcacacaaacaagaccacactcacatccctgtatacaatacattttttttaaaagttttacaattacacgggagacacacgtgcacagataataccacactcacatccctgtctatgtgcattcaacaacacattcttgatttcggagaaatcatgttaaaaacctagttacagtgcgtaatatttataagcaccaagatttgaatcttgttgggtggagccatgcacctatgactctagcagttgtacttgcaccaaatttgattaaattatggaataataatagttttgtctgaatttttgttgaataattcaggcacctgttcatctgcgtctcagctggtctgtgggcgggattggtgataggctacgtcaccgagtacttcacgagcaatgcttacgggtgaaaacgaattctacccacccaaattcgcgatgattctacattttgtaaaatttcaaattttgatgaaatttgcgttcaaatttcaaattgataggccggtgcagacggtggcgcagtcgtgccggacgggggcggcgacgaacgtgatcttcggcctcgccgtggggtacaagtcggtgatcgtgccgatcttcgccatcgccggcgccatctacgccagcttccggctcgccgccatgtacggcatcgcgctggctgcgctggggatgctgagcaccatcgccacggggctcaccatcgacgcctatggccccatcagcgacaacgccggcggcatcgcggagatggccggcatgccgcggcgcgtgcgcgagcgcacggacgcgctcgacgccgccgggaacacgacggcggcgatcgggaaggggttcgcgatcgggtcggcggcgctggtgtcgctggcgctgttcggcgcgtacgtgagccgggcggggatccggacggtgaacgtggtgagccccagggtgttcgtcgggctcctcgccggcgccatgctcccctactggttctcggcgatgacgatgcggagcgtggggagcgcggcgctgcggatggtggaggaggtgcggcgccagttcgacgagatcccggggctcgccgaggggctcgccgcgccggactacgccacctgcgtgaggatctccaccgacgcgtcgctgcgggagatggtggcgccgggggcgctggtgatggcgagcccgctcgtcgccgggacgctgttcggggtggaggcgctggcggggctgctcgccggcgcgctggtgtccggggtgcaggtggcgatctcggcgtcgaacagcggcggcgcgtgggacaacgccaagaagtacatcgaggccggggcgacggaggaggcgaggtcgctggggcccaagggctccgaggcgcacaaggcggcggtgatcggggacaccatcggcgacccgctcaaggacacctcggggccatcgctcaacatcctcgtcaagctcatggccgtcgaggcgctcgtcttcgcccccttcttcgccgcgcatggcggcatcgtcttcaaccacctctgatgaagctgagctccattgctaataaattaagctgcatgcatgctctcgccatgatcgatcagctgcacctgcatgcacgcatggataaacaagaagaagacgatgagcattagggttccttaaccagttgaaaccgataagagtaataattgtagctcgggataatgcagtgtcagatgtaatccaaagtgtcttgttgcttgggatatgtaatgcggtttgagacttaggatgtaatccaatgttgttttagacttaggctgcgttcgtgtggagaacaaagggagtttgtttgtttcgtttttcgcgtgcacgcttttctaaactactaaacggtgtgttttttaaaaaaaatttctatatgaaagttgctttaaaaaaatcatattaatctatttttaaagtttaaaatagttaatactcaattaattatacgctaatggctcatttcgttttgcgtatcttcccaattttctcaatcccctctcccccaaacacagcctcttaatcccatgtgtagtagtgtcgtcttaaattaccaaattattacctgttgataacacagcctcttaatcccatgtgtagtagtgtcgtcttaaattaccaaattattacctgttgatggttaagtttggggtcggcgttgtttttccaacgaaagcctgatttgagaacgtgcaaatgagcggtaaactgaacacccacacaatctttgatttgacacaacaacgttttgcatgaggaccaacagaacagagcaactttttgcctcgacacaattttgcaaacattggattgggatggtacaataaatcaagttgaaacgtgctttataagttcattaacataggtaaaaccttcctacaagtttgacgacgagtgcaatttgctctgtttttcccctaaatacgtagacgtatctgctggaaaccaatggacaatggtgcaagaagcagcagcttcatcttaaagtgatctcaaatcagcaatgggcaattcacagtggacagatatttgccatcaaaatcgtttgaatttcatatgttccaagctgtttccatcaaaatcatgtgaaatttaggcattccaaacagcccgacaatggtccacgttagtatatacaggataccaagaatttgttaccgtgtaaatggggggttttgagcaagatacttcaagctgttgtaaaatggttctgttacatgagtgacagcttagtggatcatcccataggctgattaaaaataagagatgtaaatagtccaatcgaagggcacattctgtgcccgtgagagagctcacattgatctttaggcggaagctaaaacagcaagaccctctcctttttgtctatagtgcagcaccaaatggcatgttggttctcagcttggtattcttctctttgagtgtcaatttacatgttcagctgagccgaaatcgcggttgagatatacaactttgaccaaaactatctcacctccgaccatgcttgctggctcgagggtcagaatgctatggattcaacgaccttcttcggagccaaatgtgaagcaattccttttcgtcgcaaggaaaagcaatcgacttgaagccaatagaggaaaaaaaatatttattgtcatctcactgaataaggctctgaatcagttgcttttgatgtatttacagtcatctcggaaggcgagttccctgcatctttggtacagtcatctccattttgatgagtggaatccaagcttcctgggtcatgttgtagattctgagaacctgggccttcctcccctacatcaccattgccttcagaagttttcgtgcttgaggaaggtggatggggaccctgtttatctgccaaattcgagcgtctgcctgccacactagccgcagcgacaatctttgagcagataaatctgggttccatctttggttttttgggagacctcccatcagcttgtttgtcatccactggattacgctttatgactaaggcctcatcatcctcatcagctttaacagcccttttgggaggtgggttgtaaccctcatcatcgtcgtcataatccacaagcccaccagatttagacctgaaaaaacaaaagatctgctaaacactggaactgaagtatgttttagagtccagaaattgcataatgtgcgcacagaatgtaaaacgtaacaagttattatgaatataaagaagaagaagccagtaaataaatcttcaatatgagttggcaggaagttatcgcaagttatagaagatgagataatgtaccttgcagggatatgacggatgtcacttcccttgggtaacttatccaaagattccttctgtgcatatgatgtctgtttatcagaatcttcctcatcactaaggtattaaaataaaaaattccatgtcagttaaggacgccatctatgaactcaattggactctttaacacaaacaagcagcaaaactgaagtggacaaacctgcccttgttgaaatagtcctcctcttctttgtcgagacctctttcttctggcttctttctcatgtcaactagactaatactttgtgttgtttcaccactctccattaactagcaagaagacatggagaagcattcaaatgaggcaacagtaacaacaggatgcaagaatacacagaactataagtttcaacctgttgatacttgagtttaaaggcctgaatgctccctagtttttcgaacctcacaagttggtcccaaaaggatttggtaacatgtatcacaagtgaattgagattttcctgtacaaataatgcatcaactgacagcacattatgtagcattataacaattggcaaataactcccgctaggttacctttcgtatgtattccaacagttcaaggacaacagaatgtagcatgttgtacctatccccattttcaacaaatacctcgataattggtttcaatgagttgaacttgataacatggctaagaagaagctcatcctgcagagcacatacaacactttatctcgagttccccaatgatgtcaatgaacctacaattagaattcaaactgggaaaaaaagtaaatgtcatacatttctagcaataacagtcctcatgaatcggacggctgccacgaccaaaaccttctctctcctatgggttaaagtaaggattttctccacggaattgcttcttaaaaagttgaccctacaagattagacctgccttttagcaaaacagcaagacatgagatgtccaaaggaaatattgaattaagaaaaaggaaagggaagcatttgcattgagtattacttgatcttgtaggggtgatgaactacacaaaagcataaaagctcgcagatgttagacagtatttcagtcttcacagaatggttttcaactcttgtacccacaccaactggactagatgttgattgggtaatgtccataggggaggaagccaatgctattacatcaatcaacttatcaagatgcttttcatgaaaaacatcaataactcctctctgcgacagaaagagataacaaaatttccatagtaactcaatacaaattacacgttaacagtcatgcttcaatattttgaagtgagcagaaaatcatgttggttcaagaaatatcaaaagtttcacaatttaggctagttcatcttacatagtttgtaggcatatttgtagcaaatccatccatcagaatcttcaaaatttccagaaattgacagtgcattccctcaccaaagtcagttaccatgccttgaacctgaaatttcagtaatagcgagcagtatttgtaaatacgctagctgaggcacaaacagcagatttgaagcttagcaaaaatgtattccaacattcctggacataacagagaaatggaggcacctgagaaaaatacctcaatcactagtaacttaatggttcaactacaaataaatgataggtcctcagattataaaataaccatcgctaccatttgcacacagaactttcccaagatttctgagttcattaatcagctgtacatcacattgtcaacggtcaagcatgcagctgttggtagtgtcgacaacaaacaggaaagagaagcatttgcatagatttgaagattaaaaaatgagaagagacatgattcgaactccaaaggctccacaacaaatccaggagtcgcaaagtgcagagaatatagctaaaatagcagaaggtacaaaagttgcagaacatgaaggccattaagaaatgtaattcactgcttggaccatgtataggacaggggaacataaatccaaaaccaggacccagaaaaggggtgcaacttacttaccagaagaccaagaagtgaatttccttcttgagaattttcttgacgagcaatatatgatctcagtaagttaggatcttgattaagaaaatatacaaggatgtctgtcctgcatttgccaaaaaagaaacagtgtgattagaaatagtatatgcaaggaaaagtcaaaaatataatttgctcattgctctagattgcataagttacccagctgagacgagcactttatcctgactctgcaacacatcagacatgatgtcaaacacaccttcactagcaagatccctgaacagggaaaagaaatgattaacctgctagaattgtctctccaattatccaatttacaaaactgcacttaaatgctatttatttgaacagttggttgcattattaatacaggtatatctgcatagcacgaaagaagacagggtaacaatcatgattcatagtggtgaacaatgtccttataaacacaaggagactgcgcttaagcaaatttgcattgtagaagacagagaacatgattcatagaatcatagtgttggcttgtcatgaggtgaatgagggtgcacaacacacataggccacaggagtaacatgacaaatggaaggggttttccctgaaacttatggaagtttatcatatcccatttcccatgtgatttgccaatgaaagtgaaacaaaaaaaatgaagctgtttacttttctctatcttctgaataagctaggaacaaacttcaaactaaaatgagctggattcacattactttttgtagagtatagatatatctaaaataattgtctaattttatctatcctccttctatcttatgaataaatgtgtgcattatatttgttgccagtaattgcctcgtatttgaagaaatatgttttctcatcaaaattaaatatatggttccattgtacacataagcaaactgaaataataagaaaaatagatgaaatactaaaccaggtacatcatcctgttctggggccataacctatcatcatcatgtttgtttgggcatcacacatacaacttcattactccctccatcccagaataagttaatctagtacatgatgtggcacatcctagtactacgaatctagacaggagtgtccagattaatttattctgggacggagtaagtactaaattaatttattctgtatgtactagattaatttattctgtactagaataatttatcctgtactagattaatttattctgggacggaggaagtactaaagagagaaggttctcaaaacaccaacctagatagacgtaattgctgaacagcctgcaaacttttagtgagagtacaaaactcaagcaaaaacaggacctgaaaaaacaaaatgttgtcaatccaaacagcatacacaagaataatctccccagctcccacccccaaacacaacacacaatcagtaacattatatcaatgttaaagaactgtgtgaaatgacatactccctccatcccaaaacataacaacttttgcatggatgggacatatcctagtactatgaagattcatagtattaggatatgtcatatgtctcatccacccaaaaattgttatagtactaggatgtcccatccacgcaaaagttgttatattttgggatggggggagtagaaggcaacaatgtgcataatacagaagtacaaactacaaaatatcaagaaaattgatgtctccaaaaactcacagcccacatcatataagcactcaaatgatgaagcaaatgttcagcatgcataagatattttggctcaactgcaaaagaagcatcccaatagtacaagatgatccaataaaactctttgaccagtaactggcttcagtaaagccaacacagtatctagttcacacaaactcaaccttggtttgtcttgttccctccaagcgcgcacaaaatcacaactcacagaacaccatgaaaacactttaattcatgaaagaaactagcaagcattgacccttctttttcttttccagcagctcagcgattggaaggggtagttctgttgaagatttgacagaacatactataaccttactaagattatgactagaaagaaaatttcccaggttctcatagggaagggtgtgtctaaatatgttagaaaaaaaaaaaccaacagtctcaccagttcgcgttttgattcagcagaaatattcgaagatctcatcttagcaaacagttcttttacaaaagaagcatcgtccttgagtaaacaaacaacctacaggagaatcacataatctgaaatagcgaaattacagaagaaagttgattcaaaacatgtacaaaatctatagtgttgaaatactaacagcagcattgttcgcatgaatgattgcagcaatgcttgccatggtagaatcatcaagtactcttggtaatataacatcctgtaaataccaagcaatccagaccaaaacagtcaagcacaaaaatggcaacagaatcaaaactactaaaaactccatgtagcaagggggcagagaacagagggcactgacctttatatagcctattctgtatgtttgatgaatctttgaaaccacagaagcatttttaatgggtatagcctatgcaaaagaaatcttgacatgaaaatcactccatcttaaccaggatatgatgcataaaactcggtttacctccttgaaaactacatgctccttcaggaaagtgcgatgattttgcacagtgcgagcctctggatcatctgctcagatcagatcactgtatcccattagtaacaaacagcgtatgcaattatacaggtatgttactatgtagaatttcccgttaaaatgacaaagcaagactttatcattactgatgtagacacttatagaggtcaagggtaattgcttacattcaagtgcgcctattatctcaagaataaaatcatcagagaaaatcttgtcatatatcgcagaactgttcaacaatactgcagaaggacaaacaaaataagcagcaatcaaacataacctatgacaaagcttaaattgccatgtacttactgattccctttactaatctaaagatcatgtggagtgcatccatgtttcctgaactctcacacgttctaaaaagattcactagctgggggaagaaatcatgctgcaacatattggggaaaattgaaaagtttagagcatcataatactcatataaatatccatcaatgttctagatttcaaaacttcacagttcaccctatgtaagaatataccaaagttgacaaaacggtgtgtggtttgttttatctgcaaacgaatttttatagtgcttatcaactgttcaagcaaaaacgaaccagaaccaagtgcgacaaaccagtgacctgaagcttatcttgcaaaatcatctactgcaaccaagcatgctcttgtgattaaattactgacttagagcacctacaacacccacagtccaacaagatattacattggtttaacagcagatccaaatttgtggagcaatgaagctcataactgagggccagtgtgtggttgttatcctatgctgtggaatctagtcaattacttggatcttcactattttattagataatacaattatggcacaataaaataggattatttccaactagaaaatataagttataccaaaaatccgctgcaatgccaaatggagcctaggcatcaattgtgaaatgaaataaagaaaatgaatagaggcatcttcctatgcctaacagcatggagctggggaatggcctattgtccaaaaataaatgggcagcctgcactagtttagccttaacgtttgtaacactcatgtacacttttatgcctgcaggaagaggcaagctacatgaccaacatgttgacatagaatagttcatgacttacatattgtaatattaactctgcaacagaaacacgcatccgctctgtcatgctgcactccaatatagtctgcatatttggtcaacagcatttcaacatcaatatgttagtataattcaataggaaacgtgtgtatctgcttccaggcatattgaccaaattaactcaggtctctaataccctacatataatgtttctaatgtggcaaccaaaaatatgcatcaaaaatcagatgatgagagcggtatataagtaaatggcactggaaagaaaataaaggtagcccaccacacctttaagatggaagatagactggacaaatcaagagggggaagtttctttaattctctgctggtagaacttaaggactcatctgcaggtaaagaaacaagtcactatcacatttttagcaaaaccatacacagcagacagctacaagcataaggcaataagaaatggtacactcaaattacattacattgtataaatataagaattcaattttctgaaccttaaatactttatttaggtatcctttcaaaaaaatactttatttaggtatcaggtggcaggagattaataagaaccttcagcattgcctctcaggcatggtaccaattagcagtcgttgcggccgttattgcggtagcagcctactgccactacgagcccgcaattcaaatagcggtgtagggcatcaggctgcagcatgcaccaacgtggtctgaagacaggctacactagaagagaacaaatatgccactgctagcttgttgtatgtgtgagtttcctcctgtgcaatgaccagaagctggaatatactggtttgttacatgtgtagctatgtatatgtgctatattgcctttcagttctacctttggttgatgtcctccatttagtgaacttccagaacatatcatattgtactaaaagttaccatgtctgcatgattagattaacttaaaattgtgagtactttttaattccactatagaaatatagcgtctgcaatccgctatgtcaataccaatctgctatttagtacctagctctcacgtgagcaaatagataaaatcggaacataacatttcatgtccgaacctgacagcgtatgtgatgagattaagcaagcccatcaaatagtttactcaagaattaaaccgagttattgggattttaaagttgaaatggggaaaaattaaatcctagccatgcaaaagagagatcatacaatcaaccttcaaatgttgcacaaccctccgtgacataactctcaagagggcacatcatgcatatgtacacagttccatgaagaagggaatgtgtagttacctaccatgaaaaggtggatttctagaggcttctaaagattcaaatgctgcgggtggagcggcttcttgaactgtaggatatagaaaaagtaaatgctgtaaaaagcaactcacaagaataacaggctaaaactacacaggttagaaaaaataccatcaaggacattaaattgtaaatttcgttgtatggtacacacactctccctgcataaaaccatcagaatttaagcagacatgaataagaaacttgaaatatgatagtaaaacaatccatttatagttgaatcaccatatgtatgaacatccagcagcttcttgaaaactcaatgctaactctagtgccttttcaggatccctccatgagatgattgtttcttccaacaaaaatggtaaagatagtacattaagacttaggagaatgagtatggccaatcttaaaagaaggacattgcaccacttcaccttcttgtttcctgtatatatcatcagatgtaatgtgatgaagcagtagcgtgtcactatcctcttcatccacaacagtcagagcaatttctcttgatccctaagtcaaataaaggttgaaaaggtgaaccttaaatggcaagtccgagattaagactgaaaatttaactgcaatcttggtgtcacactctacaagtagttcagccattctaacacgctgcttcctgtgttacttttatctgtgataagaatattatctctgttttgttcttaaatgcgaacatgaagatcagtgtttccataaaaacagattatccaatttcatgagaagcattttgaaaaagcacactcatgtgtaacagtataagcttaaatgccaaaaatatattgtcccacaaataactggaaacataattaacttcaacatattaatgatgaaaacagcacgatcgatattcaataaaaactttatacaaatttataaatatcagtccaatagagaaactaagatttgaagataaaaagagggtatcatcagagaaaccatatttagtgaaaatcactgcagcataggaaaggatataaggtttcaactcaatattcagacaaaattatacctcaatgtagtcgatggtaacatgccctgttccctgatcatcccacttcccatcatcagtcaatcggtacactttgactcgctggaacatttttcttcaaatgttaatagtagtgcttatgctgtatatcacaaaataaaaatacacacagaaaaggtacaattcttggaattgattttgtggcatgggccttgtatcattggcttgttcacaagtatctctgtatggtgtaattgacaacactaaatagattaacagttgcaagcaaagcatcttttcgggctattgtctggaaagatggcatggtgtaataatattatttttaagtcttttggatcttaaccaagaattacctccctgttaaccgaaatatgataagctgatatcttaatatagacgtaagatagcataatagataaacattgcttcagcaagtttttagtttaagatcatacagtaggacagtaaacaaataactgagatagtcttcctgaagtaggatggaccaaaaaatccttattctaaatggctactggtaaaacataacataatatagcatataattacaaaaaactggaattccatgcaatataggcaagttatacatggtatggtctaaacatcaattagctcaaggcattttgttataggacggagtaatgaatgtacacatgccattttgttactatcaagtaactatccaagatctaatatgaggaaaccaaattttttttactaacatttcctatggggtttgtgtaaatcatttgtcggggaatagtgaaaattaactggcgctcaaaatggaactgaaggttttctgagtgaaaactgaaaacccaagtagtcatgggatttgtgtaaatccttgttcgcataatagtcaagaagttttctgaagttcgaacaggaactaaaatgttctgagtgaaacacaattcgaggttattaactaaaagctgatgactcctcttgaacccaaccaaaacgtgataccttgtttctgttgcattctgtcttatcatgtcagttctgttctgtgattccgctttgacaaaaagaaagagcatactcgatttcaatagttttatgtccgctatcccgatctgtttctaccctatggagaaagtaaaggccaaaacagttcaccagacctgccttccaccgttctccacgcaagtggaaaagtgcatctacatttatgaggcggagcaggtggaaaagctctactccctgttagaatggagttgctaaccgtgatctacgagtgatgattagaaagggatcaggtgatcggcacctgaaatagtaagctccacagcacacaacgagacattcccctcacaattcaaccagaaatccccccccccaaaaaaaaaaaaaaaacccaatgaatcacactcttccccaaatcctgcacatggtcaggatatcgaatcaaccactaccagagcgagcaaccttgtcgaattcccgaaactcccaagcgaagtttccaccaaaggcgctaaacgaaagcctacataccgccgcgagtgggatctaccggccctgcatcgcccatcatcggcgaaccttctagatccttctaacaggggggagagatatgcggggactgggagggggagggagaagctcacctgcatgctgatctgcaccgcgtcgtccggccccgcctgcttcctccggggcccctgctcctcctcccccatcgtcgcccgccctaggcctgcctcaccgccggggaaggatggaaatcggggcggactcggggatcggggggcggcggcggcgagggcgagggcgagggcgagggcgaggtctagcagcgggaggaggaggagggcagcggcgaaaccctacccgccattgacgagcacgagcgagcgagcgagcgagctctcctcccttctctctctcttctcgcttcgcggctttctcctctgcgtctatttttttttctcgtttggccccctcgagtttttcttttcttttcttttgttgtgtgtgtgtgttttgttcgcttgcggaatggaggggggaaaaaaggaattgcggggggtgggagaaggaaaacgatggacacggcagtttggatattttacgtggtgtggtctttttgctacgcgtacaccatcaaaagttcgtctgggcccacttgtttgtttctcttttgagggggtacaatttagaactcacacaaacacacaccacaacacgcgtgtgtgcatcctaatatacgatagggttgagattggaggtactaggtcccattgcacgggaaacgtatagtcccattgaatgcacatgcgtgtgtgaaccatattccctagtagaaccacctaaacgtgatccctgggagccgggaaaaacctcggtgaggcaacgtgaaaatgtgggagtcaaactcgcgccgaccggttcgaaccacggtgaaccaaccagatgcgctagtgcaactccttggtctcatttgtttattgatgttcgagttggagggagattttccgcgcacacgaaacgaaaaatatcattagcatatgattaattaaatattaatggttataaaattaataaattgatttatctaaggtttaagtttaatgctcttcaatcaacttttcaaccttctaatatttaatctattcgcttgtaatatcccaactaattgtcaagagttctgttgaatccatatgcgctttaaaaccttggcatacgatgaagttcaccggcttgataacatagctattttatttttatggttagtgttttttatgcatgactttttttttggacatgtcaacttgattttgtggtatcagcattttttatcctttgatgagagtaatgactttttgtaattaaatcatgtcgtagcattgagtctttccacaattaaatgatagatttttatctataatgtaaacagattgaccgtaatgaaatatgagcactcaagcacctttaaggaaaaaaacaaggagtgcgtgagaatatttaggttgtactactcggtgcattataaatcatgcatatctatgatattttttccgtatgcgcatagtaaaatagtgagactttcaaattataaaaaactatagaaaaaaggtttctataattttttttatctatagtcgaaatataagatatattggacttgtcgaaataagagattggacttcatttagatgagtgattatcagtagaatcatttgatgttagtcaatgaaaggatatttggttagagagtagacttcgtgggatgcaaagctggttcccattgcaagatttcatctgtagaattatttagctgcagtaaacaaactgatcttacttttctcgaaaaggtaaagagaagtggatttctttagtcactagcctatcataaacaaaagcatgaacattaggtagaattcatagttgactaggctagtcctacttactagtcagcgatcaaccgatctagatttttataatactaattttcttccctttttcttacactaaatcattttatggcgcactttattaatttgcaaataaaatttcatcacctgagagcaaactaataataaatttgagaggttcctctacccaaccgttgattgggatccccgatttacaagccaaaatgtaaacaaagattatatttagaatcctcctattacgaaccattactttccctaagacaatggtttcatgttagcaacccacacaccctattatattcttgctagagaggatcacgactgcaataaatgtcgatgtaatatttaatgttgtttacggtaaattggacaattagctgctaataggttcagttttgatgtttagcaaaattcttgtgtgttagcactacaagtttaattgaacattcgatgtataattgctttaaaagttaacgtaagttaggtatttaccatataaaaatagagaatactaccttcatcccataatataaaaaaatttagagttggacatagttactaagaaaatatatgaaatcaaatagggataagttgtgattcgtagggaagtggatgtatgtgagaaaagtgaatagcgaggagttatgattggttgggaagacaatattagtgaaaaagttgttatattataggataaattttaagtgctataagttattatattatggaacgaagagagtaaagcgtagtatacatgttatgccttttcatccatattaaataaacacagacaaagtatcctccacattctcttaaattgaagttcaaacatacataagaactatcgtcatatgtgttatgaagacacatatttgtttattgagtatttttattaaaaaataatggtattatgtccaaattgccaaaaaccacgaggcttggcttgttgcacgtaaccacgagtattatgacctaatagtttcataaaattacatcattaacccatttttctttcatctactacaagcataggaaaaacacatatatgagttttccaaggctgtgttctgtatagcaccagttggattttttagcacacaaaatgagaaaagtcattaggtatgattaatcaagtattaatgattaataaatatatttgtgtaattttttaaagaaacttttatacatatatatattttaaaagagcaccctttagcactttaagttgtgtgctaactaacaacggggaatttgtaatttagagttgtagtttagaacatgatgtaattcatcgtataaatgttgttgcaatatagtataagttatacttctaggtactccctcgttttctaaatatataacaccattgactttttagcacatgtttgaccgttcgtcttattaaaaacttttgtgaaatatgtaaaactatatatatacatataagtatatcaaatgataggaaaagaattaataattacttaaattttttgaataagacgaacggtcaaacatatttaaaaaaatcaacaacatcaaatatttagaacggagggagtattattttttataatttagacaaaattcgtcaaaacccactcaaacccatgcccgcatccccccccctaaatgacaggtggcccccacccgcactcccctcgttccctccgcccccgcntaggcgccacagcttcgaattctccgccccctcgctcccataaaccccccgcccgccgcctcgctctccttatgccccccacctcgcctcgcgtcatccgccgccgcctcccattcccctcgcgactccggcttctcttctcccctcctcttgcgttcgtcgtgagggcgatgaactccgcggcggcggcggcggcgtgcgcctcggccccggcgtgggtggtcggcggcggcgccggcgggggagccagatccgcgcgggggccatgcgggatcagggtgtgcgggctcgggggcgaggcggtggcgctccgctcgctgcggatctcgcagggggcggcggtgaggcgggcggcggtggcggcgagggcggccgcggagaacggcgtggcggggagcggcgggttcgactacgacctcgtcatcatcggcgccggcgttggtgggcacggcgcggcgctccacgctgtcgaggaggtaagtgcggaccatgtttactgttcggtgtagagctctagccgtttctcgtcggcggcgctgtacccgtgatctattgacatttgaactgatgactgtatagaatgatctatgggatttccggtattatggagctgcgaacttaagtacttagctgaattcaaaatttcaaatgaactacttcgctagagctcatgctttgttgaaatttacactgcgaaatggtaactggaggtttttgttagtaagtaatttggtgctagcacaggtaaactgtttaaattgagtgctatcttgagctttgctttgggacttcagtggttagtccattgcagtgcgctgatagtctattaaatttatgctgagactatcactatgaaactagaaaatcttcctttctagttgaaatatttttttttgtcttgatggattgatgatcgtagaggtaaagaatatataatgtgcaactcaacgcatttgtaaaccaactctatcttgaatgcagcaccagcaaaatagtgacaactcggttgttctggtggttatctatttacaaatttcaatgttggcacactttggccctgttggagcctgccaagtgccaagcagtagcagtttagttggattattggcttacttgatatgttacttctttgttgatatatccgacaggccaacatacaaaaatgcacacacttttttgtttacaatccaaggcttttctgtagcatataacgcaaataagattgcagagttataaatgtaataacctgttcgttattactagtccactactgctgtctcaatgtgttaagtgttaactggcccaaatttgtgcagggtttgaaaactgcaattattgagggagatgttgtaggtgggacttgtgtaaacagaggttgtgtcccatcaaaagcacttcttgctgtcagcggtcgcatgagggagcttcatgatgaacatcacatgaagtcattgggtctacaggtattttgtttggatgaattactgcattagcctctttgtttgatgtgttgaaacttgaaaatagttcacataacaattgacaaatgagtggacttttaaaagatttgtgttctacagtattttttagtcaatttcttttaggtacgaccagtccattaaagctggttcacaaaataggtactgacacagggagtgtaaagcgtgcgaggttcctgttttcatgtttatcatttgtgtcctgaaattgatgtctatgtcaactctatggagcttaccttgtttcttactcacaatgcatcaggtttgctatatgtctatgagtctgtatctctgtgttttgtgagattgtccaaaatttaatgtcaccagttactaggcctattacctgtggcctttgggcatcggctgttttctcattcttgtgtgttgcattgtgtcctgcataaatcattaagcccattctctgtacaacaggtttcatcccctggatatgacagacaagctgttgctgatcatgcaaacaatctcgcctctaaaatccgaagcaacttgactaattcaatgaaagctctgggagtggatatattgagtggttttggtgcaattgttgtaagtcatccataagaccataacttcactgtcatgtacaatcatgagttatgcacatgagtgttacattctcatttttgggcaagaacagatgttaatatttctcttgacttatatacatgttatatgtaaaccactgagttaaatccttacggatagcactttgttgaattgtagatgcttagcttttggttgcatatcaatgtcggtgtgtcctacaatcaagtctattcaaatgttaccaagttatagctggaagtgcatttatgtgccccatgttttgttatggttcaagaattgacatatatactaaattagcagtaatttcttgtggaaagcagcaagtttattggttctcttagttatgagccattaaaatgtacatacatcactactagatgtatcatgttactatttgatgtggccaattcagtcgctgatggaataagctgacctattctttgaacttgacaacaatcatatcttgtggtagaaaatgcatacaggaatatctcatctgcgaaatatgacataatagaggattgccgacattaatctattcctatcatgatttgatcagggaaaacaaaaggtacggtatggaaaagttggttttccagacaaagaaatcactgcaaggaatatcatcattgctactggatcagttccttttgttcccaagggcatagaggttgatggtaagtactaccttttcttctcttgatggatcatgcatctcatttagttagctctagtttccagactgaacattgaagcaagtgatcaaatgctgaaagaagcatgtacttctagctcagttgtagtgaccatagtcttagctgtgtgccatgtgattactgaattgttttgtatatacaagctttgtggtagcttattctgaaacaagttttccttattacaatttacatacttaaatgtttttctaattgtccatgactgttggtatttattttggttaataaaacccattttgttgcaacttgcggcatgtgccataactagcataataaagccacacatgttttattagttttagacttctagaatcactagtggcaatagataaaacataatttactatttgttatgcctgaataaccttaaatgtgtgtctgtatttggatatcttagagatcccgatagaaagcattcgatcttggaagccacatgatctttgtgcccttctgctactgcttccatcttttgatgttataatctcagcatagaggagacacattaccattattacattatgtcctacagctgaatgacatggaagattagcacaattgggtttgcagacccaaatgtgttgcctaccatttcttgttatacctattgttcttacagaagcctgctgggcaacttttgtgcagggaaaactgtttttaccagtgatcatgcactaaaacttgagtctgtcccggactggatagcaatcgttggaagtggatacattgggcttgaattcagtgatgtatatacagctcttggaagtgaggtacatgaaagttcttgctgtgaataaattcaaggatatggcttagagaatcatacagtgagcatggaatcatgcaattattgcagaaacatggttctacaatgggtataactggaaaaattgcatctgtagttatctggatatgttatcctttttgctttgcatatagtgaccagtgaggtccaccctgttatttgattggatgcaaatttgactacactgttttcaacttacacaaatgattctattacagtagtattgtatcactgcatgctgatttttgttttcacatgccccctgaattgacagttttcattcttcaggttacttttgttgaagctcttgaccagctaatgcctggttttgatcctgaaattgcaaaattagcccagagagtccttatcaaccctcggaatatagactatcacactggtgtttttgcaagcaaggttaactagaccttctaccttagctttcttcataccgcagacacatttcatcatctctatgttaaaattgttgatgattttttctagattactccagcaaaggatggaaaacctgtgcagattgagctcattgatgcaaaaacaaaggaacacaaagaaaccctcgaggtaaaaactacatttaaacaatctttcagtccttgtacatagtatctccaattgcagttttactagccaactttttgttaagatacttcactcttcatatactcctatagctatatgacttactgattatcaaatgtatggacagttgtctcttttctatgtaacttattgttgtttagttcatctgtagtaagttgatactataaacatagtttttatttctccataatggcttatgtggaagatctaaaatgtggctctaggtggatgcagcccttatagccacaggacgggcaccattcacaaaaggacttggcttggaaaatgtaagtacctgaaggttgaaactgtttgctgtcagaacatttcctacagttaagtttcaagcatagtgaatcggaccctttttttcttcagatcaatgttgttacacagcgtggttttattcctgttgatgagcgaatgcgagtcatggatgcagatggcaatgtggtatgttgaaacaaatgaattaccatgctttgttcagaataatcctcttcctggcttgtatgggatctaacatgccatgcatttttatttgtaggttccgaacttatattgcattggagatgccaatggtaaactcatgcttgctcatgctgccagtgcacagggaatctctggtacattgcaaatctgtttagatttcatcttcttctatcgctcctatgttgcttatcgtatagttgcctgataagtaattcctatgaaaatgtagttgtcgaacaaatctctgggagggaccacatcctaaatcatttaagcatccccgctgcttgcttcactcatccagagattagtatggttgggcttacagaggtaagtcgggtgtaatcccatatagctttctttagtctgccctgtttatgcgttacttcttcatctacttctgttatattttctgtcttgatatttagtcttatattttctgtcttgatattttgtcttttccttgacgtaaccaattcgttatccttttactgtatttggtatgtatccattgcttcttgaaggggatctaaaccatgcaatctttatgatttccttgaccaagtgttatcaataaatattgcagccacaagccagagaaaaagctgataaagaaggatttgagataagtgttgttaagaccagctttaaggctaatacaaaagcattggcagaaaatgaaggagatggacttgctaaggtatacatgtttttagtttgtgccacttatttctatcagttttttttccttgcagggttatttctatcagttgtgttgtcttgtctccaaattggcacctgggtattgctgtcttgcatggcttcattcagtgacatactttgggcttgacaattgtatgttcctttctgcagttgatttaccggcctgacactggagaaattcttggtgtgcacattttgggtttgcacgctgctgacctcatccacgaggcatcaaatgccattgccctaggaactcggttgcaagtgagtataatgatattatttttcttcacttggttcgtctttgttagcctttcagcagtataacttgaatttgacatgatcactcccaccacgcaggacatcaagtttgctgttcatgcacacccaacattgtccgaggtgctggacgaactctttaaagcagccaaggtacacttcagcgctccatttttctcttgtgtttagaatccttgaccacatttctgaacagctgcaagctattcttttttttttccttcccaacaggttaattcgggtgtttctcattctgtaaatgaaccagttgcagcctagagaagggccggagcgcaagccaaagcatccaccacaaccactcctgaaggtccttagtttcgtcacgcgcctgctcacttcccagaaacgaaatcggcaaccatagttaagtgaggagcctctgacgaactcgaggcaaaaaggttcatagcgccgatctttctgtagcttccatctgtgtatgaacatttccagatttttgtagtttttcgtttggtttaattatacgaggggcttaattatacgaactcgaggcaaaaaggttgattgtcatgtaatatgtagccctggtgtagacttgatcgaaataatcagttctgctgctggtcctgtgtatcataaaaataatttatctgctcagcttaaatatgttatataggacggaatttcagaattcggaagaagagtttgtactgtactttgtagagtaaagagtttttggtacaattatgaccatggaaagttccttaattttgcagtaagttggggaaaccatgaaagagctgtcattaattaattactagtagctgttgttcatgtacagtttggttgttcattggttggttcgtgtatctgacgaacaaaaggagaaacctattgacatagacccaatttgaaacgcgataatttcatacatacaattttatggtatgaagactgaagtttcctaggcacttataagtatattttttagttaactattatataaataggctattagattatctatagataatttagagtcagtagatggttatattattaaacttgctctaaactcgtaatttgtcccgctaaaattcactttgctaggtagttatgcgggagacgtggaacacattaattttcgtgtttcgtgtggaacactcgaaaattttcgtgtttggaatcaaacggcatttcataaaatttgcaaacagtcacggttcgaggcggagaagttttgcacgtcccttcatcccaaaataaattcatttatcatccatcataaatattccaatacaaaagaggtgactagaatactcttactttatcaaatcccattataactatttatcactttatctaattctaatataattattctttacttttatagactccgttacaataaatactttagtttattttgagataaatgagggagctaaaaaaaatgatagacggatgaactagtattacctcaaaatttcgaaaattgcgcccgtcttccttcccttcccctcaatcctctccccattttccccgtcgctcacaaatctccgcttcgtcccccacccacccaccactccactccccgcagttggtggcccgcggcggcgcaagccctagcgtccacgcgaagcaaaccccccaaaaccctagctccgccgccgtcggcggcgcccgagctgcaacccccgccacgacgccatccgggtggctagcctaagcccctaaccaaaccctagcgaccggcgccgcagtcggggggagagatgccgcgggagatcatcacgatacaggtggggcaatgcgggaaccagatcgggatggagttctggaagcagctctgcctcgagcacggcatcggcaaggacggcctcctcgaggacttcgccacccaggttg

SEQ ID NO: 81137 - DNA, 67005 bp, Oryza sativa
aattcgagctcggtacccttatgagagcacgagctttgtgtacgataccacaatgagagcacgagcgcaacactcgtcaccgtggacttaaccacaacaatcgcactcatgtgagacgtcatccgctttgtacttgagaatccggcacctgagttttgctggccaggaactccaccatagccaacattgtcgaaatcttccacgaccacattgaccccataacattcgctcctagttcacatcacgaagtagaccattggccatcccacacaggcgatggtagtaaatgaagttgagttgtagagaagaagggagaagccttacatgtgtaaaaaaggggagatgagcatccgtgatttatttattcagcctcctgacatgcgaactgaataacatcgacactttccacatcaatgcattaaccatgtatgctgaaccgaggttctacatacaaatctgcatgcaaatccctccttgttttagggcaccttataatgatcttttagatgagccaccattagccataaggactggctacgaggaataaaaaataaaaaaccattcttcatctctctccatcgcagatccctctcctacgagtgctatgctgctgcggcctcctcctcctgtgagccccgctgcttgctcagccgcccccgccgatgtagcctcctcccacgagctaccacacagccgtagagttcctcccaagggcgccatggtcactgcttccaccacctcttccttccacgaggcaacgtaactattgctggatatgagctcttcctggttgggatggtggggaagaaaatactctctccatcccaaaatatacggcacaaccacgtttctcttatgtctcataatataaggcgtgcatgcatgcatacattaactagcacctcttggtctaataaaattgatctgttttaaatcctataccatcaaacctcctaatcacattgcttacatgcataaaggtgatccagccaagaagatgattaaattaatgttttcttgatctttgtgttatgagtggttgagcaaatggagtaaagaggactagaggagtcattggttggatggtaaaaggtggggcacagctaacttaacactcccttactactatatacattgtaaaatactctagatggtatataatagtggggtccacctagaacccacggtaagatccacttgcacattgcgcatgcttgaatttttcattttgggttttatgctgaccatatcatatactccctcaatctcaaaatataagcattttgaccctgacacgatctccgagatgctactttgaccatcaatatctataaaattaagatgttttcaataaaaagagttgcatattataatagtttgtttaatgataaatctagtaacattaattttacatggttaatctttttttatttttttgctattaattattaaagttaaaaatgtttgacttgacactatgttaaaaatgcttatattttgggacaggggagtagaaatttcaatctacaaaatcccactgcattacctggtttattaaccggttaatgtaaagagaggttttacagtgtttgcgaggtacttagaggtattgagaggtggagtaatatggaccgttgatcaagagaggggcaaggtatggaataaaattatcataaccaatggcaatgaagtaattaactagtgaaatattgccattattgccgaattgaataccttacttcgttgatcgttacggtaagatagagaaaatataaatctacctaggcattgattagatcaacacagaaaaaaattaggttatgttttatttctcttctcccacatcgtttcgttcttactagggtttgaattggttcactagaaaaaaaaggagggagaactgtcaatatggttgaggattgaagcgagacaaggttagccggtcaatggcaaagcgaagcgcatccgcaagatttcatttacgcagttgatttgtgatttacatagctcacaatttcattcatatataagagattggaatgagttctcctcccctgttattcttccagattttgaattggtgcactcgcaaggagacacagtcgtcatggttgagcatctatgcaatctacaacgaatatatatcaatggatatttggcatgtggtgtagacgttgtggcattgcaggccttctaaagtggcatgcaatccatggatggcatgtatgcacatatatgtccaataaatggacatgcaggaggtagtttccattttatcagatgtgaagtaaatcaaggagatggttatttttaggtaatattaaaatctaagtgtgtgaatggtattataaaataagttatttaattccataagatatataatttttttaattagtgaattctacaaaacatataaataacgtaacgtatgattaccgtacgaatctgttattaagaaaaaaaacgtaaatctcaaaaagaacacgcaaacaacatcctgaagataatgactataccgatgtggtacctatgtacttataattataccattctctatctcttagaaaattatctttttacccttactatctaagtacatgtgctaatatttaaataccttttaagtggcactttttattatggagtgttggatcattatcttttttaaatgtaaacaccgtaaaacctctctaatgtaaatcatagcgaagccaaatgggctacggagagcaaagctactacagcggtacagataacgtttcactgtgccagcgcccagcttggcacgaggagtaccatgccgtgcctgaccaagttacttttttttttccgggtttctctgtctgttttttcctcagtttttttttttggtttttctgtttttcagttcagtttttatacctacatatacaaagtttttatacatgtatattttttatacatacatatacaaactttgtattcgtgttcttttttgtttttttatgttttgaatatgtacgcatacacatataaagtttgtatacgtgtatatatacttttatacaccaaaagtataaaaaaatataatatatattgtatatatcgatatgcatacatataaatattatactagaggaggtggggtccaagaaacccacagcgcggtgggcacgcgaccacccgcgtaatagcgtcctccctattatgtgcactaagacctgtttagttccaaagtttttgtccaaattaacttccaattttcaaccacaacttttctatcacatcgtatcaatttcaaccaaacttcagcgtgacctaaacacaacctcagatttaaactcgccttttttttaagttcaactgcgctgcatgcagcatgacctgtattattgactgcattcatttcgagcaggtacgttgctcaattctcccggggcctacatgtcgagtatgcaggtaaaggaatccatgtgcaatgccaggtaattgacgaccgaccaatctataaccttctcctcattactgacaggatcggatccgatgaaatttgcagccaaacacacacacacaaacttgaataacaataacaaatttacgccaattatcttttatacatgcgcaggcgccgttcttcgtggcgacgaggatggtggaaaacctggtggaggcgaggcgcctctcgccgttcacggcgaccccgggcgcctacgcgcgcgcggcggtggggtggatcggccgcggcggaccgctctgcacgccgagcgtccggcaccagctgctgtggtgcgccgccgccgccgccgcgccggacttcgttctcgactggatcctcctgcgcagccacctggagcagaggacgttgctttcggcggatcagagcatcgagggcgccatctccgtcttcgcagcacagagttgattccagtgcaaaagggcacgtagcctgatgggttacagtgacccgagtaatacttcaagatccaaaattcaaattaagttcccaattaaaaaaactatatttatcctgttggatataaatgttgagtaaaattaaaaaaacaaattgagatgagtgacgaccatcttacgctgtactacattaaggtgtgtttgaggaggaggggattgaggagattggggagattggaaagatacgtaaaacggagattggggagattggaaagatacgcaaaacgaggtgagctattagcttatgattagttgagtattaactattttaaattttaaaaatggattaatatgatttttttaaaacaactttcctatagagttttttttgcaaaaaacgtaccgtttaatagtttaggaagcgtgcacgcggaaaacgagatgttttctctctcaatctcctgtatcacccgggaacgaacgaagcctaagtctataaaagcgagtcagcactcagcagttgcattgtactatatatatacacagtactaagcgtacatatcacctatatttatatttactgtacttccttaatatcaaaatataatgatttttaagagttttacatgatgataaaaaaataggtgaaattaaatgaggaatgtttgtgatcggttaagattagctacgaggtggaaaaataaacacggaagatgattatgtatttgtgattggctataacaagagagtaaggtggtgtttagatcagagacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagttcaagattatggatgggttttattaatagtctacgtttaatatttataattaattttcaaacatccgatgtgatagggacttaaaagttttagtcccatctaaacagggcctaagtaaagagggggatagttttaccgtccttctgaagtacggcaattatttactacctccagcaagtactaggtaagttgaggtaccaaaatatttaatgtttggtatactttctccagtaaagaaattgatattttgggataaatttttaacactagaagttgctactcgctagcatttattttttcatggggtaattgcatccatgctcctactttcaaagccaattgttgttttatccctattttttagggtttacacttttaccctcattttttaatctgaagcagccatgtaccccctctaacagtcacaactaacaaacgacatatatatatacccttggtggttattgcagttttgcccccattttttcagtctttttgtgattttgccccattttttttcagcttgtgtgagtgttataatgtgaggctttgaccggccaaagctcgtgcattcactctgaacccctaaactacaggtcaacgcctgtcagttaatcgagactacgatgttagtatgcacaattgataccacatttagtagtacatagataatacaacagggttgttcttattaaaaaaatacaacacggttgtgaattgttccaaaataaaaaaggtagtagcctcaaccacgccggctggccctcgacgcgaccgcgcggccgccgccgcctcgaccacgcctgcggccgccattgcctcgcgcacagtagctggcacgcgcccgcccacggccggcgccgctgcctcgtgcccgccgcctccggctcgcgcgcgcccagggccgccgcctccgcaccgcgcgcacgccgccaccgccgccggtttgtacccgccgcctccgccccctcgatccgcagcctccgcgccgcgcgtacgctgccgccgccgccacctggtctcaatcggcgctacggttccaggaaaccgacgcacggtggtgggaggagactcactcatcctatccattcctttaggggtataaacgtaatatcatatttcctaaaacatttttttatttccttttgtattttttaacacaacatcgtgggacccaccaaacggctgttacaactgagggtagatggctgcttgaaattcaaaaagtgagggtaaaagtgcaaaccctaaaaagtaggggtaaaacagcaattggcttcgaaagtgggggcatatatgcaattgtccctttttttattagcatttttttaaaaatttgatgaagtttatagaaaaatttagcaacatgtactacaccaaatttgtttcattaaaactaacatttaatatattttgataatatatttattttgtattgagaatgtttttatattttagtacaaacttgataaacttgaaaaaaaagagttagtacaacttataatataacacgaagtataatttttaagccaacagagtaatatttttaatatgtgtattttaacagtttacttcggattttaccgggaaacaatgatagtaaattttgttaaacatgataaataatattttcaccctatgtattactaaattgaacattggaatcaaaacaaccatgtgcacggacgacacacactctgctatgtacctatctatcctcttctgcctaattatcccttaaatttactcgtgcaatttgcgggtagctgctgcgtgccaatcggcaggtaaccgttccatgtccatgtccatgccagacggctgatgcgctagcctgccagctcaacgacgaaccgaacggcctatgcgcccgggcgtcagcctagtgctcgttataagcatcaacaacagtccttttatactactcccttggttctattttaagtatagccatggttttccgcgaccaactttaatcatccgtcttatttaatctttttttaaaaaaaaattaaaaacataagtcacgagtaaagtgctattcatgttttataatctcataacaacaaaaatagtaattataaaaaattttcaaataagatggacgattaaagttggacacgtaaactcatggttgcagttaaaatgggaccgagggagtatcatcgatcctaattttttagaattttggtgaaaaaaaatcctatcttgatactatttttcttttttgaaaactccatctccatattcttcgctcttcatttgagggagagcgacccaaatccctattttccgtgaggtttttctctttgtacacggggagagaagatcgcgcacttggagaagcgatattttttttacacgggtcagtggaaaaacaaatatttggttggttgttcaataagagggtccatttttagtttttaaggattaaatttaggctttcacttatagaaagaagtttttctctttctattttcaatttagaaaacccaatgatataattttgggatagattatacacattccgttgatgatgctcttaattacattcagctcgacgctgtccattaatctccggaaaatcttcagcttccggcacgatccgtggtgacctcgcgatgacagcgtacagtaagtcgtacagaccaagcccgtggaccgtggtgtttggggtggctcaagcaggaggccttgcagctggctgggcgtcaagttttaactaaggactcattcggaacaaattaaggttttgggaggatttaaatacgatgggtggaattactacgaggtaggcctctcactagagagggtacgagtaacctatatctgtacctaattttactcataaccatttcataattagcttattcatatccaatgggtatgtaaaatccatgtggccccacattattagaaatggctcaaaaacttgcacaaagttgcttctctgtataatattttattcctacgaaattcaaccaaatttgataagcttttatagtgtaaacgcaagtcttaaaattttgagactgagttctacatatataaaatgggtatggataaagtgagtactactacctccgttttacaatgtaagtcattctagcatttttcacattcatatagatatatgtctagattcattaacatccatataaatgtgggaaatgctaaaatgacttacattgtgaaacgaaggaagtaatgggtattacccttccctacccaaaactaaaatcctttctacccataccctccctaaatatatagtgtggataagagatcttttacagtgcttgaaaggtaactgaggtgcctccttaatcaattaatatccaccgataattcataaagcgtcagtgctcggcaactacctcagcacgctactcatcagtcatcgtcaccgccatatccaccaggggcagcggcctcggatggatccccgacaacctcaaccgcggccatctcgactacttcttctggctgctcaccgttctcaatgctgtcaacttcgtcgtctacctctggattgccaactagtacaggtgcaagagaatcaccaccactgaaactgaaactcaagcagccgcccagacttgaggggagattacaatcagaatcaaccgggaacgtatcggggaggagcgctcaaaagcggcaacggcgggtgcggccgccgtgagctcgtggtcgtcgacgcctcagcctcagccacctccaccgatgcctggaagtggaacggatcgggagttcagaacggatcgtacataaatatacatatattgaaaaaaaagaaaatatgcatttgcccttaacctcataaatcaattatgaaactcaatcttttaaccttccacttttcatatctggcccacccttttaataccttttcccttgtaccttctcttttggtgcgttagatcattagagatcaaccctactatgaggctgttgggaagaaagtattctccttggacttcctttaaaagtgtaattttatcatcttaagaaaataccataagatatcatattttcgatattttcaaatacacttgtaagattttggtcttataagtgctttctccgtaacaataaaatttctccctttgaaaaccctaagccattcatttggaattttggggaaaaagaacaaacacgagatattacatatatactaaaatgaaagtaaaaaatgacgccttatatttttagcaaaacaaccatacaatatatttacagccagttgttgaccctctttacgaacgaatccaacgtatgagccagagagctcaatgctcaaacccttctatcccagtggaatcccatgaagagaaggagatatgaaaggtggaaaaggactagagggctggagtaggaagaagatgataagcctcctcctcactaatcctagatccggcctggcccctatttatgccatccacctgcccttgtgacagtgtaccagtgcgagtgatcgatcccaagtttcagtggtccgcgtcctgccggttttatttcatttcaattcactgtgacattaacacacactactgcttcctaccgtgcctaatcacaccgccaaattattactcgtgtgcattagtccgtgccgcatgcgttccgtcatatatttccacactatatatcgcatatatctggcctgtttggtgatatagttttggcgactcggcgagtaaccgttccaaatcgctctcaaccgcgccatggccggctagactgcatgctaatgctacacatttatattgtacaaccccgccggtggggaggaagagagagcgagagagcgaatcatcatggctagtcatgtcttcatgatccggcaagagacggcgccggcgcagtggtggttcctctcgctggctttcgtcggcgccgcctacgccgccaccgtcacgctccgtttcgtcgcctacctcgcgctctgccggtgtcaccggccgaaggacgacctccgccgccggtacggcgaatgggccgtcgtcaccgggccaacgtccggcatcggccgtgccatggcgctggagctcgcgcgccacggcctcaacctcgtgctcgtcggccgtgacccagccatcctccgggagatctccggcacggtcaggtctctccacaaagtgaagaccaagaccgtggtgtttgacctgtccctcgtctggacccccgatggtgatgagccgctgcggcggctgcgggaggcggtggaggggctggacgtcggggtggtggtgaacaacgccggcgtggcgaagcccggcgccgtctacctgcacgaggcggacgtggaggcgtgggtgaggatggtgcgggtgaacatgtcggcagtgacggaggtgacggcggtggtgctacctgggatggtgtcgcggggtaggggcgccatcgtcaacatcggctcggctgggtcggagtacatcccgaccttacctctctacaccatgtacgccgccaccaaacggttcgtacacacgtaaagtgacatgtgtcataacttaaaaacaccatactttagatcagtggtattatactcttgtgtacatatgaatagaccatgagagtgaccggcctgttcatttcgatggagcaggtacgtggctcagttctcccggagccttcacgtcgagtatgcaagtaaagggatccatgtgcagtgccaggtaagttaatttatcagaaatctgtaaagaggccctgtttagatcttactttaaaattttttatcatgttacatcgaacgtttgaacacctacatgaaatattaaatataggctaaaaaataattaattataaagattgcgactaattcgcgagacgaatcttttaaatctaattgctacatgatttgacaatgtggtactacagtaaacatttgctaataacggattaattagacttaataattcatctcgcggtttactgacggattctgtaattagtttttattagtgcccgaataccttatgcgacaccctatataattaatatctgatgtgacatatcaaaactttacagccttagatctaattaaacaccccccatgcataatttgtaacttccatttgagtttactcattgacagattatgatgaaatctggaaagcataagggaatcaaatagctaggagtatgtatgatgctatgtatgtgcatgcgcgcaggcgccgttcttcgtggatacgaggctgatgttcaggttcgaggaggcggcgggcggcgtatcgctgttcacggtgacccctgacgcgtacgcgcgcgcggcggtggcgtggatcggccgcggcggcgcgctgtgcacgccggccgtccggcaccagctgctacggcgcatggccgccgccgcgccggactccgtccacgactggatcctcctgcgcttagccacctggaacagaaaacgttgtttcagcggatctgagtgacagatgacagattatgtgatgctaaagaattgccaacaaataaataatgtgtcttcgaaaagtgcaattgccgagaaattgtttgttgcccattttatgcatatttgcatacacataatcggttccgagatctagtattttcccaattaacttctgttgacaaaattggaccatggtgtagcgctggcgattggcgtttggtattgatttagtagtatcaacgaacataacaacgagtacttgcagaggagtcttaattatcccaaatagtatatatggggagtgtttgagaggagaggaaaagagaagattaagaaacgaggtgagtcattaacgtatgattagttgagtattaactattttaaattttaaaaattgattaatatgattttttaaagcaactttcctatggaaaattattgcaaaaaaatacaccgttcagtagtttgaaaagcttgcgcacggaaaacgacgtgttttctctctcaatctcccaggatcggaaggtagtgatcaaggggatcgtttcacttatcgcgtgattatcgcgcttaccgcgcgggtacggtagggaaaccggcgatatggtttggaagaattttcaccaaattcaaaattccggaaaaaaaattaaaaaaaattgaaaaaaatcatggatgtacttcttaatttgtaattgccaatggtaaagaaattttttgaaatagagaaagctagattcaaatttgtggacaaaaccgaaaatagtttacaaattaaaaaaatgaagaaaatattgggcgttaagtatcctacgtattcttccaattattctcaatttctagttttctacacatattcaaccataattttgatttttttccctatttattttttatttacatgatttcagctacacagctcgtgataaccgtacggatatcgctgttatcgcggtaaaccgtgcaattatcgcggtgaaacagcgaaactgacgagttttgaattcgaatttttggatgtgatttttgtgtgattttaggcgattatcatggttatcgtcctaccgcggggtggtggtaaccctggtccaaacgataaggtaaaccctggggatcacacatcatgtccaagaattacggttcaatgttcgttgtgaaagatctacatataccaacatcggcataacttatcaatgaactattggtcgatttccagtgacaacaccgagttacgcgtgtgtgatcgacacacgaggtgtgtgtttaagaaaacaggcaccgtcacgttcgtggtgttttgtaccggtgcatcgttctttgaaattcatgcatacgacgatactcagtaatgtgatttgtcggagtgccgcatattcacatggtttgtgtatcttttttctgctacatactactacataattagtttttataggtggctgaatttcctttctaaaggcggttaataaaacgccagtgaaaaaatgaaaatacaaaagattcccgcatggagctgctatctgcatatcacagtccacacaccacattgtcccatttccatagagaattaggatgaaatcaccataaaaccgtggaggataggggtgaaaaatgagcggattcggacggataatagctataccatatcctaaaccatattttttaagcggatgcggagcgggtgcggatgacgtgcggatgcggatgcggagcggattatttcgaacgtcggattcagtgcggagtcggtgcggactcggttcggaaacggacaaaaagttatcggatgttaagtttgtattcaatccatacaacaagagggcggcaatacatttagccccaatacgatggcaaaacattattagttcattgcgttcagttcaatagtaatagtataacaataagtaataagtgttcggttcaatagttcactagtaaaaataatccaagatacatccatgatccatcaaaaacataatataagtgttcagttcaatagttcaccggtcactacgttaaaatgtaaaaataaaagtcatcggcatgaggcaagccatacaggcatacaacaacagcaagcatagagcagtagagcacccctatgcagtggtgctacacgcagcatactgcatacaggcatacagcagtagtagtacaggcgtacagcacaaaacacacagcagtgagcagctagcagcctcctgcagccggcggcggcgctagcagcctgcagccagcggcggcggcactagccgaggaggagtggttggcgcgtgttggggaggaagatcggcctggcgcgtgttggggaggagcggccaccgcgcagggtcgccgtcacgccgtgccaccgcgctactctctccgactcctcgactgacagctgagggacggcacagagagagagctagagacggatctgggggatgaggagaggattaggttaggccaggttgggctattgggctagctaggtgggcctgaaagttgttgtgtggcctgaaatttgcggattatccgccaaacagtacatcggataatccgattaaaatatcggataatccgcatccgtcggatatcgttcatgtcaaagatagcatagtatcttctatatttggtgattgagacacgtatagaaagtcctctatcaccttcctttttatgtaattacattccattcatgtaatcctggaatatatttaattgaagatagccagcacgattgtgcttgaactgtgccaaatcctctccctgtttgcttggtatcagagcaggtattctgcttcttccaccccaaacttcccgatcccttcttccgctgcctctccatggatcatcagctccgtcccaacaacgaggccgctgcagccgcgggcgctgccgccggtgcccctgctggtggtgccatcgtcattcccgctgcgggtgccgctgccggtgctgccgccggtggtgccgtcgtcgttccccacggacctgcagcagcagcactcaccatcgctagtgtcaggacgcatgtgcctgtaaccctagagatgaaaaaccacaactacaccaagtggcgtaccttcttcgtggcattcctcggcaagttcgctcttctcctacacatcgtcggcccgatcccccccattcacgatgccgcctgggcccaagacgacttcgccgtcctcaccgccctctactactccatcgccgacgacgtcctggacatcatcatggagcccgagcagagcgctcacgctctgtggcttgctgcggaggaccttttccgagacaacaaggagactcgcatcatctacctcgagaccgaatttcgcagtctcaatcaaggcgacatgacggtgacggagtactgccgtcgcctcaagactctcgccgactccctccgcgacctcggcgagcccgtcaccgaccgcgcactcgtcctcaacctcatccgtggtctcagtccccgcttctccacccaggcggacctccttcccctgcagacgtcgttccccaccttcgcccgtgcccgctcggcgctgctgctggcagaaatgcgccacaccgctgacagcatcaccaccaacaccactggcctcgtcgccacctccgactcctcgtccggcgggcgttctttctccaacaatgggggtggaggaggaaaagggcgcgggaacggcaaggggaagcgaaccggtggcggtggcggtgggagcggaggaagcagtggtggcaacggcggatccggaggccgcaactccaacggcagtggcggtgttcctgcctcgtctggcaaccgcgcaggggtggcggcggtgggggcgaccagaccgggtctggtaaccctcgcccacccactggaccgtgggttgtttacccacagtgggccgccgcttcgtggcccaccgcaccaccgcagccctggttcgcttcctggtgcccagttggtggaccgggcctcctcggacctcggcccaactatctgccatagcagcagcaggccttcgtcaccaacgactccatgggccagccggcctaggaccagtctggtttgatctctgcgattaataacatgtcgttgcagggaccttataacagtggctgggttgttgactccggtgcttcctcccacatggcctcctctgatggtatactccattcctctcaaaacccctcccaccccaccacagtcacagttggaaatggctcgtctgtacctgttactcgtgttgggcgcacctctctacactcctttaaactagataatattcttgttgttccttccattgttacaaatttactctctgttcgtcgctttactcgtgacaactttgtctccatcaagtttgacccttttggtttctctattaaggacctatggacggggaccgtgagacttcgcttcaatagctccggcgatctctacaccattcctcctgccgtcgccactcgattccatcccaacgtcgtccccaccagtccacgtgccctcctcgccaccgccccttcagtcgacctttggcatcgtcgcttgggccaccctggacgcgatgttcttcagcacctgcagaagcgttcttttatttcctacaataaaaatagtacacattcttgtcatgcgtgtcagctaggcaaacatgttcggcttccgtttggttgttctcgtactattacaactgctccctttcaaatactacattgtgatttgtggacatcacctttattaagtaattctggtttccgttactatcttattattgttgatgactactctcacttttactggacgtttcctttgaagcaaaagtctgacgtttttcccatttttcagtcttttgtctcgtatgtccatactcaatttcatctcccactgcagtgttttcagaccgacaacggccgtgagtttctcaactccgccattttgtccttcttcgacagccatggcatcattctccgcaccacctgtccctacacctcccaacagaatggtaaggctgaacgttctatccgttctaccaatgacatcattcgctgtcttctgtttcaggcccatatgcccggctcctattgggccgaggctctctccgctgcaacctaccttctcaatcgtcgtccatgtcaacccattcagttcgccacaccctttgagcgcctgttcggtatttcaccctccctagaccatcttagagtcttttgttgcttgtgttaccctaacttatccgccacagcaccacacaaacttgcccctcgctccacatcttgtgtttttctcgggtatcctcattcccaaaaggggtaccggtgtctcgacctcaccacaaaaagggttcttgtttcacgacatgtttatttcgatgaaacgatttttcctttctctactgctgcagcaccatcgaagtcttcttcactagacatggacttgtccttccaggatgatgcacctggacaaggtgttgggccagctgcagcccacggacagggtgcccctgctggagggccaccctccccacgcccgggtcctggtgcacgtgctcctgaccacgggccggcctcgccaccatcgactccacggcctgcttcaccatccgctgggctggcctcgccaccgactccacggcccgctgggccgacgctgcctggctcgcctccagatgggccattctcgtccactgggccggttggtgcgacctctccatcagctgggcggatcgctgccgccagtccaccaccagcgggcgatgacgcgccatcgtcgtccgcatctacgtgccatcctccaggggcgccgtccgagagcggcgctctcccacggcctgctcctggccctcatccgatggtgactcgtgcgaaggtgggggtggtcaaaccaattgactgcctcaatctctcgaccgtccacaaagacgccgctccgctcccgaagacgtaccgcaccgccttgcaagctccatgcaatgcgtgacgaatatgaggcgctggttcacaacaacacatggaccctggttcctcgtctccctggggtcaatatcgtcaccggtaaatgggtcttcaaacacaaatttcatgcagatggctccctcgctcagcacaaggcgcgttgggtggttcgcgggtactcgcagcagcccggcatcgactatgatgagacttttagtcctgtcgtcaagctggctacaatccgagtcgtcctcagcctcgccatctcccgcgggtggcccattcaccaactcgacgtgaagaatgccttcctccatggcaatttggaggagacggtctactgtcaacaaccgtctggcttcatcgaccccgtccaccccgactacgtctgccacctccacaagtcattgtacggcctcaagcaggcccctcgtgcgtggtatcaacgcttcgccagctacattcgcacacttggcttcactccatcggcctcggacacatccctattcatctacatgaacggggctgacatggcgtatctcctcctctacgtcgacgacatcatcctcactgcctcctcgacacggctacttcaccacctcactggtcgtctccatgacgagttcgccatgatggatcttggggatctctaccacttcctcggcatctccgtccagcgcacccccaacggccttcatctgtctcagcgacagtacgccgtcgaccttctccagcgggctggcatggccgagtgccatcccacggccaccccggtggatacccaaggccaagctctcggcttctgatggagaacctctccgtgatccaacggagtaccgaagcctcgccggggctttgcagtacctcactctcacccggcccgacctcgcctacgccgtccagcaagtgtgcctacacatgcactctccgcgtgacgctcacttggccttggtcaagcgcatcttgcgctatgtcaaggggtcactggatcaagggctctttctccatgctaccacggcatcgacgctcacagcctacagcgacgccgattgggctggttgccctgactcgcgccgctcaacatcaggttattgtgtcttcctcggtgataatcttgtctcttggtcctccaagcggcaagccatggtctcctgctccagtgccgaagcggagtatcgtgctgtcgctcatgctgtcgctgagtgttgttggcttcgcaagcttttggatgaactctgcacccctctccgctctgcgacagtggtcttctgcgacaacgtcagtgccgtctatctctccgccaaccctgttcaacataaacgtacgaagcacattgagatcgacatccactttgttcgtgagaaagttgctcttggccttgttcgtgtccttcatatgccgtcgtctcatcagttcgccgacatcatgacaaagggactaccagttcagctttttcaggattttcggtccagtctctgcgtacgggaacctcacgtctcgactgcggggggtgtcaaagatagcatagtatcttctatatttggtgattgagacacgtatagaaagtcctctatcaccttcctttttatgtaattacattccattcatgtaatcctggaatatatttaattgaagatagccagcatgattgtgcttgagttgtgccaaatcctctccctgtttgctgttcataccacatccgcatgacaaaatccgcatccgcatccggccggatatctaaaaacccttgccaaatcctcacatcggacggattcggagcggatcggatcggataacatccgctccgttttcacccctagtggaggaggataaattgtctagtttcatcagatgatgacacctctatatcggttagctcgtaactcctggttttggacagcctagcctagtaaggtagccaaccgtaatctaacacaccgacggatgcagatgcagcaccacgaagcaacacccagctcctcctctcgacatcgtcggctcaggcttcaaacccatgatacttgtcccctctcctctcgactttccaagggtacgccgcaggcccagcatcgccgcgtccacggcacgatgcaccggtggcgctccctttccctcttcaccgctgccatcctgtagctggccacctgctcggtgcacgcgatgtacgaccagcgtccaacaccttgtgcgatcacgctcagttcctcctcggctctcatttcacttgcttcttggctcctcgcctcgttggcttgatatatatttcccgagatattgagttgctgtatggtaccaatctgatgctgagtagacagtgagaggagggatgcagaccgccagggaaggaatgcgccggagtgaagttcgccagatcgcttggcagtggctgggtcaaagggattgatgtgtggcactgtggctatggaaggggagggatggattagccgtgaggatatggttggcttcaaaattacgtttttcaaaataaatctcacctcatataatacatatttgggcatataaactatcttaaatttaaatgttgtcagttttaaagttatagatctcatacattcatataggctatcttagattgtttaaaaatttcaaaaatttaaatttttccttatccgtggcggttcgtaacaacaatcattcacagataacattatttgtgatgggtggtaattaagacccatcacggatgagtgctctcattttttacgaatcatctcactacacccgttacggatgacttgttatacatgacggagcatggttgtgacccatcaaatgttatccgagacgtgttagactaggatccaacaaagttgacattctatcagtgatgggtcatctgctgtagtcattaatccgacatggatagttcatcaggaataatgtgtagatctgtactagggaggtaagttgttggccctgtttattccatcacgtgttgtgtgacagtgcaccagtgcgagtgccgactgcatccccaagtttcggtggtccgcgtcatgcgccgttccggccaaacaccgcagagcagcacgtttaatctaattaatttcactgtcacattaacgatctacagcagcttccttggtgcctaatcacgccgcgaaattattacttcctgtgcattatagattctcccatgctttaatttgcatcccgccagtttttgttggttagcaactcggcgagtaaccgttccaagtcgctctccacagtgctgcgccatttactgttacacacatatttatatcgtgcaaacgcggcgccctgtacagtggcgaagaagagcccggaatcatcatggctagtcacgtcttgttgatccggcaagacatcgcgacgccgtggtggttcatcttgcgggccttcgtcggcgccgcctacgtcggcttcgtcgcgctccgtctcctggcctacctctggctctgcctcccccgcatgcccaagggcgacctccgccgccggtacggcgagtgggccgtcgtcaccgggccaacgtccggtatcggccgtgccatggcgctggagctcgcgcgtcacggcctcaatctcgtgctcgtcggccgtgacccggccatcctccggcagatctccgacacgatcgcgtctctgtcggagttgatcgtggtgaacaatgcaggcgtggcggagcccggcgcggtgtacctgcacgaggcggacgtggaggcgtgggcgaggatggtgcgggtgaatgtgtcagcagtgacagaggtgacggcagcggtgttgccggggatggtggcgcggggcagggaaggcgctgtcgtcaacatcggctcagcggcgtcagagtccatcccgtccttacccctatacaccatgtactcctccaccaaacggtacgtacccacgacaacagcttctaaaataaacaacatagtacgagatataacaaattttatattatacaaatttattgttttattagtactatgttgagtaattttagaacaaagtgagtagtaaacaaagtgacatgaaacaacttacgacaccatatttatatcagtacacacaacgtcatacatatgcatgagaatgcaccactacaaaaatgttcataaggatcggccatataggtaaaaatcggcacctatactgtatttcccaccaacctctacaagaaccgatacctataaaactatatagacatcgaaccgatgtctataagatcgtatagatattctgtagaccggcttatttttttacagtattataggtgcccgttataatctaaaaaccgacaccttcgtaaattaaggtgtcggttataaacacaaaaccgacacctatgaagtattataggtgttggttttggtacagaatcggcacctatatgcttgcgagggcagcactttctctattataggtgccgattctttatcgaaaccggcacctacaatatcacataggcgccagtttggaaaccgataccaccgactttgatcattagtgttgactaataggtgccggcatcaaaaccattacctattaggtcttcccaaccgttacatatatggttttctgtactagtggtgaccggctggttcgtttctagcaggtacgtggctcagttctcccggagccttcacgtcgagtatgcaagtaaagggatccatgtgcaatgccaggtaacttaattcatcagaaatataattcgtaactttcagttgaatcatttactcattgacagattctgataaaatctggaaagtatgtgcatgcaaatagggaatcaaataggagtatgtatggctcttatgtatgtgcatgcatgcaggcaccgttcctcgtggacacgaggctgatgttcaggttcgaggaggcggcgggcggcgtgtcgctgttcacggtgaccccggacgcgtacgcgcgcgcggcggtggcgtggatcggccgcggcggcgcgctctgcacgccgggcgtccggcaccagctgctgcggcgcatggccgccgccgttccggactccgtccacgactggatcctcctgcacttaaccacctggaacagaaagcgtcgtttcagcggatcagagtgacaagttctatcgacagattatgcgatgctaaagaattgccaacaaataaatgtgtcttcgaaaagtacacttgccgatatattgtttgttgcccattttattcacactaggaaggtggcccgcgcgcatacgcgggcacttatattattgcaagctaagattattgtttgttcaaaattttcatctaatagattaagggcaaactaaagtttggataatgttatttcataataatttaagggttctattttgcttaagatatcttagaaaaccattcacaaaattttgagtaggagatacattaagtacttacgacttttgaatcatgttttttttcgagtaaataaaaaactattgtgacttttgaatcatgtttaactcaaaattcttgtgattaaatcgtctcatgaagacgcatgatatagttagaaagggagggaagcgtatgtatggaaaaaaaagaagaaagggaaaaatgaaaaaagggagggaaagcgcacgtacccacgtatgtaggtgcgtacctatgccgcgtatgtaggtgcgtacccacgtaggacctcgtagtatttagtttgttccaagatcaatttaatctaatagtttataatattgaacgtaccgatttaagtgaaaattaaataatagatactttgcttttttttttagaatttatagtactttctctaatttattagagcaccatgtggtagcttgagagcattttaagaaaatttaaaggacttaacacatgtaattagaatattaaccatgtaatatatatgtatggggcatatggtaatatttgtccagcttcgtccatgtttatataaataattaactatgtgtctaattaatagtaattaattttgacacctatttacaattgttcatagtagctcttacatattcatcttacgactttgattatcggttgatccccaatttactgatcaccatgactcgcatgaaaaaaaagtgctacttaggttttaggacagctgaaattgatgaattatcttatttgcgtggtagctatttgagggtataaacgaatgaattggcttctaaaaagttaaattgtcgtttaaaaagacaccatttataaacttggaaagtgtgcaaactaaaatccaaactatagaatcgggaaaaaagagaatcttaaactcccttataacacccttgtcttagtaagagttctattgttattcgttaatattgtgctcacatttataacataataatttctttcacctatacgaacaaatagtacaaaatccaaatacgacataacacaatacattataattattctataaccaactctcgtttttagcttaaacagagctaagtgttggaaaaaacataacccacggtgcttaattcttctctcgttgcatcacacctttaattttctttttatgttattaacaaaattaatcatctccatatatgatttgatatgtggcaaagcaatagcgttgcagcggtcgtgatcaccttagatgcctcacacacaacgcttgtcacgtgtgcgaaaggcaaaggtgcagacgtgcattgtgcagcgggccaaaaagagaacttcggacactttatttatttgcaaataatagatccgatgatttaaatgatgggtcatcggttctagtataagtgtaaattagttaatatagattttaaattactaatttaacaggtacacaatataatggtgtagactttattttgaaacagtgtattatttgagaataagagtccaatgtaataaaaaatagatacgatgttttaaataatgggtccatcggtttaagtgcacgtatatagattttaaattgtttatttgataggtgcacaatataattgtgtaaactttattttaaaatagtgtattattttaaaataatagtacaaagtaagtaatgagtacaccggtttaagtggaaatgttggcaaaagtgggtcatgatttagtggacgacgtctgcataggatcacaccaacaccagtctgccgccgtgaaccgtttgggccgagagctatactactatagaatggatttttctgtacaagagcgcctataggtttcagacggatggtaacttagtcttgcctgcaataatcactttttcaattgcagttaaaaacagcatgcgaaaatgcattttaactgatggaccccttaacatatctgcacgtgaaaattgataactctctattgtgcattaatttgctcagtacttttattatatctcattagtatatggcctataggtggttttagccatcgttgtcaaactaacgtaccgattaattaactagctttcagcttggttaatggtttgatactttgaagaaccgaaatctattttatggttagtattgttggcaattttttatgataagtcgacaagcacgatcgtagcacctaaacgccttgcggtgatatagagtcgccaaccaccttgatctagccaaaaggccaaatcaagatgggttttgtagaaaaaacaactaaaccggctagcggagccgatttagagtaggctgattttgatcgataagaggataactacccgtctcgtgggtaaaacggaaggttttcaggacaaacctacataaaggtgtcgcactctcgcagcagcggcggacgatttacggtgcaaatcgacaaagatgggctaaaactatggtaaaatagaaaacattgctgaaaagtaaagataaaagaaaaatagaaaactgcggtcagaccggccctactagtcggccagaccgcccacatacctgtggtctgaccggccctgtgaaggaaacccggcactttccaaactttgacaattttcccctatttcgtccatagatgccaaatttgggtgtaaacaagtatttccaagaaaactaacgaaatgaactgataatcaccattggctactccatccagttcaaaatataagacatatttatgtttagttatgacactcttgataattgctacactggaatattattagttatgtaatataaagtgagtatataagaaattatcgcaagtttttttagtgcaaaactattagatataactatagtataattacattgtaactgtattgtaaatacattttaattatgatataacttatataaaacttatatttaagtatggtttggttggctcgcatcgggattttacgcgtgttatgtgtgaaaatttctttctagtaatcttttccctttatgcacaaatctcaaggcgatcctatgaccacaaatctaaaacttttagagaaaaaacttgcgaaatttttttaagcaattccgaatataaaagcatattcataaggaagtagttttgaatatgaatctaataaatgaaactttaaaactatacttttctgtgatcaaagcctctgttcttgctaacaacttagtttttgagccctccgcgactgttagctagttgttgccacattattgttgcaacttggaactaattagttggcgggtaaccattccaaatcaacacatttacacatatatcgcccatatacgtccacgtcaacacatttacacattaacgaacaaaacctagctctacccacagatacgcgcgcacaactatgtgcaaatgacgccgaagagagctgtgcattgcggtcggatcaaatgatggctagccatttctacggcatgttccggcaagacgacccagcgccggcgccggcgtggtggttccagtcgctggccttcctcggcgccgcctacgtcgccggcgtcacgctgcgcctcctcgcctacgtcgcgatctgcctcggcgggcccaaggacctccgccggtacggcgcgtgggccgtcatcaccgggccgacgtccggcatcggctgcgccatggcgctggagctcgcgcgccgcggcctcaacctcgtgctcgtcggccgtgaccccgccaggctccgggagatctccggcacgatccgctcccgccacggccgggtgcagaccaaggccgtggtgttcgacctgtccctcgcctcgaccccggacggcgaccagccgctgcggcggctgcgggaggccgtggcggggctggacgtcggggtggtggtgaacaacgccagcgaggggaggcccggcgcggtgtacctccacgaggcggacgtggaggagtgggtgaggatggcgcgggtgaacgtgtcggcggtgacagaggtgacggcggcggtgctgcccgggatggtggagcggggcaggggcggcgccgtcgtcaacctcggctcagcggcgtcggaggccatcccgtccttccccctctacaccatgtacgcctccaccaaacggtaaatacatgtcgtacattcaccaaacacaaaatgacatattacaacatgtacaattcatgttatatatacatgtgcgtgagatgcaggtacgtggctcagttctcccggagccttcacgtcgagtatgcgaacaaagggatccatgtgcaatgccaggtaaccaattaagtttgagtttagtgatcattgtacacacagattctgatgaaatctgaagagagaaaaaacaaatgttacggcctgctcgcggcgacgtgtgtgcgatgtgctttaattgtagacgccgttcttcgtggagacgacgatgttggcgaagttggaggaggaggtggggcttagcgtgtcgccgttgaaggtgagcacggacacctacgcgcgcgcggcggtggcgtggatcggacgcggcgggccgctctgcacgccgggtggactgctgcaccagctgatgtggtgcatcaccgccgccgtgccggagtccgtcctcgactggatcgtcctgcgcttcaccacctggaacagaggacggtagctgttgcagccagcggagcagagtgtcaaggacgaggggcatgcaagttcagagagctgtggtggctcgctaagttaccatcctggccgctgtcgttcgattaccctaacggcgatcagccgtacgtcgtgaccacaagtcgcgcccgatgtgtgtatctcgagcgagtcaggggtggagattaggtttgtaaaaactatgtcaaaatgtaattttactttcaagtattgatatggagttatggacagtatgtaatcaacaacttaattagcactatttaatctatcgtgatagatatggaattcaatgcaagatacgcactttcatcagtagaataggaaggggcgatttggtagcatcacggtcgggatgaggaggattaagcagtgacgattggaagagataggaagaggcagtgaggtctcttcttccttagggcaagttttatagtagatgtgactattacatctaattttatgtataacatacataattattgagaggtgatatgtataataggtcacatctaccacacaatccccaatatctttaacactctcatatgtttattgaagtttatgtaggggttgccccttgcatgagaggtgactatttctctctcatccttcttctctcctccacctcactatttagtcctatgtgacatcttgggatttgtgcttggatgcccatagtacttgccactactagaaaacttattttcggcgtcgtaggggatcgattttcgcaggcaggcatgtaattcggagccaaaaccccgccggcaaaaaagatacccggggtggagggggcggtccgcctgcgaagatcaatcttcgcaggcgccgcttatatggcccgcctgaaaagatgcccctatatagtcttcttcctcctcgagctctgttcattctccccgaagtttctctctcctaaagtgacttaaatataggagggaggttttgaacttcaaatcttcgggggatttttctacggtacttagatctacttatttccacactaggtatgcaattttttaagcttttagaccttaatttgtgatggatttatgcatgcaaaattgtgaaggaagagttccatgttttttaattttatttcttttgatatgttgatattagatgtatgtctaatacatgatgcctcttgttgtagtggtttaatgtggtaacataaattctcaattttttttatttttgctatcacatctacctccttgttctagatctagatttagatcttgtcatatatagagagaataaaatttttaatgtctatttattcggtgcaatcaaaaaatagttatagtattttgtaatatgccaatgatatgattttgttagattttcctaatgtactaatttgtcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagagatatggaaagtcgggaatggatgtatcattggccgaggtttttgtctccatatagaaacgaagtgtctaaatttattggtattaccaaggcacacgctgagaagaacaatatgaggaagataatttgtccatgtgctgactgtaagaatgaaatagcctgggactttgacgatgcttttaaagtgaaggagcacttggtaactcgtggatttatggacaagtacgaaatatggacacgtcatggcgaagaacaagtggacgggccttaaaatgtagttctgacacaagttgaagacatggtgcatgacgatggttctgttgaggacaaaatcgacctagaggaaatgttacgtcatgcagaacccgaggtgctgatggggtcggctaaagggttaaataactttgaagctttacaaaaggcagcaaaggaagttttgtacgatgagtcgaagggttgtgacagtgagttcacaacactccggtcagttcttgaacttatgaggttaaaagtgagacatggatggtctgataccagtttcgacagtctgttagaacttctgcagaaaatgctcccgaggcctaactcactaccatcgagcacatatcaagcaaagaaactcatatgccccctttcacttggtgtggaaaagattcatgcgtgcgtaaatcactgcatactgtacaggaaagagtacgcttctttagatgaatgtccaacatgcagtgcaagccggtacaagtcgaatagcaatactggcctagaaccctctgaagcaactgagggacgacagagaaaaatcccgcagcttgtgatgtggtaccttcctgtcaaagaccgcattaaacagatatactcaaacccgcgagatgtagaactaatgtgctggcatgaagaagggcacaagaaggatgggatgatttgacacccggcagatgctcgttagtggataaattttgatgctcagtatagagagtttgctaaagacccatggaacattagatttgccctgagtaccgatggagttaatccttttagagacgtgagcagctcacatagtacttggccagtgcttctcaccatgtataatcttcctacctggctttgtagaaagagaaaatacgtactactctgtatcctcatacagggaccccgtcagcctggtattgatattgacgtatttcttgaaccattgttggaagatatggctgatttatggaaagagggattgaaagtgtgggacgagtacttaagggaatacttcacagtgaaggccatcatcttcgtgaccattaacgattatccagcaatgttttcagtttcaggtcaaattaaaggtaaaacaggatgtgtgatctgcttgaatggaacgtactataggtatctcccgggttccaacaagcttgtgtacatgtggcaccggcggttcctacgcataaatcacaagtaccgcaagatgaaggcggagttcgatggtactgaagagactgatcctgcaccaaaacctacatcgggagaaaaggtgtgtgcaataacagagaaaattgtttgcgagtttggaaaaatgactaagaaaccatcaaaggggacaaagcgcaagaaacccgagaagaatacaaaacaaggggatagtaagaagcaagatgatagttcgaagccagatgataaactccctcccccattcaagaagcattccatattttttaagtacctcccgtactggaaagatctgaaggttcggcatgccatagacgtcatgcatctagagaagaatgtgtttgacaacatagttggaacattgttggacatgccgaaaaagactaaagatggtctgcaatcaaggatagacctagtcaagatgggaatcagggaagagttacaccctcaagaaggagaaaagaatggcgaagtatatcttccaccagcctgtttcacactgacacctgaggagaagaagtcattttgcaactcactccgtgatgtcagagtgcccataggtttctcatcaaacatcagtcgactagtttcaatgaaaaatttgtcggtatctggttataattcacacgactgccatgtcttgctcatcgtgtttcttgcaattgcaataagggccataaaaccggagcttttaaaggttgctatcacaaggttgtgctactttttcaacgcagtgtcacagaaggtcattagtctcgaagagttaggaaatctacgtacattcgcacatgagacacaataccaacttgagatgtgtttctctccgtcattttttgatatgatggagcacctcattgttcacatagtgccgcagatggttgcgcttggcccattgtacctccatcaaatgtggtcatacgagcgttacatggcggttctaaagggttacgtccgaaatcgtgcacatccagagggatcaatggttgagggttatagtactgaagaggttgtcgagtgttgtatcgattacctcaaagatggatatgcaattggagtacctgtgccccaacacgagggcaggttgagtggcaggggaacgataggaaagaagagattcgtcacccatgatcacaaatcattccaagaagctcacttcagcgtgcttcatcagtttgctatcgttgagccgtacatcaatcaacatatcgaactaatacaagctaacaataagggtcgcaccaccgagtggataatgaaagaacacaagcgtctcttcatagattggttgcgagacctagacttacctgagggacaaactaccgatgaaataactatgaagcggttggcttgtgatccatcaactacagtaaattcttggcagggatatgacattaatggatactcgtttagcacaagagcccaagataataagacctgtacgcaaaacagcggtgtccgtgttttcgcaattgatgaagccggggaaaaacaatcatacttcgggtttattgaagaaatatgggaaatcgactatgggcacacaatgcaaatccctatatttaagtgccagtgggtaaaatacccgaacggggtcaatgttgataagttcggtcttactgttgttgacctggcgagtgtgggtcacaaggatgacccttgggtactcgccaatcgcgtggaacaagtgtttaatgtgaaggacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcaaaagaccgtgaagccttacatacgcacggacggtgtgggcaaaaatgttaaagggtaatgattgttgagtggcatgtaagcatctaagaagttagtagttatataatggtggtatgtaaggtgatgtgtgatcatatcgcaaattgacgaataattgtactcaacattttggtggtatgtaattagtttgtactaatttttatgtgtaattaccatttgtagtgtaaaaaatttgttaaaaaatttaaattagtaatatttgaaaagtgtaattatttttatgtgcaattacaatttttaccatttgtagtgtaaaaaatttgttaaaaaatttaaattagtaatatttttatgtgcaataaccatttatacatttgaaaagtaataatactaaggtttgtatattttgtaataatattaaggtttgtatattttggaataaatatattcaactctgtaccaattttcgcaggcgggcggtccgcctgcgaaaattgttgtacaaagtagggtttacatcttcgcagtcggacggcacgcttgcgaagatagtaaaaacgatcttcgcaggcggaccgcccgcttgcgaagatcgttgccctatataagggcaagcccgcggcgccaaaatttctaagtctaaaagggagaaagatgtgctaagtacggcgctgggtactactaagcatgggggaagggttcgaggtgtgtcgagcaagatgagttggaaggaagggttcaaaaatgacccaaacaagaagcgtgaagtgtacaaggataaacttagagacgaaggggctgcggagtttgaaaggcaaatgatggatttctgcgtcaagcacatgcttttgcctcgccccgaaaccaaagaacctgagccagattaccccttcgatgacctcaaggagaatacaccctgcagattgcacgttcccattggacgctccgggaaaactcttgaggccgctacagccattactatccctaggagaacatacaatgaagagttcatacctgatgcgtatgccaaggtgcagccgcaagtggtccacgaagggtttgagtcctacgacattgacttcccgactgcagatggtgtatccgtacttggggatgcggtcgatcttgtaattctctggcacaagaatgacatatcctttggattgggcaccgacgccacgcaaaaacctgtggtgcctaaaccggggttgggaaaacctccgagaccttctaagaggaaggtgactgataaggcagaggaacccgagatgcaaagggaaaatccagtgccggaagtgccaccggagattgcattgccagaggcagccatggagattgcaccgccggaggcagccatggagattccagtgccggatgtgcccatagagattacagtggcagaaccagaggtgcaatttgtggcatcagtcgggtcagaaatagaagaagtaccaggattggaatgggacggtacagagccagaaatatttgaagacccttctcctgcgaaagaccccgaggttcaagagaccacggtccctgagaaggccactaccagttctgaggtgccacgagtgcttaggagccacgactccaagtccaaagatgagaacaaggagaagttcatggtaaccgtctttagagggggtaaggaacgtgccaagctcaaagatgacgacccccagaaggctgctgaactagccgggccaacatatttcgcaaccgatgattgcccggaaaagtacgaacatgggaaagcattcttgccggaatgggcactgaaagaaggaccatgagagatgagaaggttacataccttctacatggaggccagcaagaaaggcttgggcaatataacagctcgatccccggctaattgttttggcgaagagggttacgtatggctagatttctcagatctccacgccatatatcgtcgggataagatggacgtcaactacgtcggtgtttggtgcatgtgagtatgagttttaattaattagatgaaaaatatgtacaatacaaatccatgtgattgttactaacaaacttcttctgtaggatgcaatacatggatgctaagaagaaaaaagaacccatcggcttcttggatctaactcagatctgccaaacacagcatacggtgaggctagcaccagggtctgaccagctgaagggcaagaatccaaaagagatagcagaatacaagaagggcttgcacaaggataaattgattactgtcgcacagtacattggacgagccttcttgcactttcaaaataagagagtcgtcatggccgcttataattttaagtaagtctggtacatttatcttgtacacatatgtcttattttagctggtactaactaactatactgttgttaatatgtagcgatcattatatctgtttactcatccaccctaaagacggaatcgtggtagtcttggaccctctcgattacagtcacaagcaatacaaagaatttctaacaatcttacagtagtaagtgagtatgactcttgcatttgtatatgaatgtattataaataaatatcctccttattgtgaaacggtacgacatccatacagtgcataccaatactacaagttcaagggtggagaatagacccgaacacgggagaagctgctagtacgtacctattggccggtaatactccactcacttaatgtattccaattgtttcactaattgcaaattttaactaattttttctatgatatgtactgaagtgtcacaagcaaccgcgaggaacggtcctttgcgggtattatgcgtgcgaattccttagggttaatggacggtacaggactaacgcagaggatgtaagtctctatactatgtactagacagcttcacatatttatgatactaatatatggattaacttcaatgcatgcagttgccaagattacaatgtcgaacaagctttaacgatacaggtaccacaaatgtccagcgtgatctgtgccacttcatccaccatgagtgttgtcatgtgaaaggagatttcttcgacccagagggtgccctagcggcaagtgatgaatttaaggatcttcgggagtggaacactgctatgccataatgtaactagatgacgttatttgaagtgacaaggtaaaaaaatattgtaatatatatattttggcaacacttttgagttatgcaatatatgtagatttctcagtaccaaatgtttgataatcttccaatatatgtatataataatctacctgcaataatttctattaaataatttaaaagtaatttacgggcaaattattattaaatttcaatattttctacctatcttcgcaggcggaagtttttttttttgcaggcggccgattcctattttcgcaggcggaccggactagccaacgtccacctgcgaaaattatcttcgcaggtggacggccgccccgcctgcgaagatcggcgattttcatagtcgttggcatacaggcggacggtcgccccgcctgcaaagacccttttcggccgcttgcgataatgcttttcctagtagtgtgcccttatccacctctttttccgatggcagcatcaccccatgcccgacgacgtgggtggctcccttatgccattcctaacccaatgactagaatgatatccatagcattaaataagcggtcacctagaattaaaaatgatatggcaaagaaataaataaggaaagagaggagaccatgtcttgcatgagacatggtttctatacaacattcaagacatcatatgaaataagtagcattaaatttaagtatggaatagtggtgtttgcattggaagagtagtgtctagtactagtgttagactattctcaacccaatgattagaatggtgtccatagcattaaataagctaccacctaggatgaaagatgatgtagcaagtgaataaattaggaaagagaaggaaaccaggtcttgtatgaaacatggtttatacacaacttccaatacatcatgtgagataagtagcattaaatttaagtatggaaaaatggtgtttgcattgaaagagtagtgctagtactagtttcttgatgatgaggacaaaacggcagggtggtgaaaaggagatcggcggtggcggtggggagggcagaggaggcagcaacggacaagccatgcatttgcatcgtttgttgcatacgtttgaaccaaattgtttcatctagcgatctgaccatgttatactttttttttagaattaaaacattctttcgctatttgttgaaacattgtttttatataggtgaaataacgtctgattttttggaaaccgttgtttcatacgttgtagcaaaatgtttcatgaggtgatttggttgtgttttagtttttttaagcgattgaaacattttcaatctacttagtgaaacattttcgatctacttggtggaacagcgcccgattttgtaaaaaaaaaaaagaaaaatcaggcgcccgatttgtaggagccttggtttctctaggcagggacgtggaaggatgttttttaaaaaaagtttctcgaaggtttcggaagaggtttttcgtatttgagttgcgaggtatggatgaaaaatcagacgaaccatgtttacgtgacatggcgttataattttggaagaaaggattcttctttcatgtatttaaattaaatacgctacatgtgtttatataagtttatacgtgctgaatatttcttacccggaggtactcatggtgttttctgtagtaagtccatctctcttcatcaggatgcttagttatttcaagcatgggatgatgtcccacgctttgctgtggaatatatgttagatattaatgaaatgatttggattgaaatattataaaaatgatttaaaaataatgatttagcatgtgtatgtatagttttataataaaataaattgtagatatagttactatatacttgcacgttaagctttgtatgaatgcgttgacgtggcatgcttgcatatagattttagaagtgctaataaatattatacttgcatgataacctttagatgtttagtacacattagctcaataaaaagaagaaatttgcgacctatatatagctctcacccttggttagaaaacggaaatttaatttagattgagtatgggtgaaatttaaggcactgcaagaatctcaaagtacaattaacggttttgatatgggtgaagtttacaacggttaccttaaaatcgtgactcataagttgttggaaattaattgctgcagtgcgcgagcatatacagtactacatccattccaaaacaagtgcagtcatatatatcggtgtccaacgtttaaccgtccatcttatttaaaaaatttattaaaacttttttaaaaaactattcacatataaagtactatttatattttatcatctaataataataaaattactaatcataaaattctttcaaataagacgagcggtcaaatgttggacttgaacagtgtgaggaagtacaaccaacagtgcaaggttctcagtatcctaatccgtatcctaatatcttacaatattacgatcctaccaagcgaaacgatcacgataccgatcatagtcttacctagtatcctaaatgtcataatatctcgattctactattcattaccatacattttacgaaatcttaggtagtatcccgattatataataagatggtttgaaaatatgtaaataatatgctgaagtttatataaaaatcggttaaatatatcaaaactaatgtggtttctcttgataaatatccctatttgcatggtatatattattactatattttttatatagaatagctatatgtaattaatacaaatattaattaaacttaaaaaaatctcatagtattcgatcatacgatacgatactactttgaacaaaacgatactacttagcatcccgatattgataaccttcctatagggtcgcaccatttctctaagcaactatgtgtccgtgtgcacacgcggccacgcgctgcgcacctaatgctactgttttgttagtatttatttaatttagtactgattttttttctcatcaatacaatcactacttattttaagttatctttaaccaagtaaatctatttaatttagtactgatttttttctcatcaacacaatcactacttattttaagttatctttaaccaagtaaatctagaacgtacgaattatctctttttaaaaaagatcaatagtgtacgtgaaactattgcaattacatcgatcaaaggtgtggcccattgcatattttcattggtggcagctggcagctaggccaccacagtccacccgtttcactgtgtgtgtgtgtgtgacgttaacacgctactattcccttctgcctaatcaccccactaattttattattgtgcatatataatataatatatgcactaattttattattgtgcatatataatataatatatgcgcgtgctgcgtgtcgtacagcgcatatataatactccctccgtccctaaaaatttgacatcgtttattttttaaaacatgtttaaccgtcatcttattaaatttttttgtgaatattattcaaaaacttaagtagtagtatatttaacaatgaatcaaatgatatgaaaagaattaataattacttaataaaatgaacaattaaatatgtttaaaaaagtcaacagtattaaatattcagggtacaattttcccattttattgcatctgtttcactgtgttgctcggccaaacgtacacacagttcgttatatatcgtgcaacaccggtgcatggcgaggaaaccatacatatagagagagagagagagcccgtgaggtgtggctggaatcgtcatggctggtcatgtcttcatgattcggcaagaatcggcgccgccggcgccaccgtggtggttcctctctctggtcttcctcggcgctgcctatgtcgccaccgtcaccctccgcctcctcgcctacctcgcgttctccctgcaccgtcagcccaaggacctccgcagccggtacggtgcgtgggcggtcattactgggccgacatccggcatgggccgggctatggcgctagagctcgctcgccgcggcctcaacctcgtgctcgtcggccgtgaccccgccaacctcgaggagatctccaacacggtcaggtctctccacggggtggagaccaagaccgtggtgttcgacctctcactcgtggcgactccccacggcgacgagccgctgcggcagctcagggagacggtggaggggctggatgtcggggtgttaatgaacaacgccggtgtgggggagccggctatggcgtacctacacgaggcggacgtggaggcgtgggtgagaatgatgcgggtgaacctgtgggcagtgacggaggtgacggcggcggtgctgccagggatggtggagcggggcaggggcgctgttgttaacatcggctcggcatcatcgcaggccatcccttccttccccctctgcaccatttactccgccaccaaacggcacgtacatgcaacaaacacacgtaacatgttactacacttttttatagtaaaggttacttactctcactgtctctctctctctctctcttcgtaagtattttaatatttaatttttgtttataaggatttatgtaatgcttgttccatcaatcacctttcttcccgtgttgctcttaaccaccatcacactcccaaccatccgtgacaaatccaaaatgtaaattgacggagtgctaccgtgctagtgtaaaaacatagtagtatgactgaagcagagatatattaattaatatgcgcatatgatcgaaaaaaaaaactttctccattttaatttatggctgtgttaaatatccacaaatatctgttatagtatacctagagtaagttctgtattctgcaagttcaggccctgaaaaaaagaagtagaaacagcgagacagctgcatcggtgccgtccgaacagtttctttactggtggctaattagacttattaatgattaattaggggtagggattatggctgttcgtttgtaccggttagaagtctatccctccagcacagaaaaagaaacagcttattgttgcataattaattaagtgttagctaaaactaacttgaaaaatggattaatatgatatttttaagtaatttttttatatattttttaaaaaatacaccgtttagtagtttgaaaagtgtacgcgtggaaaacgatatagattagttgggaacaagcacaaaagaacagtgatcggccactgccaaccatccaccattcaatgagcgttatcaaagtcattttttcctcaaccttcttcttacaaacctaaaaattgtttatatttgtcgtcttaattacacatggttgtatatatgtgggcatagagatttataatcctttcatatgagttgtatatatgtgtgattgtcagcacaacctgatataattagtgactacgttcattaatttcaagatgcaggtacgtggctcatttctcccggagccttcacctcgagtacgcaagtgaagggatccatgtgcaatgccaggtaaccctgatctgacgagagcaatctgacgaaattttgcaaccaaaaaaaccaagtgaagaaacacacaacaaatttacgcgatgcatccatccgatcatcttatctgcatgcaggcgccgttcttcgtggcgacgaggatggtggagaacctggcggaggcgaggcgcctctcgccgttcacggtcaccccgggcgcctacgcgcgcgcgcggcggtggggtggatcggccgcggcggcccgctttgcacgccgaacgtccggcaccggctgctgtggtgcgccgccgccgccgcgccggactccgtgctcgactggttcctcctgcgcagccacctggagcagaggacgacgttgtctcagcaaatcagagcgtcgggggcgccggcgccgtcgtgacagcaggaagttcattcttggcgcttcgtcttgcgttcatgaacaataatagtgggcagtagcattgtgatatactgctacatccccgttttatatactataagttgttttaatttttttatctaagttgaacttctttatattatttgatcaaatttatagaaaatataataatatattttcaacacaaagtaaagaaaaactatcaaaatatgttcaatgttagatgtaataaaactaattaatttcgtgctataagtgttgttatatttttctataagtttgattaaaatttcaaataaaaaataaaaaaatcaattcgatttataatatatacggaaagattgcgtgcgtatgtccggatgctggtccatagggaaaaacctggttacatgactattctcgtagtgtaaaaacgtgcatatatacaacataacgatcacacacttgtggactgcccgtttgctagattattttggatctcattgaatgaagcgtttggatccgggcctagccttgcctagcaagaccagtcatttggaatcgtaacaaaatcctagctcctcagggcgagctaccccataggggtgagaaaaggctagctcacgaggaagagccaaataggtacgcctccaacggtaaaatgcacgtaagaaaaaattgttgataaggccgaagcgatttactccaaaacctactaccttcttcaacaactagtcccccaatttcattgttctcttcctccactcttggccaaagaattggcctcgcaaatctctagttctctttgtccacccttggctggactatcgggctcacatatccggtcaattggcaatcatcctcctcttcgccttgtcgaactctcaggtatgctcatcatctccggcgcacatatataaatgcagtagagcccatacgtagtaaatcagagggcttcggcaaggccaactttatttgaggataaaagataagaatcaagttggttgggtatgttgctaggaggagcatatctaatactaattatgcatacacctagtagtattgatcatgttaatcgtattataacctagaagtacagatgttgggtacggaggattcataccaccgtttcaccaaacccgataccatttgcatgaatggataggctataaacccaagacagcaaacgaatgactattcaacttaagacactcttctctccgcactactgttgagagagcgtctgtcttacttaaactcttatactatacttacttaaactcttatactatcactacatgacgtgtcatgttgtgaatatataaactctataactttcaactacttacattaaacggctaagatcattgtttgtaatagttttgtaaaggaaaattagtacgtggagcggtgctcatctcaaattaaaagaagaaaaggaatcccaggcatgaggcatcagtgttcagtcagtcaggcacctcgacggcgagacggcgcggcgcttggcgtggtgatgatggtgtgatcgccggttaattcgtccacccgaatataatgccgccgtagtggagtactggaggaggcacgtccaaacgaacgaaccattattattcctttaaccgctcacgtgcgcgcgcaaccccttcgtttccccacgcgtggcgctgatacgtaaccggcctcggcgccactatatatctgacgacgtcatcctccattctccaagcggcgctcgatcgccactcgccttcgatctgcttcggttttccactccaccactcgatcgccaccatggagccggttgtctcggtctcgcgcgtgcggcgccggtcgccgtcgtggttcacggtggacggcggcgtggcggaggagccgctgctcctgctcggggcaccggcggacggcgacgacggcggcgaccaggcgcgggcggcgctcctgcgcgtggaggagctcgagcacctcctcggcgacgtggcgcggaggctgtcgcggctggacgccaagcgcggcaggctcgagggccagatcgccgcggcgtcccgcggccgcaggggtggcggcgctcatcatcgccgtcacgggagcgctggaggaatatcggagtcggagggcgagggctacacgcggaagggcgcgggcgccgtccgcaagattctcagggcggcggccggcgacgtgaagaaggcgcgggagtggctggaggcggtggcggggaggctggaggcggcgctcgtcgacgcccgcgagcgcctcgcgctgcagcagatgctggcagccggagcgtagttccagcaaccgcggctatatattagtacttacttatcgaatgatactgcattagcgtatgtgtaatcccagctctgtgcttcttttaattagttttctgtttcatagactcttcgtcgtgcatgcatattcatcgacattgttgcattgtcactgtgacctctatggctctatgtaattaatgttattggttcctcgttttttaacttgttctgctcccgttccgagagttacttgttgtagtattatgcaatgtcaaattggtatattgtatatgtcaatataggaaggtgtttggttcaagagaaaaccaaggagaaaacaaaggaaaattttctattggaaaatctactgtttatgcgcttggaagaaaggaatatatgtcaatataggatgttttgtgggtataaaaaaattggtcttcgattgtgcgaccggagagcaagctattgtctgtaatggagttacatgcttgaaatggtagccaaaaatctcttgtttctcttcggatggcatagtttcgcttaggcttattgatgaatttaggtaaaattggttctataacatcaaaagttttcatttgttggttttgcaaaaccatagtttcgcttaggcttgttgatgataaaattggttctataacatcaaaagttttcattttggttttacaatacgaaatgtactgagcaatttaatagcaccaaagttgcatcccgatcatgattttagtttctctttctagagaaaggtatttttacccgggctttacatccaacaggatatatacaacctttttaaaattagaaacttagtatttcaaacaggaacttagccctcaaattaataacccaatctgaaattcgctcctacgaagatttgaactaaggatcttagggtgctactcaggtcgctgtaacttagtcctgattttagttttgtggccggtgccgatgaaaaaagtatacttcttactactactattactattctagcgtgtatgacagactagttcctctaaggctggatggattcagtatgttgtttgtctcagtttttgcatgttgggattgtccaacacctatttttattcctactgtactcttggctagatgtgctacaacacagacagacaggagaagtattactcatcttccattgtctaagaaaaaggaacggagggatgcaaaatatagtgggattattcctataaagtacttttgcgcacaaaaacatccgttagaagccagtgttttctcttcttacgctaaagagtgagatgagagagaaaattcctacactatagatcttttggaaaacatgattttgaaaatgtaggaacaagaaaaacattttccacgaatatgatggaagtgaatccatgggatagattttgaaaaaaaaaaactcgtcgttcggtagcactataggaaaaacatatgaagtttgagagacggagagaaaacattataggtcttgtctcttcgtaatttttcttcaagattcatatgaaatgagcaattccataggaatttcaaaagatcgtgtgaaggtattagtccactttacacccttcaactattacatttgtctaaaatacaccatcaaacttcaaaattaaaccgggtatctaatacccctcaattattaaaaccattagacttacccccccccccctcgttccaaaccaggcaattttggtttacgtggcatctgacgtggcagtccagttagcgaaaaaatataaaaaaactataggggcccatctgtcagttgctaaaatatctctctttctcctcttcctctctctctctcaatctcatatttcccctcttgatcccgtttctcgagtgacgacacacaacggcacagaagcgccgagcgccaccgccgctgccagagtcctccctctggaccaccgccaccgagatcctccgcgagactgccgccaccgatcgatgtcctcctgagtcccgaggtacaccacccgatttcgaccagcaacagagaccaacgagaagaggacggatgccgctggattttgtcctgctcctccctgcatcaagtatgagacccgccacccctgagaacctccaccgatccatcgcctctaggtgccgctgctccacccctacactgccgcggtgctacctcacgaatctactcgaggcttggctggcaacgattcctcatccttgagtaaacggcgatggcaggggagtggcttggccctctccgtctcaacctcctccttcgagctcgcggtgaaaggggattttggactttatgccatcttcccaacgcctcattcccaaatgccatcctcctgaacgtcctcgctaatttgccactaggccccataaaattgttgattctatgccattttcttcccattttgatgccacatcagcagcggacgtggaatctcgatggcgaattggccgtcttgcccctggtgtgtgtggacaaaaaaaaaagcgagcagcagccgtctccaaataagccacagcaaacaaataagattctcagcgaagaaataaagcagggattttggatcttgccacgatgggcactcagacagaaccatggcttcaacaaaccctagaccatcagatctaaaaaaaacaagtgaatccggagaaaaaagtgagggaaacagatgccaaactaaaccaaaagaggggaagatggtggatctatcgatctcatgtatgtgattggtgtcacggtttggccgccgtcgccagtcggtggattcatcagctgctactcgcgtttttttagggtggcggaatgagacgacgagaaacgacacgtttttctgttcacgcgtgccaaggggtaccggtgaggtggagtcaaaattagaggataatggcatagaatcaacaattttgtggggcctagtggcatattagcgaggacgttcaggagggtggcatttgggaatgaggcgttggggaagatggcataaagtccaaaatccccagtgaaagtagctcggctaactgcgagcccgccaaggaagtggcgtaggtggcatcaacctagcggtggaggcggtataggcgacgtcaagatggcggtggaggaggcgcaagtgacagcaagctggctgtggaagcatgcgagcgacagcaaagattgcgctggagacccaaggtagcacgtgcaaagtatatagggagggttgaagatggcaaactaggggatagctgacatgtaaaaaaaaatgttgccatgaaaacctcctggttttgataattgaggggtgttcgatacctggttttgaagtttgaggtttgaagggtatttagataaatgtaatagttgagaggtgtaaaatggacttgtacgttttgtgaacctcattattttgttccaagggattctaattttccttctaattgctatgttatcttccaagccttctaaacaaggtcctaggaatgttgtatgggcctaaaaataggcccacggatactaaacatcatgctcccctaaaaagcccaccaaatgagtagtctcccattctgacccttcctcccgtcgccgacgccctaaaccccgcaagaaacaccacacctcgccgccggcgacccaccggagagcgggcaagccagcctcccgcgccgcccaccccatggcgtcccgccggtcgctccatctcctcactgcctcccgcggcatcttctccaccccgcacctcgcctccctcggctggttcgacaagatcaagagcaccttcaccggcaagaagcccgacgaggccaccgacccctccgccaacttcaccctactccgtgagtgagctctccggacgcatatgccctgttctcttctcttctcttctcttggtggcggcgtgggtgatggccctcctgattcggcttcttgtttggttttttggggggagattcttgcagagttcgcggattcgatggagaaggcgaggaagctggggacgttcaagaacttcgtgatggggcggtgcagcgaggccaccgtcgtcaacgccttcgagaagcactccgccgtcctccgctacctcggcaccatcgaccccaccggcgaggtaggcaaggatcgattgcattcgattttttgcgttgcgttgcgtggtggttgtgttgattgtgttgctttgcagaaactcaagaacagcgacaagatcggtgccaccaagcactgcaactgcacgattgcggatgtggagcacatactggccaagtacacatgggctaaggaggctcagaagaagatagtaaagctcaaagaagaagggaagccgttgccgaagaacttcaatgaggtaattcctggtcttgaaagaccaaaggtgttattaatctagttgttcactacacattttagagatgcctgttatgaccgttgaaaggaacataattgggaacagataggaattgggaagaaatataatagattgagaaaatttgatgtatttgtctatttgagaaatataaacctaaaagcataaggtattaaagtcaatatcatggcccacatatgatggtactactgcgctctgtgatttttttcaatggcactaagcaaattggccccctaggatttctgtatgccaaaatatgaatgaggtcagtgcagagatatcattttctctagtgtttaccatgtatctgtgtagaatcctaatttgtgatcaaagtggcaaaagctactttcaattgttgtaaatgattttctgaacaatatttaaggagagagtaaaaaatgtggtatgtgtttcgattaaaagacatgatagaagttagtgattcatattacttcttacatatattagatatcggtattacaggatgctcgattttgaatgttggatttcagcttgtccaaattattgtcatcttgaatgcgacattatgccatataatctttcagtcatattgaatcattttaatcatatcatgcgtgtaggtgaaaaacctaatgggttctacaccactggacgttggcagatctaatctggaaaagagtggacagataagtagaaatgctatgtgcccctgtggttctaagaaacgatataaaaagtaagatgcttctgagcttgattctgttggtaacagtgtttgcattgtggtgctgctattctttgattggctatatttccccggttccttgattggctatatttcctcattgctctgactgcaatagtatcttttacaattataatgaggacaattgttctatttagtatacacatggctcttgctatttggagtatttagcaaaagatagatcaagattaatggatttaaactttccaatatgtgcattgtcctgtaaattttaacctattgccaatcttgaatagaaagatacatgtctcaatcctatatgctacaaaattggaagctaccacaatgtttgtgcatttcatctaaatgggttgttgcactatttatctattaaggaaataaaaactaagaatgtaataactctaatggtgcaaaccagatttagttttatatatttatagtgtatagtgtatttctcgcccatattgttttgacatttcccttttgctgccttgaatttgaaggtgctgtggagcttcttgaagtgaagaccatgttttcctttgtgctgaccacatgaaatattttgattagccatgatcaagaagagcattcctctctttttttttcacttcagcagcaatgcagatcatcctgccacaaacctgacattgaaatatgtaaagcaccataactgaggtttgcatgactgagttttttttttgccaaaattgcattacatctaagccggctttgttgttaaatttgcttgtttatataagaagtcatggaaatatccatcacattctgcgtagaaagcctgaactttgttcaagcaacgcccgtagatcaattttttttttggtttatgggtacattactaagtcgagagatgcactatacatgatgtatcctgaagctggtcattccgtttgtttgggaaagtagcatgtgaatactgatgcaattcaggacccttcattgacattcctaagtcctatagaatatggaaaaattttgaaaatatattttttttcattggtgttacatcaatatacacgtttaaaagaaatttatgaaagtataccgttgttgcaaggcggtgccacgagatcgcaagattcgccatggtctcgcagattgagggcatcagaccgcgcgaccgctcgaccttgcgcggtaagtgcgctagaccgcgatagagaattcaaactagcgcgattaatacattactcattagcaattaattaattaatatcatttctataattagcattattagttataaataattgctaattaggataattagttactaatcattctaaagcggtgtcgctgtttgccccttcgagacttgggtggtggttggatccaggtactcacatacgatgacggtatatttgtgctagaaaaattacatcccggatattctgaaaaaataaatgaacagtatattttcaaatttaatttctatagaatattgcagctctacgatagcagacagaaaagacaatgccccacagaaattttaatcatgcaaaacttttctttgctccaaggtaattttaaacatacaaaacttatcttctctcaaaatatgccagctacagtgtcattcgctccttaggggggagaggatatctagttatctagataggggaatcactgaattggcagttgacccaaccagaaaccgcaaaacatgttctagacttcctagtcctatcttcacttggtaggccgatcccatgtcgtctctgatgtgaggctgttcccgtagtacacctgctttgtagattcatccaggtatgcctgccaacaatggaaaagtcagcacttccattttaacgaacgtaaatgttaaataagcaaggctatcatggcacgatactggagcagagaatacgtgaacttggtcctcaagactttcttttagtgtgtatttgaattgtcatcagaaaatcaagttgcatgctggattttattctagacgtatctctagtcattggaaggacactgggatctgaaggaaggttgttaccacgaatatgctccagaggttggagctcggtgctttacccatgctactaacaagccagtctttgtgcaactgaacttcaactgtaatcacatctctggtgaagagattgatgaggtgaaggatgttctgagtggtaaaaactcgaattagcttgttagattaactagctcctatcttgttctcgaattagcttcaaaatgtttcgcttgccaggttgaattttcttcaatttactccatttaatataggttgagctcaactagtcacaatagaaacagcagtaaaaattgtactaacctgccatccagaaggaagacccttgcagagctctgcaagatcaggttgtcctttatgcagatcggtgacactcactggtgcagaaatagtctcgctatttgcctccttttttgcttccgctctcctgcgtttcacacgatcacgcctgcacaaaatatttgctcaaactgaaaaacccgcaatatatgcaacggaaaaacccacgtactccctcaaaacattggtagttgggttcccaattcccagttagtcaacagttttccattgcatacctaaatctatagcattttgttgtagaaaacttaaaacttgccatattataaactaaacagttcaccaaaaaaaaagcataaaggacatgtaatcttaatttgtacaatggtggcatgattcaaggtctacccacaacttatgtcaaggcaaatcaacaactatttttagacatcccatctaaatagttgaaaagatatcggaatccaaaaagcttttaaagttcgaattgagacatgtccaatcatttctccaataccagagtataagatatataggcatatggccaagttccagaaaccagctggaggtctaattgggcatctccgagatggtttccagctgtttcaacaaaacactccatattgaatccaacaaactccaaaggaaactaactagcccaaagcagaagttcagttttttggcagtcatcaaaccagctatcactggtagcaaccacagaacattgctcaactggcagaggtttggccgcacgaatcagacattacctatacctatttcaagttggaataaaatccttatttgttgtgtttggttcaggaggtgagttgggttgcactcatccatgtttttggaatgggatgcccccatccatccatccatcccaaacagaggcaaagcatgtgttttgattgaagtgatgggatgggtcgggtcgtgaatccacttgtcagggtgtttggtttggggacaggtgagatgggatgattcctgaaagggaatattccctctagatctaggtcagcttcatacctcgaaaactgctacaccgtccaatagtccaatttctcaaaaaaataggatcattccatcccttgtgccaaacacatggatgggaccatcccatcccataaaaacagggatgggtctaatccatgccacctcatccccaaaccaaaacattaagcatgtgtttggttccagggatggagtgggttgggttgggttgggtcgaacccatttttcaaggtgtttggtttgaggataggtgggataggatgatccctaaaaagaaatattctcctaagatccgggttggattggtccctcaaaaattggcggaccaatccatcccacttttctgtctcattgacatgtgggtcatccccgaaaactaggatcattttccatccctcatgccaaacgaatagatggaatgatcccgtcctaaaaagaaggatgagtccaacccatgacccatcccacctcatccccaaaccaaacacatcccaagggatggcctatcaatgagaaaaatgggttggattggtctgccctttttaagggacaagggcaacccggatctcaagggaatattctcttttagggatcatcccatcccacctgtcctcaaaccaaacaccctgaaaaatgggttcaacccaacctgacccatcccatcacttcaaccaattatttgcccctaactgtcacatgacatggatggatccaatgaaacatcaagggcaaataagagatcacatgaagttgacaggggcaaataaggtcatcctttacatcatctatttactaatctaattacattagtttgctatacctccaaaaaatgttcatacataactttttttgtagtcatacacatgcaaccaaagtgaagtaccaaaccctcaaaagcaggcagctaaaacatattaagctagtgtacattacaaagaacaaatgattatcatatgaaaaatacaaacagatatcagatatggtaatactgcaaacacaagataaaacaaaatagccatgacagcagtcagaagtaatatgtggtaggtcttaactagtattctggtaagttaatgaaggtattaaaatcaaactatcatatagtaaggaaacaataccagtcaccaccaaggggaacaaaattggcattttcctgagcttctccgctggctatctgttgcttgcgccactcctgaaacaaatggaaggaacataaatgaattggcaacttcaaagatatttcatgtatgtgatgtcaggcgaaagagaagtttacatcaatatccttttgacgctttctttctaatgcgtccaaagcactttctggctcttcatcctcctcatcacgaagctcctccttagcagctttccactattataagaaaatacacaagcagttgtgttagcaaagtgaaattggtggaggaataagtatatgcacatcaatactcacctcattttatgccttaccatgtaaacagattgatctgcctttaaactaagaaatggtgaaatgagaaaaataaatcaggtagcacatagttaatatgttttcagaatctttttcagcataacctctatttgacagaaggaaataaacaagtttaagctgctctagttctttgttggaagaggcagttgaggacttcacaatctccatacacttcatcaggtatatatacataaacaattagcaattacacatgttgtgaacagatatgatgcttggaaacagttataggaggctcatcgtagagagctaccttatccaccagacttgaaaccttcttattagacctcagtgatgttgcaacagaaacagctcgcttcttgctacgaacaactgcaaaacacagcaaaaggttaaacaatgttttccatgtaggaaccataaacaagatagtatattagtttttttatgaggaataacagaattacctttgctctgacttgtggtacttgtagaagcctgtgcagaacttccctgtatggatgctgatgctgatgttgctcccacaggttggctcaaagatgcaagttttgcctccttggatatgatgttgtcagactccctggaatgcaaactactattcgcaggagcaagattggaagagcttgttgtgttatctaatacactgctagaagtggcagagactgatgccgcgtagtatccagaaggctcagctgcttctccagtggcagccatagtgactgaaggatagctatagtaagaaacaggtactggagcaatagatgtggcatcaacaggaatagatatgccacttgcagatactggtgcatagtaaccattctggtgtgcttgaacgacatgaggctcactcgtttgcatataatagctggcatgtgtaccttctgtacctgcagcagcatagtactccattccaggaactgtatagaccaagtttgcttgatcgacataggactgtggaattgtttcagtagaaacagatgacacagcaggttcttcaggaggaggtggaggagctggttcattctcaggtggtggaggtggaatccattcatcttctggtggtggtggaggaatgtcgctatcctctaggggtgcagctgaaccgtccaacaataacaaagccggtgactgaacttgctctgatggaggatattccttaataggcgtggaattcgagtgcttatgctcttcaacattgtcatcgtcaacctccatatccacatccatatcttcatcattgtcggattcaatttttgatgggactgttgtggtatcattttcttctgatttctgaatggatgatgttgaaaatggctcctcatttttaacatttccatccatcataacgtcagtgctcacctcagatttcaaaccctcaccattggagggtggcatcatcacttcagcttcattaggtgttttgtgttctgtgtctgctttctctggatgtctaggttcagtggtagagtaactagtttccaatttggaaactgagaattctagttgcttaaggtgtacctcagcatgcaaccacaatggaagcaaagaagatccatacgatgaaagtgcattgcagtctgatattcgtatctcaatttctctttttagcaattcaacattgtaaatggaaccatgcaacctacaacagaagcatgacaaaagtttagttatacagttcaaggtgtggaaaaatgcttgaaagaggaagtaaatggcagaaaaataataacaagcacctttctagcggcttcaatctttgcagcaattcctcgccatatcttgcaagctgcaaaggatcaatgtccatcgattcatgactagtgacagctccagcataagcataagcatcatgagtaggctgtcccattcccaaagtagcataagccactgagccatttagcacagatatatcacttggataagcttccacggcattgtgggtaagggcatgtgcttgggcctccatagagtagtctacatgagtaggagcagatgcagaagtgacactgtcagctgcaatttcagaagctaatacattaggaatctcccaagaggtttctccagtaactgtgttccaatagtaacactggttgctctgctcatgcattatagtcttccaattcccaccaatgtcaccaacaatttgcatcccagatgagtcaggaatagcttcagttgctgttgcagtcccatcttccagagttggctttatggcaacaacattttcttcagcaatatttccagtgcacttcttatcatcagcttcagttaactcttgttggacattagcagaaccagccagatcactttgtgcatcaccttcattcctagtcaagtccccacgttcatgagtaatctgaaacaagcaaagtagtgttaccatgaggccaggtgtgttcaaactcttcaataataaaatcaattctcaagccaaagagatatagttgacaacattgcttcctatagtggctagtgtacaggaaaacaatattgctaagaataggccaagggcctgtttggcatggcttctcctggattcttgcggaaaatagagtttgcaaactgaacaatgtaatttaatcatccaacggtagactcaaatgtgtgaacaaaatgtctcgccctaacagcatttgggcccagctccaactccaagatttgttggagctagagatatcgaactccaagtctccaacaatactagagagtagctgtaccaaacagggcggcttgttggccaagcaagccccccccccccccaacaacacacacacacaacaaaagctagcttattataagccatttcataggctccagcttatttgttgctttatatagtacaaaactagcataagcttaagttcaagagcccataagataaaccaaagctgtagatcgacccaaagaaatggataaagagaagccaaaatgaaaggtagaattaccttatcacctgcatctgcaggattagcctctgtttcatcattgggttgatctgctgcttcctcttcctcttcatcatcactatattgcccaagcaacgctagaggattctccttcttatctggaaataagaatggatcagtaaaattgcaatagcttgcatgtggcaatctgcattgcactttattctgaagtatatatgaagatacacagtattcgagtataatagaagtcaaacaagtggtatatataggttaaaactatgttacatgcagtatatcagcctggcaataatataacaaccaggttaggagatgaattatagagaaagagacatacgaaccgaggaggcaacaatcacattctgatccgcacgcttagaggctgccaaaagagaaattacccataggcatttactcaattttgacagtagcagcccggtttgaagaatttactcaatgttccttgcaggccggaaccctacatgtgcctcaaccatatatgtggagcatatatatgcttgtacaaaaattccaaatttccaccaaatttaggttccacaggcatgtcttctttacaaatcccttggaaggaaactgatgaaacccacctgaagaagatggtgaagtgggaaccccagtttgttggtcatggttttcccctcgctctccctctttcgaaggtgttccccctgcaaaataccgtagcagcagtcagcttttcatcaaaaatatctatcccaaaatatatcagaatgcctctggaggcatgctaatttaatatctcttacatattaggtcgctatactgttactacttacaagcacgtattgctaccctaattacccctttcatcgttaaaaaactaggaagagtatccaagaactacacctctactatataaacgttgatttaatttgtttatcgaccttccttcccttaaccaaacctaaacttttatttgctctgactgctatatgaggtttctgccccctcccatttcacatgttcaaaatttggttagttcaatataaattcacctctgccttcaccaccgaaccttttcattgcccaagctatcgccgcaacccaaccctatttattcttttttaaggcaaaaacatcagaagcaccatttaagttatatttatgtgtttatgtgcagcttttatacatgattttgtgttatctaggttcagtgcagtttcacttgtccccgtccaacgtatttattgtcgttccttggatgttgacacttatcttctcttctcttcctagtgtttaaacatgatgataatccatatttttgtttcagatttggccagttcagaagatgtgctggatatatttatttccaaatgtggcgaacaattgtgccctttggtattattaaaccttattagtcaacactttggataactgcttagatactgctgactcaaagcctaacaggctgaccatttgtcagttaggcacttcatcctcctttcaaatccatatcgtgtgctacctccagatcatacatactagaaacaaccaaacaacatattccaaacccatccgcacggatcagacagccctcaggttgagttcaggattagcttcgagcagtgggggatggaccgatccacgcaccaaacgataataagtaaccacaagacaaaaaacaatctcgtgctgcccgaatcaatcaagctcgatcgaaaagcgtagcccgcctacaaatctagcactagtcacgaatcaaccgctctcaaccatcagctattccctaaaatcaatcaggcgagcgagagactaatcacgaacgcacgccgcgatcgatcagaaagcgaacgagatcgcccccccccccccccagatttttcgagaggccgtaggacgactcaccgggggagggatcgaggaagaggtcgagcttcaccctgcggccgcccgcggccgccttggccgcaaggcggcgctccttcctcctccccatcgcgcggcgcagcgggcgggcgagcgagttttctctctcctgttttctttttcctcctcccctagggttagggtttcggaggccgtgagatggggaggaggcgaagacgaagaacgaaagggaggggtctcgtgctctctcgtgtttggaaaggagaggaaagcgaagcggggtagggcggcgaggcggtttcgatgtgcgcgaatcgtaaagcatggggtatatatatgggcttcagagtccagaagaactcgcttatcgttgggcctagtagtagggaataagttcacttgacgtccctcgacttcatgtcgagtctgtctaaagtccctaatcgcaataccagaaatttctacccctcaattattacaaactgtgcaaaaaaaaaaaaagtcccaaggcagtattgacccaatttttccaggtttcgctgacatggcatacagtgggcaccacatgtctgtgtcatctcttctcttctctttcttttctttttcttttttcttcttctcttttctatcatctttcctttcgtctcctctattctcttcttcagcgagactgagaggctagcagacgaagcaggcaggggtcggcgcaggcaatgactacgagtgcaaaagaaacatcagtaactttaataatcctcaagtttctaaatgataatcaaattcatagttaagccgttgttgtgttgctcttctctctcgcgcatttcatcgagcatctctctggccaacggcaagatcttggccttccactcccggaagtccgcctcgaagcccaaccgctccattcccatcaccatcaccatgtacatgtacttgtccaccttgcagcctcccatcctcaccgccacctcgtacacactccgccccgcgcgcgtcttcgccctcaccaccagcgtgcgcaccagttgtacatgtcctcctcccccctccacgaccccgttgccttgctccttctcctctaggaacgcctccacaagcgcatccacggcagcggtggtgccgtcctcggtgaccggcgaggaggacacaaacgtggcatagagggtcaggttggggcgttaccaaggctcggcgcgggcaacgtggagcgtggagagggcgaaggaccagtagccctgacattggagctcggccatggcggtgaggaggtctctcttgaggaggaggccgtgagaggttgaggcggcggcgacggccggggagcggttagagtaggtgagtcacttgagggattgcacggcgaggatggcctccatagatagggagcagtcgcgctgaagcgggccacagttgatgcgccccgcccctgtctacttcgcctcccacccgctctcgcgctcgcccaccatcgtcctgcccgccggctcctagtctcgctgaagaagagaagagaggagacgaaaggaaagaggagagaaaagagaagaagaaaagcgaaaaagaagataagagaagggagaacgctgacatgtggggcccaccatatgctacgtcaacaaaaccaggaaaattgggtcaatattgcctcagtgtctttttttgcatggtttgtgatagttgaggggtagagatttctggtattgcggattgaggacctcaaatggtagcaattactattctagcccatttaaaatcccacgcaagcatgtcacatcttcactcactagcaattacgcatcatttacaatattatattatagagatcaataaaattattagaagttaaagctcacatgcaagtataccacatcatcacccactagcaattattattctcgtccatttaaaatcccatgcaagcatgtcacatcttcactcactagcaattacaaatcatttacaatattattgtcaacgtttaatgtcgcggcgattccggtatttgcatagtatggggatcgttggtaccagatatatgcgagacttaggtaaaagagatggggacgaggatttttatacaagttcgggcccctgaattgttaggtaatagccctacatcctgttggccgaagccggtcattgctcttattcaccataatcacaccagtacaatatttggggtagcttatctaaccgtcatcgacttggcggccggatcaccaacactagtcgacgacggggtagtcttcctcctcgaatcagcattcagcgaggtcagagatagcgctagattcctctctttggttcctgtaggtaccatatggggttttcctaggcttatctctgatgtcgatatctggcagcttgtcttggcgtatgttggcttgtatgttgatcttgtgtcttgatctattgttccgtgtcccctctcctcctagggggccttgtatttatacacataggtgtccacttgtccaagtagaactaggaaaaccaatatagatacgatccgagtagtacttgtcgtttccatgtagaactctattcatccttccttatgcggaactcctcctatatccgaaagttgtttccgtataagacatggtatgtggtgggtcctaccgagatttagtcaactactattaggtatgtggtatccataaccctgacaattatattatagagatcgacaagtatgtgtcaaatcatcttcctcacattattttctcaatatttcaactttcactatttcgataatatttaacctatacttattcatgaattccgcagcaaagcacggggtatcacctagttctatatgtgaacacaacaaaacattagagacaattagctattttatttattgctgactaaaaacaatagttcagccacctaggagaataggagaacaaccaccaaagcacaacggttgcgtaccaaacaagttatgaagctcacatctatactatctatatagttgatgcccactaacttctaaaacataatatgtaagtgtgacacatcattactcactagcaacacttagagtattttaaatatcatgcaaacatgacatattgtttacaattttgttatatttttagaactcaatatgcaaacaatgttaaacgattaactccacatcattttttattatttaaacatgaacatttaccatttttataatgtataacatgtatttaccacatatcccgcaacaaagcgtggggtatcacctattcctctaatgatgggattcttcttagagcatgaacaatgcaccgacacggtgagtggttttagctcgccaaaaacggagcgactgctccacgttgtcctctggcgtgcactctggagctacacgtgtcctcgacaaaggattttagtcattctcagtttgttgatttcacaaattaattaaatgtcatgttggagggctgagaatatagcattttatccctagccccaattcccgcataaattaaacttttttaatgttcactccataatgttagagcaagtttaaggccattcccaacgcaataactaggatggtgtttatagcattaaataagatgccaactaggatgaaaaatgatgtggcaagtgaataaataaggaaagagaaggaaatcatgtcttgcatgagacatagtttctacacgacatccaagatatcatgtgagataagtagcattaaaattaagtatggaatagtggtatttgcattggaagagtagtttcttgatgatgtggagtttatggaaactatatctagtatcttgggttgggaatggcctaatagtataaccaactactagctgcaaaataactatagccaacttaatagccaattcatacaaaaattacctataaacatacacttacatggtcccacccatcatacacgtattctgtcttggagtccgtgttgcagctgcctacaaatctgtaacctgctgctcttctctctcctcttttatcttctcggtatgtggttatagttggcttatattctgctattgtacctgctcttacaacgactaccggttgtgctatttccccttcttttctaactcaccactctttttccgcatgcacccttttttaaaattgttaaatggtgttttttttaaaaagttttctacatgaaagttgctttaaaaaataatattaacctattttttaaaacaaatattcaatacttaattagtcattttttcagttcaatgtgcgtgggagatgagttcccaactcattgagaataacacagcctccggaattaataagttttggcacgtggtactgttgcacgctgcagttttagcaaggaatcaaatctttcaccaaatcatgttgttgaacaaccatggtgaatggtccaatcactttctagtgttgtactaccattttagtcacgtgttgcgtgtgataaaatggaatgcataaatgtttttcaactaaaaggactattcaagctagtccgtcaattttagtttacgacttttcctagcacccttgtaaatagccacccttttatgcagggacatattcttagggaatttgtttcgccttaagctttcattgtctgcttagggtgtgtttagttctttgggtgtaaagtttttaaaatatacggacacacatttgaaatattaaacgtatagtaataacaaaaacaaattacagattctgcctgtaaactgcgagacaaatttattaagcctaattaaacagtcattagcaaatgtttactgtatcatcacattatcaaatcatgacgtaattaggcttaaaagattcgtctcgcaatttacatgcaaactgtgcaattaattttttttcccacatttaatgctcaatgcatatgttcaaacatttgatgtgacgttttttgccaaaaatttttgggatctaaacaaggccttagttacctattagctataagcaaaacttgaattctagttacctattagctataagcaaaacttgaattcgaatcttagttttgtagttgattttagggttttttatagtttattttttacatggggttttaaatcgtaaaacgtatagatagatataacctttttatccatacataatatggttgatttttttcaaggcttctcaatcttaactctacggataagtcataatttgccgcatacggcaacacattgaggcggacttctacctaattaaaaaccatcgctctcaagatggtaaaattcgagacaatttctcccaaagcgggaagatgcttggacctaaaccaaaccctctccataaattcgtcaaacagatagacaagcaagatcccggcggggcccaccaggttaggaagcgggagccaatcagagaagaatggtctaccgaggttggtgggcccaccagtcatacacagcagcagcagatgaaagtgatgcttggccctgtttagttcccaaatttttttttctcaaaaacataaatgaatctttaaatatatacatggagcattaaatataaataaaaataaaaacaaattacacagttatggaagaaatcgcgagacgaatcttttgagcctaattagtccatgattagccataagtgctacagtaacccacatgtgctaatgacggctaaattaggctcaaaagattcatctcgcggttttcagacgagttatgaaattattttttttattcgtgccaaaaaccttttctgacatctggtcaaacatccgatgtgacacctaaaaatttttatttcgcgaaataaacagagcccgtgtgtcgcgcgtttgagggcatgtacaacggtgtttattagtggtctctctattgccatgcaagtaaatttgatgacatggaagaaagagaaagaactatggttgttatgcatgacaacagctcagagtcgactcttagcatttattagagcaaattttgttgcatggttgtgaaacaaaggaaagaaaagtaagaaaaagtattttgatacattaatgattagagaccatattgtctctaactattataagatgctaatctttagataacgtagagcttatatctgactctacctttgtatatgccctgatgatgatctccaactggatccggggttccagaagggacaccgtaccaaacaaatccagcaagagcccttttctcacttgaaaacttgaaatgacggctttcccgttttcgatttatcaaaaccgattcataaattatttgttaagatataggagtataataaactcctaatgaggtgtttttttagcttaatttttttgttaaatgccaatagacgttcgattttgaacagattttttatttggcgacatgttattgctcgtcctctgtgtgtttcgtcaaaaggggttgacacacaaggaacatccggtgcacaatattttcccatttgagatcatgacctaaatgattttcaaagttaacgtaatcaaagattaaactagcttttaaaaaacattacttaaaataaaagaacaaagtaccagacacctttttgatgtccacatctacaatgatggccattttaactctctggaaagagactttcatgtgttcatcccgtaatctctccgtcaaaaaaaaacaaaccctgcgtttccgtgtctaattttaactatctgtcttatatgaaactttttataatttatattttcattgttgttagatgataagacataattaatattttatgcgtgacttgtctttttaatttttttcataatttttttaaataagacggacggtcaaatattggacacggaaattaaggtttgtctttttttttttgacggagggaggacagctcatgacacgatcggatcgacggatgctacagctacatacttcttatctactcaagcgggtagcagtgcaatatttgatgcctcagttttcccattgctccaatggataaatatgtgtggtgcctaaattgcgcatcaaattctccttttagtccctgcaattcggtgagctcgatttttttaatccatttttctttatattaattgtccttttgttttttcttttgaaaacaaaccttttcccaattgacaaggaaatgttgtaccctcacaaaagttttatttctcaggtattacaggtggatgatcagatctttgattaaaagtaagattatttgagagttttattttgttatattacaaaagtatatagaataaaaccattgtcattgctcggacgtaccgtgcaaacaaatttatactttttgaattgtaaattttcttttcgctacccatatacatatacgcaggatgagctcttttccgtaactcaaataaattcttttctaaaatttataataaatcatactctaatgatccgtaccattttcctggtcacgaatagctctagcccaactacacattcgaactgggcctttaagtcgagtcataatagtttggtttatttcagttttgatattttttatatcttaacaaacttatacatatcaaataattagttttgagcccttagactaagaatcagcacgacacaaatttacaggtatttcggtggtgtttaaatctcctaaagatgaagataaagattaagtgtttcatgtaaaataaggtggtaataatgtgtgattaattgagttttaattattacacacttgaaaaatagattaatatgatattttagaacaactttcatataagttttcgtacgaaacacgccgtttagccgtttgaaaagcgtgccacgagtatctaaaagtttatctaaaacttttaatagagaaaagaacatggcattcatgtaccaaagatggagttatttttccacagagagggtaacaaacaaacattctccatcaaaccaacgctctactcaaacttcggcaatatccatatacaaaggctgcttttagttcatgccaaaattgaaaatttgattgaaattgaaatgatgtgaccgaaaagttggaagtttatgtgagtaggaaaatttgatgtgatggaaaaagtcggaagaaaaaattggatctgaacacggtgaaagtcttctcttttctgccatgaaagtttgtacgcaccataattttttttgataggatcgcaatacaaaccaacccatcttaacgttatgcttattttcactatattattttctaaaaaaggaattatatagttaatctattactttaaaccatcaaaatcagataatctataatccgcttaaagcaattagatgggcttacatattttatctttttatcgtcttggtctttggtttctaaaattcacacaaatactacttctttatataataagttcatcttttcctttttgattgtctcaaaataaatttatttttaatcaacatttgtatcagagtatataaaagtacaaaataaaataagaaacaattatttaaaacgaacggattacttcactgcactcaagcttcaactaagcctcatcagcaaatggcatatttataaacgaaaaataatttgtaaataaaattttatatatatatgtttttagctatttaaaagtaaagactaaaaataaactttgataaaaagtaccttaaaatcaactttaaatataaagttaaaaatatttgtattttggttgataaaaagtataatcgaaaagatgacgtgtggacgtggcaggctgagggcggaaggaaatatgccgttggcggggccagctagtgcggcggtggccacgccaaccggaaacgggcgatccacaaccaccacctaaaattaccaaaataggcagagcgcggatgatgtcgctgtctgtcggttccctctgggccccacccgtcagcgactccacggcacgcgcggacaaaagtcagattgggccagtcgcggggcacctccaacttttcgcgcagcagtgccgccagcagcagtagcagcagcaaacccacgtctacccagcctcactctacccaacacccacagacacgtgggacccacgcgtat

SEQ ID NO: 81138 - DNA, 8965 bp, Oryza sativa
tttgagatttactgctttcagcttgtctttctgttcttttgtgctgtagttgtgacttccttgtatgctacattgttatgatctgtgactcttttgttgtattctgcaaatcagtttatatattgtttgttccaatgttcttatcagaatgcataatggcataacaccttgttccaataattagctgtatcgttttttttgttcttattgtttgttgtttataataaactgttgcaatttttacttgcagctggaataccttgaggaacgtcgcctcaaggatctggtgaagaagcattctgagttcatcagctaccctatctccttatggactgagaagacaaccgagaaggagatttctgatgatgaagacgaggaagagaagaaggatgctgaggagggaaaggttgaggatgttgatgaggagaaggaagagaaagagaagaaaaagaagaagatcaaggaagtctctcatgagtggaacgtgatgaacaagcagaaacctatttggttgaggaagccagaggagatcaccaaggaagagtatgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaattccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtctgctgaggctgacgccgacatgccgccgctggaggacgacgccggcgagagcaagatggaggaggtcgactaagcgccatggttgtcattcggcccccatctcctggagccctagttctctatagctttatctgactctgtgctcttcgccatttttgctatgctggatgtatcggtattgccgtatcttagcgcctgaacatttcgtggtatttgctcaaacagttacgttttaaatttaaatatgctagttaattaatccagaatctgtattttcttattctgcattagcccttttatagtaactctttgttctgcattatctccactttgttcttagcttgaatgggcctttttttttctctgttgcccccatctctttcaatcgtagtagtacatctatctttgatacaatttttttgatatgctattttgaactgagcttcttgttgacaccggattacttttgattggcactgaatagcttgttgtacactgctcatgtcttctcgactgatctaaaatcctatcacttaacacatctgtgaaggattccatgttatttgcttaagagaacaaagcacaaagcagcccaatcttctcctcgctttgcctctctgctttaataaaagcaaagcataacgcattccttaacctgtcaatctgtccatccacacgcagccgctttaccaactctcccaagaacacacacaagacacaaactgagatgctcacctgtcgctgcgatccatttgccgctgcattttgatcatgccgtctccaacctcgtcggcgtcggcagcggccagggggagcgctggcgccggcgataccctacgcaactcctgccacgacttcgcgcgcagcctggcgcggctgccggccagcatcatggacggcctctccaggtccatggctcgccggagccgccgcccccgcgacacccagcctcaccctcctcttcctccgccgctgctgccggaggagctcttcttcgccgagttcgagcggcggtacggcggccgccacccgttcttctacgggtgccggctagccgaggcgctggggatcgcgcggcgggaggggaggctggtgttcgtctacctccacgacgccggcggcggcggaaacccctacgccgaccagttctgcacggggacgatgtgctccgacgtggtggtggagttcctcgacgccaatttcgtgtcgtggggcgccgtcgccgggagaggggaaggtgcggccatggtggcggcgctgcggcccggcagcttccccttctgcgccgtcgtctctcccgtctccgacgagagcatcgtcatcctgcaacaggtagtacaaaaccccataatattacagaagcaacagaatccaaagcgttccctaaatgtttgacgccgttgatctttttaaacatgtttgaccgttcgtcttatttaaaaacttttatgaaatatgtaaaactatatgtatacataaaagtatatttaacaatgaatcaaatggtaggaaaagaattaataattgcttaaattttttgaataagacgaacggtcaaacatatttaaaaaagtcaacggtgtcaaacatttagagatggagggagtattttgctccatcgtttcttcttcatcttatcagatacaacgaaaatttgaatttcagaacttagagtttaatttagagttgattttgatgtttcttttatttggtttaatttttcagcattgacttataaatatttaaatcgcaaataaaaatttgcccacaaactattttttgtcgttaataaacatcacagcttataatcaagtatcgtctctagtggtttcatccataaccatcataactgagcgaaaaccagtgaaatcgaattcttttgcgccaaaattttgaattttaggattttttttaatttggccggtttatcgaacggtttctaaatgcagaccagcaagacaaggccaacgaaaccgtgataactgagcggttatcgtcgcattttgaaacgctaaagcaagtagcaacaatactaacaattatgtcaacctatttgcacactaaactctacagcatattggttgcatcgatctatcttggcattttaagtttttgtattgattaagagatgacacaaactgtatcttctttcaggtagaaggcccggtttcgccttcagagctggtggacattcttcagagaacaatcgatgagcaacgtgcatcctccagacagtcttggcctgatgagcagctagctgcagcagtgagagcctcaagagctgatgaagaagagaggatgagatcagtagctctaaggctaagacaggagcaagatgcagcttatctcgaatcacttcgaaaggatcaggtagacacatgcatgttcatcatgttgaggtggtgttcttcatcatcagttcatgccctgttgatcagggtgagctcactgactccattgatgcaggagaaagaaaggtccaggaagagtgttcaggagggatctgcgaaaccaaaggcgagcaatgtgcttcgtccaagataccctggtcaatctgcaagggagcctaacaaggcagctcaggccagagctcctgctcagaatcagaatggaactgtggcttcacacagagcagaagcaaataccaaggtatgaccaaaaaaaaaggattatctcttgtcctcgtgtacagatgtacagtgcatttgtaactgctagcagcaatatttgggaaaaaaaagttaattacttaacatgaaaatttctggggtttagttattcagttgacaagtgttcagatcatgcattcaggtttttctgatgtctgaactccggttacagtgataaaaatatcaagtgttaatgtgttatccatctactagtatcattgtgcaaaggatttttatgggaactttggtgcagaactttttatgggaacatccctgagttaagaccagattaattgtagaactttttatgcagataatgataagatttcccaatggagagagaaggcagcaggcgttccatcatacagataccatcagggaaatctacaggtatgttgattccctaggcataccaggcatcggaaattatcagctcgtgagaagctatccaaggaaaacttatggtcgccagcagctggagatgagtctccaagatgcaggcttctatccaagtgtaacactgtacattgaacagcttcagtaaacatgctgtaaccatgaagatgactgcaaatttcgtgtaacaaattacgtacaaacatctgcatatgtgcatgtgtttctgcattcaactctactgaatgcgtactgccactttgcatacatcgaaacaagttacagtatgttgcaaaggaaaagccacaggcctgaaacttcaaagttcagagcatgatgttacatgttgggaaacttcaaagttcaaaacaaccctccatttcctgggctgcatatgaaccgtccgattgtatataagtggcttcagatcagcgtagtagttgtaagggtatcctcaatgattattgcaaaagtactccaagaagtaaagtgaaccgtgccaaatagtaatagtagattgaagatacaccatactacatatatgcgaagaatgggtaataaggtgagactatctaaaaaaaaaaagaaaagccaaacataagtcataccacaattaaaaagtatgtaggactcactacaaaatgcttactactatctccgttttaggttataagactttctaacattgcccacattcatatagatgttaatgattctaggcacacatatatgtctaaattgattaacatatatatgaatgtgagtaatgctagaaagtcttataatatgaaacggaagaagtataatttagtaataagcctatgatttgatagtagttaagagtatttactatttccttaatttatcttagctactagcgatacttaatccctaactttgtaaatactttttcaatacattgtggatgactggtaactatattgaggaatagtaaatacattgaggatgaaaaagtaaatactattttctcaagttaccggtatccattatttggatgaccggtaactttgtagaaaacaccctaacacaaaatcgtatgttcaaaatagcccccggctagccgaccgctagtccgctaccactgcgcgatccgaccgtcgaatttgaggtcgacattttccgccaataaaaccgcacattaccttcagaacagataaggcgccccacccgtcagtctcacggtttctgctttccacatccgccgcggccatggcgctcgtcaccgtccacgcgcgcctcgccgccgccgcctcctccgcctcgccgccgcttcgctccgccgcctcctgcacccgcctccgtgccctcagtacagtcaccggaacccgcctcagcattcggcaccaacagcgccggcgctggcggcggccgaggcgcgccgccgccatcgccgcgtcgctcgacctcaacgaggacaacgtccgcctcgccatcgacgaagccaaggccgaggcaagcttgagtcctcccctcctcttcttcttccctcgcctcgtccccaattggaatttggaacgccattgttgctgattttctgaatctttgcgcgaattcgcctctgctcctgctctctcagctgggtcagctgttcgacacatcggtgggaatcacaggtgaaacccaatcgtccaaacctgcgttgcttgcgatgaacacggatcaagaatccgggagtaatctgcgttgctgttgatgatggcagggcaagttgatctcgcggagctggacgggccgttcgtgaagctccggctcaagggcaagttctggcacacccgcgccaccgtgctcgcgcggatcggcaactacctcaagaaccgcatcccggtgagcatgctttggagtataaagtgaattgactgtttttcctcgtcagtttaagcttttgggttgaactggtcggtgcatatgcaactcaatactgttgcatctttctcacttctgtcatgttcttggctcctgcttgcgtgtggagctggagaaagttttgtattttggacttgttaagaatgttaggttagtgatttagtgagtgagaactgagaagtgattattgatttattgtttgggcaggaaatcttggaagtggagatagaagatgagaagcagcttgatgatagccctgcagccttctgaggtaaccaccatacatgaatactgtagctgctgactctctcagtagttaaatcttgtcatgcagtaaaatttgaaatcttacaaatttcaggtctagaaaagttgtggtgaaaactgaaagcacatttaaatcttccgttttattcactatgcacattttacttactgctctctccaatccaaaatacaagcatttccaggtctttagcaaaaaccaaggtagagtgaaagaaaaaaaaatctctttcagtaacttcaatggttaaattttgaattggttcttcttgccttctttcaataaataaataaattttgaactcccttcccaaaaatcacattggttgaaaatttatagatttccgtgcattggaataagtgcggaagtgcctcagaaatgtttatattgtggtataaatcttgaatcgtagatgcacttatattttgaaacagaggcactagttagtatggcagtatcattcatgacgatacgaactacctgttcagccggttgtcactgtgggcataacatagctgtatattgcagtggcattcaccagtcaatggctccctccaatgcacattgcacaaacctgaatttctgaagttaagctgaagaaccaagtctgctggaatgcactatcctacattcctaccttacttttctggtcaacatcgcacaaattcagggatctccaattcccctacattttgattgtggagatgcgtatgatttgagactattctattttactagcactcacgagtcgcaagaacctgaaaactgtactgacgggacctacttacggagaggtttattagacgcttttcctgattctgagcttgttggtatcacctttatgtgtatttatttaaaaaaagggtgtagcaatgatgtgctgctattctgagtactatatttgtgttcactctttcgaatgatgtttactccatccgtcccaaaatatagcaaccttgaactggatggaacacattctagtacaacgaatctggacaggggtatgttacatttgaaataccactgcatcagtgtgctcctgtggacagtactctggtagaggtataagttggctgctcgttcacgaaatgtactggtcatccatccaatgagcgtcatggtaattcaaattcttcaatttgaaattctgatatcctgattttctcagttcttacccatttgagtcatattttttatgttttgtgaactcattaaatagggttcttggaatgttgtggcaacgcagctgtggccatttcagtgctcttgtcaatctgtcaaatgtttgggcagcaatgaactaggagtatctgaagagaaagcagtttgcaaccctaggctctagctccgtggaacaaaccatttcgacaatcttgtactgaaatgtactgaaatcaaatactactatattcgctcttttcctttgagaaaaagttgtttgaggccacttctggttcctactccgatgtacttattggatggtgcaattgatgatgctggaaactgttgctttcaaattacagggagaagttgggcttgtctatcagagtaggtacaatagcaggctataagccagctgcaaatatattttaaggagataaatcaggagagagaagagcagcgggttacagatttgtagccagctgtagcacggactccaagacgctataacaggtgggactaggtattaatagtgtagtatgtaactattgtatgaatgagctattaaattggatatagataaattggagctagtagttggctatactattaaacttgctctcatgtttcagaccagaaaaaggtgagtatttcatcataaaaagggacgtatttgacgaagcatgtcagtgcctaatcctcagtagagtggagtactagcaagaaacaagaattccgaaagaattttgcacggaagctctatccaaatgtcccttcatccatcaacgtattggactgatttttttcagcgaatcaactcgttgctagtatctctgagtct

SEQ ID NO: 81139 - DNA, 11082 bp, Oryza sativa
gtctgtatttaggatattgaaatcatgatattttttatgagatttgttttccctcacacacatttataggtcactgcgccaaatcagcactgatggcccaaaccgtcaattgtgacaggtaaggctctcgtcagagatgactgattagtaatgactctacctcatctttaatggatgaaggcccgtcagtggaggtaaatatttgtgatgagtagtaacaaacacccgacaatgaggctgttcacctgtgatgggatggtattttagcttgccatcgaggacacttgtctaaggtgggttataattacaacctagtatcatatatgcatatgatgggataaacaaaattcagctcacacgctagtatccgtcactggtgcagattaccgatggagaaaaaaaaaagagggaaaagtccattttacaccctcgaactcttgtgcttatctaaaatacacccccgaactacaaaaccggatataatacaccctcgaactgtcaataccggacacttaaccccccagactgtttttaccgtggtttttgccacgtcggataccacgtcagccctagccacgtcagcgcaaaacataaaatgggccaagcccatattctctccccccctctctctctctccctctctatctctctctccctccctaccctgttcgctctcctctctcacaaccgttggcggcagaggtggcagcgcggagctgcgaaatcgacggctacggcagctgcgtagagctgcgagggcggcggctgcggcgtcggcgtggagccgcgagggtggtggcggcggggagctggtgtgaggccggcggcgctgcgaatcatgagcttgatgcccctcgcggaagaggccaacctcgcctgagccatacgcgcggggaggagtcatccctatgcagtgccgccaccgcttggtcgaggacgaggtcgagctcaagctctgcatccgccgccgcctcgtcaagctcgagttccaccggcgagctcgattcatggagaagatggagtcatggagctcctggaggcggcaggagaggtggacctttgagcttgtgctcgtcggtggtcggcgcgaaagggaaggctggggatgtgcttgagctccgtcgccgcaacgagttccctgctccacggccaccgatctcctgctcagctccaccactgctctctgtctgggaggaagaaggatggagagagaaagggaagaggagatgggggaagaagaagtggctactgacgtgtggctcttatttctattttcagtcgtatgtcatgtctagacttccgcatcgttgtcaagtagactgtaaccagctgaatacctacttgagggtgtaaagttacaggtattgaaagttgtagtgggtgaaatatctaagttttagagttatgggtgtattttagccaagacaaagagttggagggtgtaaaatggacttatccccaaaaaaaagagaacatcacaatccgggctcgttgccattgcatttgtcacgatcacaaattcacacaggaaggatggcaagaaatacatcacaccataaatttatttgcactctggaaaatgattacgaatcgacaatctgggcgcctcaagagatgctaggggtagaggaggggatggtgctgggacgttgagagatggcgacaggagcctggcatcggttcgagccaccatgaggtcgaaggccataagatcaggtgtccctctgacctcgggaaggctggatctgcgattcttagggcagcggaccatgcttaggagtagagccagaatgcaacgccattggtgctcaacaacggtggtggagatgacactggcgaggctcttggggataaaggagtcgacaccggtaggcgacacatggggatggaggaggcggtgtctagcggttaaatctatgtcccccgaccctgacctcgtagaggatggatccgatggtcgggggacaaaggaggcgacacttgcatcatggtggatgggaaagaggattcaagcctttaggggcagaggaagaagaaagagagagagaggaggggatggaggaagaagggataaggacgagacggggagggagagagagactcattaagggaggggagttgttttatttgattttttaggtcattactaacgtgttaaaaaatactctcatcacagatgagtacctcatccgtgacgggtgtaaactcaacacctgtaacatacaagagatcatctgtaacgggtctatatgtgagctcgtcaaatatgttttgtgctgagtctccatcacagatgagtccttccctataacagattaacagaccgtatccctaagcttcatctagatgggccgatgtggcgtagtcggtcgcttattggacccagcccactaatcaagccataaaaagtctttcctaccttttttagggaaggaataagtacactgaagatccctcaacttgtcattgagttacaaaatcgtcatccattcacaaaaccggatatatgacgtcatccattcacaaaaccggatatatgacatctctcaacttacaaaaaccgttcaatctagctcctttagtggttttgaccctggttttatcctacgtgtcagctgagtcagcgtggaacccacgtaggacccatatgtcaagatgcccacgtcatcaccctctctctcactcctcttctctgggcaaccgggaaagccggccggcgaggcgggagaggaggcggtggctgctgcaacgcggctgaaggcgagggcggcggccggtcgcgaatggtgtcgacagcgatgtgtggccgccggcgacgaagcggccccgcacgggcgggcgccgcggcgttggccacggaggtggaggcggggaagggcgccgcggcggtggccgcggaggtggagccgtggaggcggggtcgagcaccgtggagctggactcggagccccggcctgctctcgcgccgcatcctccctttctcagcgtcgggagcgtcgtcgtcgtcgtcgggcggcttgtctgggcaagccggccggcgctgctagggaggaggccgctggggcgaggcgggagagggggcggcggcggcgtctacggcgctgtgtcgcagccagcggcgaagcggccccgcgccggcgggcgccacggcgttgggcgacgaggagaacggcggagcaggcgagcaaggcgggcagcgacctcgctctcgcgtgcggcgtcggcgtcgtcttcatcctccgcagcgagctcccaggcgacgaggctgctcatcacccggaggcgctcggcgtcgccgcgacgaggctgctcatcaccctatcagcgcacatggggcacaccatcgccgagaggctctgcaagacgcagggccagccgaggagcgccggcttgtcgccgcgggctggggatgagagccaacgccagcggaggaggcgtacgaggggcggagggccgcgctgctgcgggcggtggtcgtgggcgcgacatgtgaaaggattttttagctcgccattaaggaataaagtaagaaacgcgtactctctatataaaatgagtacgttcaccgacgtgaaaggaatttttagctcgtcattaagagcttaagaaagttacttggaattctttggtttgttgacaatcacgattcatgacaaaagaagattgagagcctacgggtgcacgccagcgcgctgctctcactgtcgtcacccgcgtggccacgtcgatggcaccgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaactacccgccgccagtggcagttcctccctcgccggccgctgcccgcgcccgccgctcggccgcgcccatctgctctctgccagccgcctgtggtccgtggagaggggaggagagagaggaagagagatggtgaggggagggaggaagaggctgacatgtgggacccacgtgggtcccacgctgattgggctgccacgtcagacaaaactagagtcaaagtttacactggttttataaattggggtacgtgttgtatcgggacgattttgtaactcggtgacaagttgagggacctccggtgtactttttccttaggggaatgcctaaggtctaagccattgctaaaggctaatcttcgatgtcatcaaattaaagcccatgggccatggatataggaggacttttggcccactcggccagcttccgctgcggccctgcctgcctgcctcttgaaccgcgtggcgccgccgccgccgccgggattcacaaaaccaacggagcatacggactagaatcttcgccgctcgccgccgcggggaccaatggagcgcgcagtgcgggagctgtgggcggagtcgcgggacctgctgggcctccactccccggacgacgccgccgccgccgacgccgcgatgccccgcgccgagatgcccccgacgccgctcgcgtttctccgcgaccacgtctcgccggggcgccctctcctcgtgtcctccgccgccaccagccactggccggccgcctcgctgtggccgaccgactcctacctcaccgacgcgctccgctccaccgccgtctcgctccacctcacccccgacggccgcgccgacgccctcgccccgcacccgcgcccgagccaccccggcgccaagtgcttcgcctccgcgcacgtccgccaggtcgacttccccaccgccgtgcgcctcatccggagctccgatccggcctccggcctggtggcctacgcgcagcagcaggacgactgcctgcgcggggagtacgccgccgtcgccggcgacgtggacgcgcacgtgccctgggccagcgacgcgctcggctgcctccccgaggccgtcaacctctggatcggcagcgcctgctcccagacctccttccacaaggaccactacgacaacatctacgtcgtcgtctccggcgagaagcacttcctcctcttgccccccaccgagcaccaccgcctctacgtccgcgactaccccgccgcccactacgccgcggaagatgaagcggagctgaggcttaagctggagctggaggagcccgagaggatcgtgccatggagcagcgttgacccctacccgccgtcgccggaggaggcggccgcgcaggcgtcatccttcccgctctacttcgaggggccgaggccgatccgctgcacggtgcgcgccggcgagatgctctacttgccgagcatgtggtttcaccatgtgagccagagccccgggccgaacgggctcaccattgcagtgaactactggtatgacatgcagtttgacattaagtatgcctacttcaacttcttgaggtcattggagatcgatggtagttcgtcgaaaaagacggatgctttggaagacgatctcgaggagacgaatgattgaattgaaatttttgcggtaattctggatctatgcagaatataacttgattcaattgttgtgacttgtgagcattgtcagtttaatgttttggaggcagaggtcagggcatagatcttgataacctgtgtttatgttgtaccaattttcagggccaaatggcttatcaggtttgatttagtttcagagtcaacatattgatgtcaactttaaaattttttattcagatataggaaggtgaattttgtctaagatttactctccactagtcatgcttacattatgcaggtctgagaaatggccatcttatgtgaattatgcatgttttagtgccagatggatcagatgttgacagaatgaatatcaagcaattacatcttctgaatctgtgagtgttgtgtccggtatcataaacttgatgccaactctagattgcaaatacatactatattcatctttactcctatttatgagaactagtttaatttcaattcctagacatggtcttttgtttacctgttgttgtgataacatattgtcatccttattactgaacaagtgaacatgcaatgctttctattactcaacaatcagataattcactgtgcaatttccagaactgttagttttattcccaaatgtaggatttcacgagcattccgcacaacatttccatttgttcagctagcttgtgtgatatgtaaagtacagtattacaacctcctggtttctgccgtgtgccaataataactagcaaatgaaatagctcaatccagaataagaatgcaatgacaaaattataaatagtagacatgtaaaaaaaaatattgctgcaaaactgttgtgcttcaggctgccttggccagctccctgtccacagccaccttgaggaagctgccttcctccaccaccatctgaacaggcaggaacccgagcccattggcgacggcgagcatcacctccttcatctcggcccggaactcctccaagtccaccgtgccattgccgtcgtggtcgaaccgcgcatacaagccacggtacatctccacgagttcatcggagctcatggcggcctcatcaacaccgaaatgcttctcaaggaccctgaggctcatgagctcctttgccatctccgagtaggagaggaggccgtcacggttggtgtcgagggcggcgaaccggccatcgacggaggagttgaaggcgccctcgtcctcgacgaagctcctgatggtcttgccgtcaaggatttctacactcatgttgccggctctacaaaatgtggcggtctcagagatgtttttggtgtgtagcagatgagtgctacaaaatgtggttgtatcagagatgtttgtgtctttgttctagtactttggtttgagcaaatgttgagcttgtaacttctacttatatagagaggcgtagcagctggttttggagccactatgaccggcaacatggtatggggcatttccagtgcaatgttcccaacccctactgccttcggcgttgttgatgattttacactttcaaatggaagattcggctgtgtacttgtgtgctacgccatgatttgcctctaaaccaatggatgtgttagcacctggtttcattaaaagcggcaaaaatgatggacgacgatgccttaagaagtcggtggttagatgcaccggtaaagcctagcccactggtattgacgcccgcgttttctgttggactcgtgaccacaagagtcaatcccggttggactctgctggattctgatagtgtttgcttgccagttttcaattggaatgtctagattctaccatgtcggctgataattatagattaacccttttttaaaatagtttatctagatttactagtccgattaacaggttgctcaatgcttcatacgtagttggccgcaatttcgtcattgcaaacagttcatcacattggcagatgtggcaacgagttaaataaccagatcaaccagaacagcatgaataaaagggaggagattaaaaatttactactagtaacgataacttcttcattcagagtgatgatagagggttcaacatcccagtcgcagcttcgcagggttacaacttctttaagcaacaacccagagctctcaagcgtactaagtaccacaactacttctagactacggacataacatggtagctgggcatacgaagttccaagagattaacaactacggagtacttctaaactggacataacatggtagctgcgcacacggagatccaagagattgattcagctggtgaacactttccagtgcctcacgctatcgaaagcgagttgatgaacttcttcttcaacctcagctgaaaaagaataatagaaatgggaacaaatcagacattccgagtttccgaccaaagttgaacaaacactgtaattgtacggcttgctctgcatttgtgaggggaaaaaaactgtacagcgtgtattgcaaccgatgcagaacacagtaatcactagaataaacacaattcaaaggcaaaccactgaactgaattggtgttcagactgatgcgactctatccaaatttccaaatccgtgacaagcgcacacggaggcaaccaatgacgatttcaaatttccaatacaaagtacaggagtatgacaactatctaagacaaattcatctccagcattcagaccaaagcaaagccaagaacatgaacaatggtgtgttcacatacgaagaggaactttagaaatgctcacctccttgctgtggccacacttcttcttgcggcagtggtgagacctgatgggaaggcgtgcatagcacctgcatcaggagatggaacagggttgaaatcaaatcagttcatgttagccgcggatgcaaagctagtatcatctggaatcaaggtgcgggcgggcgggggcgtgcgtgagttcgtacttgcggcagaccttcttcttctctctgtacttgagcgcaagagcccggagggtgggctcctggatggtgtagccgcccctgctgccgccgcggaggcggagcaccaggtgcagcgtcgactccttctggatgttgtagtcggccagggtgcggccgtcatccagctgcttcccggcgaagatgaggcgctgctggtccggcgggatacctgtacgggttgtgcagagatggatacagttcatcagcttaaacagcagagagattcgaccatgcgcacacacggattcaacaatttccagcttagcagagcgtgatatgaaattaacactaccggaggatcaaatcaatacagcatgtaaaaggatacagaacgttttaggaatcgattcaagtagttcgaatcagattataaaacaacatacttttttgcttattgtaacaagaaaacaggggaccttttagatctagttaaccgtgcagtatagcgtgacagttataaaaaaaatcgcctccagagaaattggaaaggaactattcaatcggaaggttttgggtttttatacgcttttcaagatggatctactctgttacagatctaaaaaaatggtagaaaagcagcaacattggatgggcgatactactagagttcacgcattttgctcagtattccactaaacccacaaaaacttgcaactgctatacatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatatccacagcgcataaactccactaaacccacagatttgcacacaaacacagtaacatatcagcatatcgagcacaccaaacaaagcagcaatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatatccacagcgcataaactccactaaacccacagatttgcacacaaacacagtaacatatcagcatatcgagcacaccaaacaaagcagcaatcaatgcaggtcagcgagaatggggagggctaggaatggagagacggcgagtcggcgaccatggccggtgcgagcataccttccttgtcctggatcttggccttgacgttgtcgatggtgtcgctgctctccacctccagcgtgatcgtcttccccgtcagcgtcttcacgaagatctgcatcttgccgccgtcgaacgatctccccgcgctctcgccgatcggtggagtggtggtggtggtggtggagtggtgcgccgcgccgcagtcgtggtcacccgctcttatatatgggcgaggaaacgcagccgccacgaaagcgaaatatcccataaaaataaatagaaaaagaaaaggaaaataggaaacgcagccgctacgaaacctataaatgtcgtaagaaaaaaaaaagatgaaaaagaaaagagagaggaggaaacgcaaccgccacgaaaccgaaccacaggattgacacgtggcacgagtacgggcccatggagagctacaggcttctggctattgggctggtccgtgtatatggcccaagcagacacggcttaaattgtggaattttttttatttatacatttttttattaaaatatttacaaaaataattttttgtttcgaaaatttacaaatttaattgcctgccgcccttaagaagggcgatttttaaaaatcgccctctcaaagggcggcaagggacctaaatacaaaatttttatttgtgatcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcaaaacaacaaattatttttgtaaatattttaataaaa

SEQ ID NO: 81140 - DNA, 1964 bp, Oryza sativa
ttagctaagtataattgcataaagtatagcaggcttaggaggcaatgggaattcagccttcagatcatggacacttttgagtttcgaattgtctccaaagatcatcaaccatgtgaggagtgatctttggacacgctcacgcaggccagtcttcttgtcaagtgtacgagggaaaggataggagaaaagtattgcaaatttgtaattaaaagtcaaacatacgcaactcctatgaaaaaagggtcaaaatagtcaggccaatctgtagaagaaaggtggtctatagtagacaaagtgttgcccaatgggaacaagaccaaagcatgacaatttatttataaattaacttctagttctaatttaatatccatatgcatcattaaggcagaattttatagtttctaacgagcccaagtccaaccataaactttatcgagaattacacacgatacacgaaaaaaactgctcttgtttggatttggtcgttttgtttataacttaaattttataagttcattgaccccataagatagatactttaagaaatattgatgtagattaactgctgtttaccactcctaagccaaatgaccagttacaattatcagcttgaataatttaaatatagctctggtagaatgtctcaaaaactcaaagtacaatgtgaattagattattcacaaaagtttgtcccactccggagatatataataaagtaccagcatatctcttgcctcgaaaagtaattgcaaagtgattttgataattttggaatttcttgatcaatagaccatcataaattttcttacccaccatgtgcttattaattcatccctatctataaggcccgtgcaagtcgatccgttgatccctatttataaactcttttgctagtctcttttctcctttcaaaatttgcaacaccatttggacttttgagcatatatatgtgccttgtgtttctacgacagctagtgcaatgggcataggaggtgccaggattgcaacagcgagttcaaggctccgccgatggagcagatccatgcatgtgtacactgcaaaattgatgggtagacttcatcatgaaatcccaatgcaaatactgtgtgctgatgggatcaaccgaagcccatgaactgcacgcacgcgacgtcgacacattgcagtgcacgcctctctttccatggagacaaatgctgcagcaagaagaacacacaattccagtttttgccgctcgacttgttgcggttgtcttcttggggtttgttcatctattttggtgttaataagctcctcaatgaccggccggtaactaaattaaaccagccgaccctaactacctatgtaatctttaatttcatcatccattaccgaagattttcctatagataattgtgatgggctactcgccgagatgttctgttggatttatttgtgtttggcacatttattttcaattaaatctataatattcaaggcacacgttaaatgctgatgaattaccggacatgatgtgtaaaaggtttctgttcaagaattgataattcaattgacacggaggattgatggctcaattagagaacactataaatgctgactattagtgttgattgatggtgttaatttggcaaattaacaacgtccattaccagtaactgatgttgtccaatgggagtaatcggtttcaacatcatctcctttacctctgtacgcatataatcagagaaggagctagctcctggatgtatggaacaaaaacacatcactccaccctctgttgctgctgcactactgaattctcatcgctagtttctgcacgtacagaaccagcgagagcaggcctccgaaaccatgccccgctgcgacgtttgcacggacgggcgagcgatcaggattttagggagcgcaaggcgtgactgctcactgttcgtttgcttcatcttcttcttggtaccgtcagtgag

SEQ ID NO: 81141 - DNA, 11418 bp, Oryza sativa
gcgtcaaacatttcgaaacggagggagtatatcgtttgtcccaatgttcttatcagaatgcatagcagcataacaccttgttgaaataaatacttgtattgtttgttttgtttcttgtctcttgtgttctcttgctgtttgttgtttaataaacaactgcaatttttgcttgcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatgatggaccattgtttgcccgcagtatgctggaacttcttccatctgttattgtatggctagatagtggatggtaagcttagtatgcctggttgctgcaaattgatggaatgatggaccatttttagcctgcagtattcttgaacttcaatttgttagtacaaggctatttagtttgaatgagtgatggaatgtttgttcactgttgatgcctgcaagatagaatgcctcgaatgtcttcttgctttgatcaattaaccatctgcagggaatttcgttgtttcaatcatctttggtcgacctcgagagctttctgtttccgtttcaatcatcttttcgttgtttcaatcatctttggtcgacctcgagtactacttagtagtagtggaccagtaatttctgcccctccgctctagcacaaacccaactgacgaactgatccgccggttgagagatggagcacatatgcgtttttgcgttgtgaggacatcgtgaggtacgtgtcggctgatctgctggctgagctcacgtgcatctgtatcggatcggaggcagaggttagaggtacgtgtcgattgcccgtcgtgagtacttcctctgcttgacacctggtgcactgccatggcgaggtggccatgaaacccgaatccctagctctatccacacacataaaactagtcttggattctactagtagtaggccaaaagcaacatccattataaacagtgttggatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatagacggtgtaagtgggtagactatgggtgttggtcggtgagccgcgaacccacttattttaatttataagtggatttgcggtttattttagcctacaagtggatttcacgccacttacactcgtaccataaaccaccgtaacatcttttcggttttcactgtgtgagctgctgcctcttgtggtagtatagtgttcactgttcagtgtccagagagtgataaaaaaataattaaataaagcctgaaatgtgctactatcaggcacactgtaatactgttactagcccgaactggtttgcatcaaaaatatttttaacggttttcaacttcttccatgtcactatcgatgatgcttatttattgcagttttttttcactattttttccccatatatatgtcactgtaacaaaacaaaatgatcgattgattcatcatctcggattgtaatcagctgcatcccttggcgccgaagccgatcctctggttggcaacgtcgtacgcgacggcgaacgtcttctgctgcgtgttcccgaggatggcgatggacgagtcgtcggcgttgggcgcgaacgccaggcacgcctgcgacaccttggagacgtagagcacgccggtgaagtcgaggctgacggtggcgccgccggcgaacgccagctccaccgtgggtatctgcgccgtccggtggccggtgaagtcgtagcacgtgtcgaggatggacagcgcgggcgccttcttgtactgcgccatggagcgcgcgaacgccgcgcggagcggcgcgtacgcgcgcggcgggaggcgggtgatcaccgtgccggagtcgatcaccgtgccgccggccgccgcgaacgccgtcgccgggatcctgatcgcgcggccgccgaccttgatgccgacgaggtcgatgtagtagaacgacggcgtcgcgccgtcggccagcgccgtgaactgcgcgttcgccggcggggcgccgccgagggacaggtagcccctgccgctcgacgacgacggtaggcagtaggtgaatccggggccgtagctcggcgcgccctgcgacggcagcgacaccttctccctgccgaggccgaacagcccgtcgacctggccgaacagcccggcgttctggtcgccgcacccgaagacgaagcccgggagcgtgtccgacgccgagagcgtcagcgtgtcgcgcacgaggttgccgtcggtctgcgactggtcgccgtactggacctcgtaccggcacctgctgtccgacgagcagcccgacgcgtcgagctcctggcactccggcgcgccgcacgccacggcggcgtacgtcgacgacagcgacgggtcgaacagcgggtcctgctgctcgtagcagtcggcgcagggcttgcactgcacccacgacaggtcgctgccggtgtcgaagatcacggcgtactgcttcgccggcgtcccgagcccgacggacacgacgtagttgccggtgccgagggagatgcccctctgcgccggcagcgacacgccctgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgagaaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggcaataaactaaacgtatatattttttgacaacttaaaaaaaatggtatggttaaaaatggctttaatctgaaccgccccaaagctttttactgcactgaaaattttgtgtagtgatcagtcatcagcatgccaaaagtttactcgcatcaatcagcaacagattacctgatgtaattctgatcaatactactgtaaaacatattatgtttcccttagaatatcttataaattcgatatatgctgcatatgctatcacggtagctgagtttcagtggtactaaaatttcagaataatgcagatgctacttcagtcacaatacttgtttgcaggatacagactaaccatactccaaattggcctaacagatttcttattgggtttttcaattcctcagtttgatcaaatggacgagatttatataaagcaagttcgatcgagatggttaatggccgaccaggttacattatttttccgcagtaactgcttcagtttcagatacagttgcgaaaggagacaggctgcaaaactgacactacctttcgatgcagtgcaggccgagctcggcagcagcgagctgacgctgaagacgtgccagttggggtcgttcgtcctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtcaaagtcgtcctcctcgtcgtcggcggctcgtcgccgtcagccggccgcccgtgcgaaggaaaaagattaggttgttcgccacacacgctgctggctagctactagccggcgtccgatcaaggagcaccatggcattacacacacggcgacgactagcgatcgagctagtgacgaactgtcaactccaactcccaactcgatccaacttgattgcacgagcacgaacacgcgcactacggaggccctgtttagatttcaacttttttttcaaacttctaatttttttatcacatcgaactttcctacgtacgcaaattttcaacttttccatcacatcattcctatttttttaaacttctaattttagtgtggaactaaacacagactgagcgtaaattgccgtttagatcagtcgtacgtcaagtcggagccacttaaattaagtggatccccagcatcgctctaaatgtaaatgttcctatgatgtttagcaaagataaaggataagaaaaaagaattccggtcaaatttcgaattgtctggattcaccgtataagcacctgattgattagaatgcttgaattcttgcccattggaacctgaatgcgaaatgcttatattttaaaacagaaggattacgttgccatatatatatatatatatatatatatatatatatatataatttatttcaaatctagatcaatttggctacgatcgaaatgggcataggaaaatgacacctcttcccgttccgaaaggcaggcagagagaccgacctgtgtcacaaattgtgtaatatattgggtggtgaatgctgatatgttggaggttgctttcctgcctccaccacgccagaaagcaggaaatgcgtatgcatgcagtgctcgatttgctgatgcactgacaaagtgatcacaaacacagctggtgcgttgcaagcgtgtgtcattgctgcgtgagatgaaacgaaacgcgcattgctaattaagcgctgttcttgttgttcagtaatactccgtaattgtttagttggttcagtttagccctggttaggagttagttaaactatgtagttgtagtagtagtacataaacattgattcttgagaagttacagcgttgatacattgagaacatgacagaggatgagacattggcacacaaagggcaccaataagttacacacactcatatgattgatgcattccaatatgctccttagacagcatcagatttgattaattaactttgattagactcatgaacaacacatagcattttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcattgcatctggtcagtcagccgcgtgcagaaatgggcgaagaaactgtacaaagtgcatggctagctaacatttactgtcacttcatcgatcgcactgagtacgaaagacgagtagacgacgaccatcattagtgacgtccacgctaattaccctctcgagtcaaacacaggtgcaggacattagtgcggttaatatcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcataaacttgttacaaatcagcgagggttgtgtgtttacccgtgcgtgtaatctgtatagtgtggtagtgtgctgatgcttttacagatctgtgtgtttgggtgatgaattcgatgtgacatgggtgtgtgtggtttctgcaggcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcaggtataagattcagcacatttctcttgtgaattcctattacttgtgtgatatatgttgctgtccatgtgatgttttttttgtcagaactttagatgttctgtacatatgacaattggatgagttcgggcctgtatggttgagttggcatgctaccagtgtacatgatctttcttgactgttagcatgttctgaagaaatattcttgctactttaataagaggttgtcttgatgacatggtgctcattttgtagtacaataaatgaactgtatagattaggggtgtacagcagtttttggaatagtggtatcttgttctcttggttacatttactgaaaatcaacattgctgataaaccgtaattctgaactagtgatatgggtttctttggtagtaatcacttaattaaacaatagtattagttgtaacaatatatatttggtgtagtatacatcttactgttttccgttaacatgaaatgaattttgagatttactgctttcagcttgtctttctgttcttttgtgctgtagttgtgacttccttgtatgctacaataaatgaactgtatagattaggggtgtacagcagtttttggaatagtggtatcttgctctcttggttatattgactaaaaattaacaatgccgctaaactgtaattctgaactagtgatctgggtttcctcggtagtaatcacttaatgaagcaatagtattagttgtaacaatgcatatttgctgttgtatacatcttactgttttccattaatatgaaatgaattttgagatttagttgtatacatcttactgttttccattaacatgaaatgaattttgagatttactgcttttcagcttgtctctgttcttttgtgctgtagttatgacttccttgtatgctaacattgttacatagttatggtctgtctttgttgttgtattctgctaatcaatttatatactcccttcgttttgaaatgtttgacaccgttgacttttttagcacatgtttgaccgttcgtcttattcaaaaacttttgtgagatatgtaaaattatatgcctacacaaaaatatatttaacaatgaatcaatgataggaaaagaattaataattacttaattttttt

SEQ ID NO: 81142 - DNA, 7426 bp, Oryza sativa
acacaaaagagtcttcaaaaaaaagattaatagctgaaaaggaattggagagcaattcatttccccacagtatatctgaattgaatgtccaacagaattcaactcggccaattcagatatccaaaacgaagcctaaagcatcatgcatgtaggtgatcttaataagcgagtaactcgaatacatagagatcatgccaaatgtaaaaatataaaaaatcaagggagcatttgtaaaatttgttgcagattcatccactgctttgttctaacacctccaattggtctactttccaacttcaacatgaagctgtcaaagaacatggttttttgattccagagagccaaatcattccgtgtgcgcggcggtgcacctaggggaagtttcaagaattgcagtccaagattattgtgaatccaggagcactttctggcacaatcgatgaagcacgaaacttggtcaaggtatcaaattatgatcctacacatatcataatttgatcgatgaacacatatcatacatacttggatcataattgttacatttgaacgtagtgttgtgtgcgtacggaaagatgagtaaaatttggattggagtctaagtttgggaagattggagtgtggaattgtatggggatgttctttcccaggtatggtaggtttcctatatatgtgatcaggagtcctagttttagttggattcatggttaggagtcctagttgaggctagaagagatctatttttctggagataaaagttagggtttgattcgaggtttcaatcctagttcgtgagttgagagaggtgtacttcagatacactttgtaaacacatattgatgcaataaagttgatatactttcaggaagcggtttgattggagttcattgggcagtctaaccggtggcttagcgatggtctaactggcgtagagaggcggtccaaccggcggcaaggcggcggtcagaccagcggctatactgtggtcagaccagagatctgacagtcagaccgaggtacagtgcaattttgtcacgcttgagggtaatgttttaattgtgcaaaaagatttgtttttagtgtttctaccattcacctccctttggtagacttggttcttgtattcgatctcacaaaagttttgtagtactgcaatttatagcgaaagttgcattgagtgaaatcacaatatttaaaagcgcaccataggagcaggggcacatgcttattcattcagcaacttttttgttgggaactctcatctgaagtgcaagcaatctagaatgttcaacctgcatagcaacattgctgatccacagctccagccatatatatagctacaaaattttggattgatgttagggttgagaagcatcaggaaattagcgctcgcagcgcattgggggcttctacagttgggttattattgtgtagagaacctttcaaccaagcccgccagccagtgaaacggtgaagtgatccggatgagcctgttagaaaatgctgaaagatagttatccaccactgagtttcatgcgtctagagattgaataggtgaaatatgccatcctgatgaaaccaattactggccctcacttcttgccacactgtaaactctccttcacattcgtgaaacacacattgagaattttcgatagaaattagaagcatatgaaacttctagcagagaaagatagcagcactgctctagccatttgatacccaaattgggtctgagcagttaggactgagaatcaccgggaaattcatcctcacctcattttcatttccagtagggttgttgtctatgggtagtagatgttgtgcaatcatccgttagtgatgaatagaggatattagaaaccaataaatatttgttggtctcaagtagccacatctgattgtgagtagcctatgccctctttgtaaaaccttttgtgaagatactttgcattttttttttcactggtgaaagagcaaaggaagtctgggatctcctaggcttgaaacatataattgctgatgctgtggtagtggattgtgcgggttcagccatgtttgcacatttgctgctaatgatcagtggtggagcttgacccaaaatgcagagggggccaatattatgtgttactgaacacaaaacctctgttttttcgtgtttaatacgtaatacattagataattgttctttttattaaacaaaaaaaatattatgtgttacagagcacacaacctttgtttttcatgtttagtaatccctctgtctctaaatatttgacactgttgacttttttatacatatttgactattcgttttattcaaaaacttttatgaaatatataaaactatatatattcataaaagtatatttaacaatgaatcaaatgatagaaaaagaattgataattacttaattttttttgaataagacgaacggtcaaatatgtttaaaaaaaatcaacggcgtcaaatatttagggacggagggagtaatatattagtatatgatcgtcatggacaaaaatagttttgagcaaaagacacaacagtaataagaagatatttcccaatatatcggtggaagaacaaaagaaatatcttcataggatagaaaatatatcaacgcttggagttggacaaatattccattcaaaggctatgagaaaatgaaattgtctaaataataacagaaatattagttaattggcgttcgtgaaaaatattagttaacaccattaacacttggagaactgaaaaacacatgggcttgagaggtgtagagcagaaggcctcgggtctcactggtgtaggcttgcaggagcttatagcaacgtcagacagtactctcattttgccagtgtcatcttcaagttcactcgtaatcaaagagtatgtggtgttcctttctgtatttaaatcagcactgtcaggagccagattatgaaatgaaaatcagaacaatggacacaccatataaacagagaaagccattatatgtaaaccaatggccctcatttcttgtcacacagtgaactctccttcatcattcaggaaaacaaacattgagaattttcaatgggaatttgaagcacatgaaattcccagcagaagaagatagcagtgttgctctagccatttgcatttgatacacaaattgggtctgagcagagcagttaggactgagaatcatcaggaaatttatcctcacagaattttcatctccaggagggttgttgtctgtgggtaggagatgttctgtaaccatccgttagggatgcatcaaggatatatattagaaagaaatcagtggtggagccaccacctgggcaggtcgggctctgccgatgtcgtctccactacgaacagctgttgacacctattaaaattaatcgatcactgaaaaacgctattagttgtccagacttgatgacaatgctggctccgccactgaaagaagtttttgttggcctcaagccgccatctctgaactggctattccattccaccgagatcgaagtgatcttctgattgtgtttgtttgttgctaattgtcatagcgccttggcttatccctattgatgcgaggccatgtcttgaaagctaacaacatctgggatattatcttgtactcttcagtcttcaagatagcgatcacccactgatggaaggttaagcttgtggttgagccattaaaattatgcataaagtggtagcagccagattcaaaattacaattggtggagagattgcaaaaaaaaaaaagtaagagattttttaccatataacatgccgatgcggtaccaaatcgtcgccattgagtggataggatccaacggctgtcatcactgagtatcgtgaggcacccacttgttcttgtggtggcactgcattaggatgtggaggtggaagggtacttttgtactatcgcatggctgattcggtctcatccacttggattgtttcatttgacaccgcctctttcatctccatctccgcgtaccaactttgcagccccgatgtatagcgagcatggtgtctccgcggtggccgccgtcgcggagagaagagcgggcgcacaactgacggccccggacgagcacgtcgagaaccacaaagcatggctccgccaaggaggagctcatatttactgaaacactcaagtaggtcagagagtgagtagaaacatatctttatttttaggtgacatttatttttctaagttttgtggttgtatataagcatgtgaaccacaaaattataaactcatatttactgaagctacagcacacaggagggggcaatacaggtgccaaattttgaccttttttagtcatttcatattattagtcattttgacctttttctattcaattttttaaaaaattataacagcgttttcaacacaaaataaatatattaccaaaatatatttaatgaaataaaattggtattttggatgttgttctatttttctataaacttggtcaactaaattaaaattgactaagaaaaaatcaagacgacctataatataaaggtaaattttgcttcaggatactcaaaatttgtgttatttgtggacagacataaaaaacgtgtcattaatgaaagatatcctgaatatgataatttgctataggatatatttggctaaattggagagataaattcttaagaaagacgggaatgcccctagaaccacatgtttcaaacatgacgttagagtaaaaatttagatgtcatcaccccaagtacatcattagcgtacatcatattccatcttcactccagtctcaactcaaaagcttttgactctagggacattcttgtatttttttaaaaaattctctctccaattgagccgaaagtgtcctctagcaaattaccagtgttttagagtgtctttcagtcatgacatgtttttacaatgtctaacaacaaattatacaaattttgagtgtcatgtagcaaattttgcataatatgaagggtctgtttggcacaactctagctccttctccacctctcctagagttagagctcagccaaacagttttagctccatctaaaatgggagcggagctaggtgaggcacactcacaaaataaaataaggaggtggagctgagtttagattgctacacaactatactccagacccaacttctgaagctaaatttaggagttggtgcttcactgaacagacccgaaatggagggagcaacagacaatcacacttgtgaagtattcaagagatggaacacaagaaacaaaactttgaaatataagtatttaattcgaattatgtaaattacaagttagttcccaaattaatttctgaaatacattatgtttcctgatatttttcagatgcattaaattgacgatcttcttaactttggtcattattgcgtgccaagaatttgctgtatatattacaccgttgtcagtaacatgtccattgtttttttttccaagacttcacaaccacgaagagctcaaattcatcctcagtgtgagccaatgcagggattgggatgcgtcaggaatatggatgtgccatatctttgtcctatcatctcaggtatgcaaatgatagtgtgcttctgagaaatatcccagcttttgcaagaattgctcatttggttaattgctctgcggctgggatatatacccgtgcaggttcttagatgaacggagttccatagacctgttcgttccgagcactcgtccgcgtatgttcttaggtggatggagttcgggaggcctgcttgcttccgagcactcttgcgtgcaagtgctcagaaccggggaaaatggatgtgccatatctttgttcatcatctcagggatgcaaatgatggtgtgcttctgagaaatatcccagcatttgcaagaattactcatttggttcatcgctcagcggctgggctacaggaagcggattcacctgaccactgctctcaaccaaattgtagagctgtagtagagggtgtgctcttgatccaatcaaaagggattggagagcagttcatttcctcttcagattttaatggaaggaaaagacaatttgtttcagtaaattcagagatccaaaatgaagcttacatatatgagatcttaataagcaagtaagttaaatagatagaggttgttaaagggaatatgtgaatgtgacgtgagtattatagaattttctcatcacttgtacacgttatgcagtctttgagccaaagttaatacatactgatggaaaggttaagctggtgacgaccctttaaaattagagaaaattcactctatgccacgaagcttgcccgattcaacgatttgccattgaaacaaattaaatacacatagtaaaattgaaaaatggatttaaaaaaaatactctatgaaattaatatatagaaagttctataaaagaatagtgctgagctcacctgaaacatgcccttcaactgttgtatttgctaaaaaaacaatcctagtattacactatggaattaagcagggaccatctatataacgagtcatctttattcctcagtagtcgttcagtaatattgttggtgaaaatcatcatctgaacagaagcaatatagaatgtccagcctgcatagaagcattggtgcttcagtcataggtaccaaatattggatcttaggattgagaagtatcagtaaagccgtcatgacagtgttagggacttctacagttgagttattgtgtagatccaaattctagtctctacgcagattcgtgaactcatcctgaaagtcctcttgacatttatccaccacagcgatttatgcagctagacattgattaggcgaaatacgccatcgtgaagaaacaaattcctaatgtccatttacaatgtttttactacgattatatatatgtcagtctcacaaagatgggcatgcacgatggttaaatttagatggctgattaatctctaagatgtgttcctgttaatcttccaagctttggaataatcactaacggtttatgacttcaagctaaatctcagactctgaaatggttctgatagaaccttcagatgttataggggtcaagcattggctgttctgtagtagaagtgtgcaataattctgctatatattatcagatgtaaggaatgtatggaataaacagtatgaaatttgtttcaacaattcatgcatattacaaatggacaacagtttccgtggactaataatgaattctctagtaaaaaagttaatgttcaagttttacactatcaatcaaaatgcacacagtactcccattttgccagcctcgtcttcgaattcattgaaaatcaaagagctaggagttaagaaaaaagaaacgtcagggtttttcagtacttatcatgaaacaaacaaatgatacccgtgctttaatgtggaacatattgata

SEQ ID NO: 81143 - DNA, 3595 bp, Oryza sativa
atctttggtaatatatctgtcgatactcagtactgtacttcctatttgtgatgtattgtgaaagcgtgaatcttaggaagttgaggtatttttttgagtacctactcttctatctatacttgtttgcaaatagatgatgaatcatcaacttgtaattagttcttgtttaccatgcttaatgtagacttgttaagataatattgcatcatataataacgtgcattgagatttttcgttctgtgctaacttccatggtaattcgtaggccacacctaaaattttttccgtcctccgccactgactatatagctaatcagctatacctcaatgcatggctcatttgtagataaataataactagcacagctaattgcaagttatcgacgtctttcttcgatctgcatcgactcacatcacaccactgtacttctaaacactactccatcacccttttcgctaaatctggttcattaattcctcttctgggagaatcataagtccctggtgcctcctaatcctaagaaaataaatagtgtctatacgcatgactcacactagagatataatttcatcaaccaaaaaagtgcaacagaaggcaaggcatgtggatgggtgaaaattttcaagccatctcacacatttatgcacagtagaggtaggtgtgcttcaatgaaaatcctaggaggttcacaaattgaacccttaccccgtctgaatttcacatatttaaaaccatctatcagaaatttcaacatattgcacaagtctatttattatactcaatactattatatcataataatgcgaagcgacgtatataaatgcgtatggtttttgtacatcccgtggctaaatcggtgccctaaagtctttatcttttgtggccgatgaatgaaccgaaaaatcaaataattgatgtttaaaacaaaacaaacacatcctagcagagcaagtgaaagtgtgaagtccaaaatagactaattgagattgcatttgcatcacgtactcacatagtgataaaaaactattattcatggtaaacctaaaaatgatcatctaagcccaaggttttgttcagtagtaagctttctatatcttctaccatctcattttccgcatgcaagtttcctaaaaataaaaaacttttggtgcatatttaaaacaatatagttattttaagtcatattaatctaatttttaagttttttactaagtattaattaattatgcattaatccatagcttcgttttatgtgcgaggaagtttcccaacatgcacaaatgaacatagcctaattaaggctctgttcttatgtcccaactcccctaccatgttttccgcgcccacgctttttaaactgctaaacggtgcgttcttttgcaaaaagtttatatatgaaagttacttaaaaatcatattgatccatttttgaaaaaaaaaatagcaaataactaattaataacgtactaatggactgcttcgtttttcgtgtcggagggataggtttccaacccaggcaaacgatcagagcctaaagacttagcactgctttaagtgacatcttccaggcagaaaattaaatgatatttacgtcacatgtgaacattttgttgtcgttgatgaataattttgttgaaacttaaatgattgatcctttatttttctcactttgtgtctgatgactaggagatgactctgaacataatatatcaaaatcatatctggaagtagtgactctggtcgtacaaaaattgaaaaacactgtaatttaccgagtaccaagaataggagctctggtaactttctggccacgtcagagctccaaccgccgtggtagtgcaacttaggaaacaggcagataccccttgaactttcatcatctagacaatgtcttctcgtggagtgattctactgtgctgagtgagaaattgcaagaacctgatacctcctaaacctattagacagtactgcagcctatctaagagaacttttttttctcgaatacacaggagatctacatatcattccattaagagagtaaaaaaaaaggtggagagaaagatcccccacaaaggccttacaacaaataaaaccaaaataacacacacatccacgccaaccttcctacggagctagcactataggagacattctactatgtgacttatgtgacttgatatgtaagaaaactgacttggtatgtgactataggagacattctcaaattactatgtcctatatatgcgtctatctatttaaataaaaaaactagtaaatgattttagagaaattatgagcactaggagcagatcatatagtgtaatgtaggcattatatataggttgaaatcgaaaccgtacatgtaaatcatttttttcattacatggatgacacacacactagcatattcaagtgtggctcatgtgtgttagttcttcaatagaacaggtacatacatattatatgtgcgggttcttaattaacaaggttgtcacgtataattcagtttagtgaccgttagtgagtcccgtcatatctgtctacttgcgagatgaaatggcactgaaactgtgaaattcaagtcacatataatgggactcactataggtcactaaccgaacttcattgtgaaattcaattgctatccaaaattataagaaataggtagcaaaacatagaacaataaaatcgccctttcgtagatcaaatcattcatgatatctgcacccacatttacatggtcagcagctagctagttgtggatcaagagagcagcctagcattaatgaaccgggagctactttgcatttgagagaggcagcttgcaatgctgaaaaccgggaaacatttttttcatcaccctgacaacaatctgaactgaacgtttcaaatcagcaacctcttcatattctttctggctagggctgtgtttaattagttcagcgcaaagtttagattttggttgaaattgaagatgatgtgactgaaaagttatgtgtgtatgacaggttgatgtgatagaaaaaaaaaactgaagtttagaaacacaacctagaaagaagaagcaccaccgaccgtttcgataagatcatattcaatcgagtatgcagtataatcatggaacagtaccgaaaggtttgtttgttgagaaatttttagtatttaggaaagtacctagaggtaccaagattttacactagaaattttacattggaacaatctaaggttgttttgctaaagataccaaattttacactagaaaatgtggtaccacccggtaccttctaaaggatggtaaaattacacgtgcttgtttctttaaaatggaatgatatctccattagcaacttgggcaaaaaataaacagttagtattgctggaaattctatatgcaattgtggcaaacgagattgtcgcgagggaaacccacctcagaaataaacagtctatgagatggatgagcaagaatggactgttattattggaagttgaattttaaccaagcaatttcattcacggtacaagaactcgtcaggcgggtgtgttatagaaatctcgtaatatgaaaaatgagcataaagtgaatcgtctctg

SEQ ID NO: 81144 - DNA, 9629 bp, Oryza sativa
acggtggacgagcagaaggcggccggggtggggatcctgctgcagatatcgatgctggtggtctccttcgtgctcggccacgtcctccgccgccgcaaggtctactacatccccgaggccagcgcctccctcctcatcggtatgtgttcccacccagttacagcattttgggcttgtggaaactgaagaatgccgatcgtcgctgagggtcctatcgattcatgtgtctgacttcgcgatcgttgtgtatttgcgacgccgtgcgatgctttgagctagcgcatttgatgcgggggtgatcgtgtttggtgttgtttactgacgccgaatgaactgtttattcacacgatgtttagtggcgagcagtaacggtgtgagtgtgtgattaggaggaacggcttcgactgtgcgtttatgcacaaatcagacgaacaaattttgcattcacgacgcgcgctgtagtctagttcgagctgtgcttttccaaaatttactgtcgatggttgaggattggttgtaacaggtgagggctttggaggataaaatgaacctttaaaaagttggcatgtagcgcaaacagatgtcttttccttcagataagcgtatttccgttacatttcagtagcttagcttttactgatttctgattatctaagataagtgatgtgacatttgggtttattctagctacgttttatttggatcatccggtggattatcatatactatttgccttggaaataaaacaccctagctaagatggatcttaccattttatttaatagtttgtagagcctagaggtacattgaaaatgttagaatcgtatgacaccatattattacgaaattatttaatagcttttcttgtcagggatgattgttggcggccttgctaagatatcaaacactcaaagaagtattaggtgataatatttcttattactcactgtatacaatttttccctgcaaaatatgacatcgctgttaagtctgaacattttgtggtgttcatttgctttattaattcaggagatggttcaattttcgggaggacttcttccttcttttcttacttcctccaattatattatatccttttttgtatcttgattttgttttttaattacttgtacggaaatttaccatgttttacttgactgaatcttactcagtctggattcagcttagcaccagtaagtgtggaattcttggatcctcttagttagttaaattctactcttcgttggttaaattctatcattctcagctaattatatcatattttttcctgatagaaaccattcttttcaaattttggtgccattataacatttgcaatcttgggaaccttcattgcttctattgtcactggtcttttagtgtaagagtatcttctatattgcctccattcctattcgctgatatttatttcatctataaaaatgtaatttatatttttccatttgtcacagatacgttggtgggttaatatacattgtctataagttgcctctggttgagtgcatgatgtttggtgctctggtgtcagcaactgatcctgttactgtactgtccatatttcaggttccttccatatccctatacagactatatttacaaattttgagataaaaggatcacataatgtccatcaaatcgcaggaacttggcactgatgtgaacctctatgcgctggtttttggagaatcagttctcaatgatgctgtatgcataaccctattattatttaatactagctgtttttttttatttctactgaaatgtgcatatttcttcgtgtctaactacggtttggaaattaaggtggctatatccttgtataggtgagaatgtattgcctgagctccttctgcctatatggctccttctcagaatcctgtcattaacaccttgaacttttcaggagtatggcttcactgagaacaagttcttctggacagaactattttctagctatccttaagtttcttgagaattttgttggttcaatgtcatcaggtactgtaccttaaatatttacaaatgcctttagcagaagaaatttcgagtcgcctatgtattttgctttttccattggatttcttgacttcgcttgcacttatgattatatatgagtatctatttgtactttaacatttgatatttcaattccatttttttatgtgcaggtgttggggttggattcatttctgccctcatatcctttattttgacattttctatcagtagagacctaatgtatattttttatttacacaaagtaaaactgataaacttgttacatgtatgtgatggtatcacctagttttttataacatatattaaattagtttaatatctgtaaagaaatgtatacctgtttgcaccctcctgaaaatttatttttgttccaaaacactgtaggggaagcccccacagttaaagatttattaaattgaaaaggaggaaacaattacaaaagttcaagcaaagagttaaatgctactctctcagaggggtttagtctatgtaatcatcctgaattcccactttttgctatcaaaacttagaatactcctgctggatcctcttagaaaccaatatgttattgttgcatgccttgagcattacctttccagggttgacaagaaaattcaatatgtttaacgtgtaatcatctttttggtctatttacaaacgttttccatttactctggagaacaaaaaaggcaacccccaccatgcaacaatatttaggctatgtacatggccagatcaacaacttcattgccaacgacaataagtcgaaaaagaaaattttaaaaaattcttgcaaaaacaaaacaaatgcattttttgaacttcatttttgcttatattatgttatccccgttgagactcaattgtcagtccttaattctatcaaacctcttcaagtatgcagctctaggtgttgagaagtaagtacattccgatttgcccaaactagtaccccacacataaactgctaatttattttttttttcacttccagccttcataatctggagagttgcttgtttgtccttttcccttacttctcgtaagcctatctttgaaatttgttccatttcatgttctctttaaatatctgctgtaaataattgccagttgtttgtaggtacatgctagctgaaggctttggtttgtctggtattgtctctattctgtttactggaattgtaagttagcctgtgacaatattttctctagattttattcttattacatattatagataagcaactttgcaggaagatattataaacatgcttacaagaagtgaatttttatttcaggttatgaagagatacaccttctataacttatcagaagattctcagcgttttacagctcgttttttccatctactttcatcactagcagaggctttcgtgtaagcaagaccttcaagtgcaataatttaacaagtccaaatactgaaactgtaatgcatttacacaggttcatatacatgggatttgatattgcgatggagcgtcaaagctggtcacatattggattcatttttttctcagttgtatccttcgcattgattacacaccaactcttacccatgcttgttacgaatacaataatttcttcttgtttccttaatttttttcccttttgcttatgcatccagatctttatattacttgcaaggtattttcttctccaacggaactgtctatcttttggtctgatgttggactagttgctgagtttttggagatgctttctgtgtatttatacaagcttaagccccatagctatataattgtgccgattttctgatattatcttattttaaagggccgcaaatgtcttctcttgtgcatatatattaaatttggcacgaccggtgcactgccaaatacctaggcagtatcagctggcactctggtatagtggtatgtaattatgtatgcccaaaaatgtcataaaataagtttcatgtttgtactgctaatattgttggttttttctttttcaggtcttaggggggcaatggcttttgcccttgcacttcagtctattcatgatcttcctgaaggacatggcgagacaattttcaccgctaccacatctattgttgttctaactgtaggttaccggttgtaattcttgtgatgttacataatagccacgactatttttatgcaaaggattttgtatgtatcagttcatgctattctatgaatcattctaaatgtctttttatgcaaacattgcaggtgcttctaattggaggctcaactggaacaatgcttgaatccctgcaagtagttggggatagtaatcgctatcgccatccatatgaggcaagtacttacaccgcgtatcataagtacatgcaaaaaacattatatttctctttgtttgccattaggttagttaaacaacgcaatcttatttatttgctggacattctcagcctaaatatcaaatgacattgcagttctatggaggatgcaattccattgcattccatgcactctccccatagggcttatttggatagataggtattacacacaatctttggatggtcacgattttttttctgttttcttgttcataatgaattagatctattcctttttttaaaaaaaaaactaattggttctctcttgaggtgcaacctgcttgttctacgtacaaaaaaccagataatagttatgcttaaatgatcatcatgggttattatttattcaataagagcacttactaacggaccgttggtgttgctgaatgccatatgcaccctaactatgtagctactatccgtccttgtttatctttcttacagctcatggattaacaccatagcattccggtggtttgccagttattgatgctgtacttacaatatgcagcataactttgatgggaacaatgctggctaccctgggcaacgttacggggaagaaacatcaacatcaagcaatttcacaatgaaactcaaagagctccagagaaggtacagcagttcacatttgatattgaagttgtatctactcattgctcttctttagtttgatttctaaaatgatgaacttttcattaaaaaatttcattgtgttaaagtaccaaccagtagtagcctttagttgcagagtggtacttttctataatttattatgtagtattgctgaggagcaggtgatctcctaatcgcttaaatatattttcctgccattacagcacctcttctttcgctttactggacaagcattaccttactcccatttttacctctcaaaacgaggacgataacagtgacggcgatgaggatattatcagtaagaccaaacctgcattccatctttctcttaactttatagtcaagcaatatcaaagatgctttccctcatcagaggcaaagcagtattggcttacttttttctccatccttttccgttcagcatttattcctggtaaataactatatgttctggtaaaacaagcagatgaatcattgaggaatgaggatatgtagaggtcctgcagatttggaggatcatgaactcatgattattgaatgcaaacatgacgcacgaaaatttttcaagagctgcgcattccaatcaagagcaaatgtttgagccatcagccatgtatacgtcacacactaggatagttcgacatgtatgtaagtaaagaggatcataggtgggaatgtaagattcgctaggttatctgctttctttaacgatgaagtttgatgaaggcacttttgctctaatcctatttttgatctgttgccatgcatcttcatggagttcagtgatgaaacttgacagtattgcttttcgtctagttatgtagaatcagcctatgagaatactaggatgtagcttcaaggcatgttttggttgattttctggggaattttaccctaattaattcctgcaaaaatttctattccaaacgtgcacttggcttccggtcacaataaccccacttatgtttttttccccctaatatatcttaaccaagagttcctgtcacgtcaaaatattttacaatatagtctaaaataaattaaaaatatttttttctataaaatgtgttacacatccttttttctttttgccttaatttgatgattttatatgttttcatatttgatttgattgtttttaatattaagaaatctataagaagtacaaatgtttcttttatatggcctagcaccgaatattcccaaatttccaatttccatcagcttccatagcggattggaataagttcgtttgttgttcctcatctttacatcgagtttatttggcatccctaaattgcaatactatactcttcactcttttatctttgcaagaccgttcaagtcaagttctaagataatatagatgtctgttttggctgatgtggcctcacatgtaagttgactcctcacctcttccctctcttccccatctctcttcctctcccctctcttccctcgcagcttgccggcggagagagggctggcagccgacgagcccatctgcatgaggtaccagtggaccacctcccacgaaccaccagtgcccgctcttctcctccgccatcacctgcatgtccagcatgcttaggtcgttcagcgtcgccacggtgtcgatcttgccatcttgggcaggcatgacatgctttgtgagtgcgccatggcggtggaggcctcccatcaccgccctgctcgtgtgccccatccttcatggtcgagggcttgccacgccgaggtaccaatcttcgtcgccgatagaggcatggggtttgttcagattgatgtcatttcaaaccatacaatttttttttgatagagttgttagatatgtgcatccatttagtttcttgtcaaactttggtaaatacacaagaaaacctacaaaaaatttgacaatattgccaaattaccaaaaattgataaggtttattttggctacaatctaaacaaccccatcgagccaaaggcaccggggcacgttgcgtggtgggtgatcgtccagaacttgagcggtcactcctccaacctcatgatgtagaacctgcaaagtagaggagagaggagatcaaaggaagtaggaatatttcgccaaatcaagtactagaattagagatgcagagggcatatactactcccttgacgttgttgatttttaatcaacgttgatcattcgtcttattcaatatttttaagaaaatataaaaatatttaagtcatccttaaagaatattcaatgataaatcaactcacaataaaataagtaataattacattttctttaataagacgaatggtcaaatgtatctcaaaaggtcaatggtatcatacataacctatgaaaaccttagaatcattttttttctgactacgatgcctcctgctgccttatgatctggtttgaatggttttgcaaaaatcatttattgtactgcagtttaggaatgccaactgaaaatcgacgtaaagctgagggacagcaagtggacttattcctagcggatcacagattattgaaggcccgtgacttccccgagaaaaggcccagcagcaacttagtcaagggccactacggcctcgccggcttctaggttcgtgtagatgcttctagaaccacaggatcccttaaatactctccctcctcttccatctcgcgtcctcttggaaacccctccaaaccctagccgcctctcgtttcttctcgtcctctccacgcccccgagatctcaggagcacaggaggaggaagccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcataaacttgttacaaatcagcgagggttgtgtgtttacccgtgcgtgtaatctgtatagtgtggtagtgtgctgatgcttttacagatctgtgtgtttgggtgatgaattcgatgtgacatgggtgtgtgtggtttctgcaggcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttttactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcggggataagattcagcacatttctcttgtgaattcctattacttgtgtgatatatgttgctgtccatgtgatgttttttttgtcagaactttagatgttctgtacatatgacaattggatgagttcgggcctgtatggttgagttggcatgctaccagtgtacatgatctttcttgactgttagcatgttctgaagaaatattcttgctactttaataagaggttgtcttgatgacatggtgctcattttgtagtacaataaatgaactgtatagattaggggtgtacagcagtttttggaatagtggtatcttgttctcttggttacatttactgaaaatcaacattgctgataaaccgtaattctgaactagtgatatgggtttctttggtagtaatcacttaattaaacaatagtattagttgtaacaatatatatttggtgtagtatacatcttactgttttccgttaacatgaaatgaattttgagatttactgctttcagcttgtctttctgttcttttgtgctgtagttgtgacttccttgtatgctacaataaatgaactgtatagattaggggtgtacagcagtttttggaatagtggtatcttgctctcttggttatattgactaaaaattaacaatgccgctaaactgtaattctgaactagtgatctgggtttcctcggtagtaatcacttaatgaagcaatagtattagttgtaacaatgcatatttgctgttgtatacatcttactgttttccattaatatgaaatgaattttgagatttagttgtatacatcttactgttttccattaacatgaaatgaattttgagatttactgcttttcagcttgtctctgttcttttgtgctgtagttatg

SEQ ID NO: 81145 - DNA, 7423 bp, Oryza sativa
gcaggggagatgggccgagagaaattcggcccatcgaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttaagagataattttcccgctaggcgccacgacggaacgggcgctacagaccaacccccctaacaagaatctcgaccccgagattcagcacctaagggagcagctccgggaactcggcgcggagaagatcttctcgctcccaggttgttttcactggcacgaaatgagccaatttcgtgagtcgatccacgattacccaaatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccggtacacagatacgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtggtaatgaattccaagatcgtaatccttgattagttccaaccatcttctctgcctcatatttaactccgtctgtgtgaagatgtacttaagacttttgtgatcggtgtatacttcacatctgttcccgattaaatagtgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaattcttcaatgaatcttcgataatatccaactaagccaaggaagctgcgaatctctgacacattcttgggcgggttccaagcaagtacagcttcaaccttgctgggatctacctcgacaccgttggaggagatcacgtgtccaaggaatgctactcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccaggtattccataaagattttgttcattaagttcatgaagaacgctggagcattggtgagtccgaaggacatttctgtgaactcatatagaccataacgcgttgagaaagcggtcttcgggatatcttcagatctgattttcaattggtggtaacctgatctcaagtcaatttttgagaaaactcttgctcctttaagttgatcgaacaaatcgtcaatccgtggcaacgggtacttgttctttatagttacttcatttagggctctatagtcgattaccattctctcagagccatcctttttcttaaccagaagcactggggctccccaaggggatgagctaggtcgcacataacctttactctccaattcttcgatttgtcttttaacttctactaactcattagctgccattcggtagggtctttttgcaattggtgcggtgcctggtgccagttctatggcgaactcaatctcccggtctggtggcatactcgttaattcttctggaaatacgtcgggatattcacagactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgctttgccaaccaatccatccctaggatgatgtccaagctttgcgagtctaggactatcggtttggctaggaagtcaacttcctcaattctaaggttaacttccaggcatatttgagttgcccttatatccctcccaggggaatgtactatcattggtacacgtaaattttgggttttccaaccatttcttttcacaaaagcttgtgatatgaaagagtgggaagctcctgaatcaaacagaactattgcgggtatggagttgacagagaacatacccatcacaacgtctggagcatcctgagcggtctcggcttgaatgtgattcacccggcctcgaccaaggttgttggacacacgagaaccttgtccacttgcctgagagctaggacgagactgagctgccgctggagtaggagttctggcagtgctgccattagcatgccctgagctggtgttggtaggattctgagggcactgtctggcatagtggcccatctggttgcaccggaaacactgaactgctgacggtccctgtggtgacttgaaagaggtaacactgttgggcgcagtattgccactaggggcacgctgctgtggctgaggtgccggacagttcatctgaggacgaggggcgtagcctggctggcggttagcctgagtgaccgactggtggtattgcatgggttgaccgtagtgagggcgaggtgcgcctcgggaagaatttccctgatggttagagttgcgtttcttgtattcttcggtagcctcttttctggcatcttcaagtagaagcgccttgttgatcatatgctgaaaagtggggaagtcatgagcaagcaactggagtctcattccaactgcgattcctttcacgaatttcctgatcttcttcttatctgtgtccacttcctcaggggcgtatcgagccaagttgttgaacatacttaggtactcattgacactgctgttgccttgcttaagtctgttgaattccactttcttcatgtcaatggtgctttcaggcacatgagctgcacggaaagacgtagcaaactcatcccaagcaatgttagtgggttcagggtgtgcattgcagtaattttcccaccaatctgcagcaggtcctcttagctggtgagaggcatagagcgtcttctcaaccggagtacactgcaccaagttgagttttctatccacatctttcagccaatcgtcagcctcgacgggctcgacggtctgagagaactctggcggacgagacctcagaaagtctgtcagcttggatctattgttgctcatgtgacggtggccatttccatgcgcagtatgctgaaaaccggctacggctgcggctaatccttgcaagatttgtgtctaaactgccattaagtgctgcatgttgttttccacatgaggtggggaagggaggcgttcttctccagaattgtgactggcagtgcggtgagagcggtgagactgttccatctctacatcacaggaagccgtgcgatgcgagcggttgctgcggcggggttgctcaacttctgcattgcgggaagcagtacggtgcgaacggttgctgtggtgagactgctcatgatttgcttctggctcggctctaccatcttcaaaaccaaagcgggctggtgcacgagctgcacggcgggggcggctagccatctaaactcccagaagagggcggggtaagaatcaaataagcacttaggagggcaaggagcaacgtaaatagcaactcagatagcacacactaggcataaactggatttttcaaatcataaaaacacctgatacaacgggtgtggacaagtcacagagctacgccgagcttgactgtgcgcacaccacctaggagaaccagactaccgaacaacacccacaacaaacacacgcacgcactaccttgccacgactccgaaagagttggcggcggaacaaaagggcctaacacacgggcggctgctgtagactgcctcctctactcctcgtcggcctggctgcctcctgtagtcggctcctcagtcgaagaaatgtcgatcggctgacgcgaagggaccggcggaacctgtcgagggccgacagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctgggggagcgcgggccactgggagtgcgggcagagccgcgggagctgtgggaggacaggtggctgccgtgacagaggcggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggtagctgccggaaggcgaagcccccgagatggtggctgtagtcgtgggccaggtgacgaagcgcagtccaggagaggtcctggtacgcgatctggagagtgggcctggccacggtgaagtggtgtgggcgaaggccagctccgtgtatacctccacgagggtaaaggtacacagagagctcacagtgagggggaacacggtccacggagtaccccgtgtactcgggacacgagaagccaaggaaacgagcgaggtcacgaagctgagcgacgtggtgaccctcaccaaaaccgtgggagctgaagctggcgttcactgccatctacaattttgaaggagggagaaaagatcagtaaccattttagaaacaaactattgaaaataaggaaaccaaagaagccttagcttttcgcaagtagttttgaacttagtatccttagggtcgtcctaaacgtcgggtttcgccctagggccaagcctgtgctctgataccatttgtaacgtcccgcctcccccaggccgggcccacttacatctgatagctttcataggtcatagactgccctcacagaccaacacatgtcttttctgcacactttgtcctcactcgtgtgcacccgggaagaatttcccaatcggtcacccatcccaaattgctccaggccaagcacgcttaaccctggagttctttggagattggcttccgaaaaagaagttgcaacttgttgatatgagtattctattaatcctattaagccctaggccgggatgttacaccctcacccccttaagagagatcgacgcccccgtcgatcaacctaggccaggaacgtcatctcttggccacgtccatgtgtccagtgccagcgcatgtgccatgctgtgtaaccactcccggtctacatcagccatgcgcaccatgcctgcgcaactacgacacacgcgcccgtgaaaccgcgagagtcggctctgataccatctcttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcattacaaggcatttctaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcggaaaaccgtacacccggtacgttccccggtccgcggttttggaaattcatttaattcgcaagcaccgacccaggtgtcgggttttccaagtcttttgtaaaatccaagttttacccaagttgcttttcagattttaagtttgaaggcgtccgccgatactcgcactaggtgcgcgaatatcgagacgcaactagatggttgcaaggggacatggtatcacaattaacaaaggaaggatcaaaaaccaccaaattaggtaggtctaccaatctgccttgcagacgggacaacagattaagtgtgatcctatcaagggctgcagga

SEQ ID NO: 81146 - DNA, 4004 bp, Oryza sativa
accggcgtgtatcgcgcggtcagaccggcgcagcccgcggtctgactggccgacgttgtgtcagtttcggtttcgggttgtttgtttggatatccgtgattgtttcatgaatatgacttctagatggatactatacgtatgtaatattgttgtttgctactaatgagtcaagttggggatagtttggtctcggaatatggtttctttgtttgttccatgtgtaggtgacatgagatgccgggagagtatttgcggtgatggaccgagagtcggcttggggataagacgatgtccgtggtggtcagagatcatgcaggatactaaggctagagttcaatgcacatggttggtgaagtttccatatggcatacgatggaggtattgtgtgcgtatgggatgcggagttgaatttgaaaggagtccaaatttggtagaattggttatgtaaagtttgtttcttgtacgagaaggtttcctatggggattaggacttctagtatgagtttggttcgtggctttaggttgcctacctcgggtataaatagagagggagcgtgaggcttctcggtattgcttttcagagcaattgagttgatagtttacttatggtttcgagtttactcgagatttttgtaaggagtgctgttggtgcactttgtaaacacagagataatcaataaagtcatcatcaactttaagagttcttcgatttgtattttctcgagtgcggcggtctaaccagcaactcactggcggtcagatcggcggcaaggcggcggtcggtagcacgcaggcggtcagaccagcagcagcgacaggcagcggcaggcgatttcggcggttcgaccaatcgatctacatcggtcagaccgacgttcttctggcggttagaccggtgcatacacttcggtcagaccgcgattagtcgaatttgagggtaacttttatttccgctaaaagttttggtttttgggtataccaaccattcactccccccctctggttggcttagtttttgtattcgatcctacagatggaagtggtccttcaggtcccttccaaatgtattctaatgaccgcgctaggtttatggctttggagagtagccttgctgttgcgagaagtcaatattgtccatctcgcacgggccttccactagtacagaatcgatttttccgtgcggtcaaaattgatctttccgtgcggaggtagcgcctgtctacagctaggtgtctgtgaaaatcaactttatcgcatgcaggcggcccaaccgtacggggtaatctattatcccatgcggtcgagtcaagtggactgcacgagataatctaccaaaaaacatctttcatgagtcgaattgtactacatttaacatatgaaaaaaagatacaacttaaacgaatattatattactattcatggtctagtggttccaataacattaaattaataacttaaaaattatttagaattactagatttgtaaacctaatatattcgtcgaattccattgaaaaagtttgaaataaacggagggaactaaacaaaaatttaattaaagatttacggagaatttaaacatgcatataatatttttaatcattaataaaaaattttccatttccaaaaatgaaaattttcttagcttttatctgatgacaaattaaattaatggaggcaaacctaaaaaggaatcggactactaaatactttgaaaatcatgtgatacaaataatatatattatctcaaaagttataaaaaaacataaaaagtgcctacactattccatttataaaagtgcaaatttcttcgcattgcacccgtaaaaactgacaaaaatagaagcaaatgaaagacgagaacaagcattacaccttttatatgaatcaaaatcaaagatttaaggtcgaaaacctcccctcttaatgtttgtaagtctaggagagagaaaacgtcggaataaatagggcatggttgggctggggtgtatatagaccaacatcatcacgtgcggttggattaaacagcccgcacgggaagatgcattatcctgtgcgggcatcttaacccaaccgcgctggataatcgcattatctcgtgcggttcggttaagacgcccacacgggataatgcatcttaccgtgcgggtgctggccctgcgtcggtcctccggtttccaggaaaatgttttgtgtagtagtgttcttttcttttattggacagtgatgggacaagaggccaacccaaaatataaggaaacacctctgatgttggcatggcattgttaggaaatcgcatggtctagaaactcatgcaaatggacacttcatcctcgcaaaattctcgtagacatggtgaaccgaaagtatctgttgctagtgttaccaatgttacactggtttaaaattaccgataaatatgctaatatctcgctctttcagaagtaccagacattctcctaccaatataataattaacatacacttcagagagtgcacagataataggatggactcaattcaggaggttgtatttctgcaaacagatattaagctccttttcaatatattgaaaaacacaagcttcagatgcatcaactgtaacatgagtatgtgtagctagcctctccagtgcccaagaaccagttcaatgattgtaagctgccgctgcaaaatgtgacagaccaaatgcatcgtacgtatcatcgttcatcatccctagacactgcttctctagagaaatcgatttcctagattcgtcccaagcctaatttggctgctgttttctttgagtcatagtggccaatcgccagtaagaatatataggcagcattgcatgcatgaggagcttatcacttgaattatatatttcgtatatacgtgaaccgagaatggaacctacaagctcccttctgtatcttctgacgctagctagggtcttcagtttataaatagaacaattttaccatcttacactcgggcctgtttagttggtgaaatgaaaatttttgggtgtcacttcgaacgtttgaccggatgtcgaaagtggttttcggacacaaatgaaaaaactaatttcataactcgcctggaaaccgcgacacgaatcttttgagcctaattacactgctggagaatcgctttttagtcctggttgggaacccccctatagtcctggtttcctaaccgggactacgaatccgggactaaaaatatctacttttagtcccggttgaaataaccggggctaaaaatagatctttagtcccggttcgtaataccaatcgggactaaagatactaaatctttagtcccagttggtattaccaactggtacaaaagtttttttcttttttttcttttcttgcgccaaatatcacagatttgtgttcacacatcactcatcacatatcgttcacacatctcaacatcccaaatcatccacagcaacaacccaatatctcaaacatcccaaatcatccaaaacaacaaatcacagatcaaatcaacaaacaattattcacattattcacacaacgaaaagaaaaaaaaagaaaaaaccagaaaaaaaaaatccatggaccctgccgccgcgcggccttccgcgccgggctgccgtcgctccggcacgggcccggccgccatcgctccgcacgggcccggtcgctgccgcccctccccggcacaggcccgaccgccgccacccccgcccggcatggccccgccgccgctgcccctcctcggcaccggtccggccgccgccgcccccgcccagcacgggcccggccgctgcctcggctgcttctcccgcagatctgaggaagagaagagaggaaaactcgatcagatgtggaagaggaaggggagaggaagagatgagagtgaaagaggaaggtgaggaagagataaggaagagataagggtgacgactgagggctctgcgcgtggagagaatgatggaagagagagatacgtgggaaacagatttgtagtcccggttggta

SEQ ID NO: 81147 - DNA, 34639 bp, Oryza sativa
gtttccccccccccccccaagcggcggagccctgccgccatgggaactcctcgccgtcgcgtcgagctctatgtccggcgacatctcgccgtccacggtccgtcctctgccgccttctccctcaacctcggtcgccgtcgcgcggccaaccccggagcatcgccgccttcttggtcgccgcggccaagaacgccaccgccgcgaccaagggcgccaccgcacgcctccgttcccttccccggcacgcccgccgtgacgcgatgccgcctcggcatcgcgttcgtcgccgtgcgccgctgctcgtccatgcgccgccatcggccttcccatcctcaactcgccgccgacgccattacctcccgtcggtgagctccccacctccctttttccgctgtcccagcactcgcgtagctcgcgtcgcgcgtgctctgtttccgctgccgtgcgcaatcgagagccgccgttggcctccctctcggcgactcctctagccaccgccgttcttgagttccctctctacctccccaagccgctgtttcagccgccggcctcccctctcgccctcgcgtcgcgtcgcccgatccgccgctgccgcgctcggccacttccgctgtgcctcccctgccgtcggcctccctcctctccttgattcccggcgccgccaccttcctcgggcccccctcgacctccccaacccctccccctggccgccgaccttcctcctcgctcccgcgccgtgccgcccctcccgccgccgcaaggcgccgccgcgagccacagcccggcgaccatcgggtcccgcgtcaccgcgtgtgcgccgcaaccccataccgcgtccactgagcccgagcgcgcgagccgcatcccttcccatcgcgcatccacgtcggcatcccggcgagcttcgccgccgccgccggccgtcgtcacgcgtcgtctccccaatccgagccgtggaatcggttcgccttgacctcctctagccaccggtgttcgtcactcgcttcggctcgccgaagttcgccggattccgccgcgcgccgtgagccgtccgatgccattcccgcccctcccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaagtccgcaattgctccctccaattgctcctctctctctctctcaccttcttattggccccactcgtcaatgagtcaaagataatcttgagaatgtctttccaatattccacaaatatttctctcttctataaattcagtaaatcattttatcttattccgtgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcggtccaatcgtccgattgaccccgttctacttccagtatttccgtaaaatcgagatctatttaatggcactattatttagtctaaatagggtctttttcttggtctcttgtttaggtttttgtctgtttgcgcatagttgcggttaccggattttcgtcgatcgtggatatcttgaagattcatgaagcttcgtgaagaccctgagcaaggcaagccacccttgaacatattgagcctatatttgaacttaattatattgcttgcaaaatattatgcattgataggattacacttaatttgtttgccccgtctgaaaggcagaccggtgggtctacccaacttgttgcatctgatccttccattgttaattgttatatcatgttcccttgtaaccatctagttgcgcctcgatattcgtgcactctgtgcgagtatcgacggttgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgatcacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcccttaggtcaccagacgtggccgttctacacgggctgggtgattcgggttagtaatgtcgtgtgggtaaagtgtaccccctctgcagaggttaacaaactgttcgaatagccgtgcccacggtcatgggcggatgtgaggtgattccttagcatagtttttgttttaccctgttttatgaaaaggtgttaaggtttgggaaacctaatgcttgggaagcatttagctgtccgggggacagtgggaccgggtgtccctggaagtgattggtcgtttggggaccactattatcgggaagtttggaaaattggtttggtttgggaaaaaccagatttgaagccaactctgggagttgtgcaaatcttgataaataaatttgttacttctcacctcccgaccaagctgagacttgtctcgctctggttgtggaaagcacacacttagattgttgaaaacttgaaaacaaaattgtttgcaaataacagccttcccttgaagcctgcattaaccacctaagtttccctggcttgctgagtacgaaagtactcacccttgctctatataaatatatatatatagttcctccgtcttgaagaaaagatgaagtgaagcgaagattagggtttcgtcctggttcccagccgtcgcctgtggtgttgggtgttagttcgttggttctgctactgctgctgctgctgttggtgtttcctcgtccgcgtcgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagccttccagtggttcgtaggcgccgctccaagccccgccaccgctcgccatggccttgccgccgtcggcgcccgctcccggaggccgcctctcgtcgccggacctccacggcgcctccccaccccatccgaacccagaaacgaaacccttgagccccggagatgctcccatccctttgaatcgaaccctcgtcgtctcgtcgtcgtttccccctttgctcgccgccggttgccgccaccgcgattcgccgtcgccggctaccctccggcaaatctgagccgttggctcactctctcttgtcctccttgtcgttccaatgtgctccccgttgccctcgccgtcgcatggtgtcccggtgaaactgccgccgtccgccgtccatctcggcctccccttcttcctcctcccgccggcccgcgtggctgccacgtaggcgccacgtcggcgccacctcggctttgaccgaaccgagccagtcagccgcctcctccctcccccaccctcgcgcgcgcggtccacagtgcgccaaccggctgcgcgtgggcccgccgcatctctggtccatccggtgcacgcgcgtgaaccgcgctcacccgaaaccctagtgccaccctcatgcgccgctcccacggtgagccgcgccactgacaagcgggccccactcgggaccccgcaaggtggactcagcccaccggccctctctctcccccactctccccgcgcctccttgggccgcctctccgggccggccggcccattagttcggccgagccgtgcctctcctctcgggccgcacccaagccgcccgaggaagtctaaatcatatccctccaatttctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgaagcttcgtgaagaccttgagcaaggcaagtcaccctttgaccaattgctcctataattggaaaatcattattattttgtttgcaacttgcattattagaatcacacacttaatttgcttggcctcggtttgcgtgccaaaccgatggacctacccagtagtcgcactaactcctgtaggttgtactaccctgattccttgtcgctccacccttgtggtacttcggtatccgtgctctctgagcgcgtgtaccaaatatcccacatacaccgttgattgtcgaaaacttaggaaatgggtttgtgaagccttcaaaacccgacatgtggtgtcggtgtgtttgaaaataaaatgaattgtgaaaactcgcgatgcgggagccgtgcctacgtggcgctgtcccgtattcgcatataaggaccgattcctatgggaaactcatcgagcataatcaaagtgcaatcacaaggtggaatgggacaccctggctaagtaactagtcggttcagggaaacctcgcatgccaatagttgggaacgccggggcggggtcggacaaaccgggttcttggtaaggcaaggacaagaagcttgctcacttaccgatcaaggtggttggagataatttgtgaacgcctaaaatggcctatgtttacgtgaggatttgatccttctatgtggcatgaggtattcctgggtcggcttgggaaaggctttgtcgcgaacctcttacaccggccagtgtctggagtaagttcgtatcttgtgggtaaagtgtacccctctgcagaggctaactaactgttcgaacagccgtgcccacggtcatgggtagatgtgaggtggttcccgttgcgtagatttgtttgcctgtgctttgtgaaaagttgttgtggattgggaatcgtaaccagaatcagcctatgtggcagatggatgacctgagtggtcagaaacgaatctgtgtgattcgggatgtctgcgggcatcatagactaggcttcccgagtggaagcggattgcttagctgctgggcagctggactctgggagtctgcaaaaatgaaaaaggctctgggagccgcctaatcaagtgaaatggctctggaagccgataagtaatgatctgacccgggaggtcggtacattaccatttgagttgttgaaaagcatctcttaagtcgatttgagacgcaagtctcttttcgacccaaacttaaaaagaaataaatcacttagtgatttcaaaaatgatttcaaacaaaggatttgcaaaacaatcttgcctctcttccaagcttgcattaaacacctaagttcccgtgacttgctgagtacgaaagtactcacccttgctctatataaatatatatagttcctccatcctgaagctgaagatgaagtgaattgaagaatagggtttcgtcctggttcccagtcgtcgcctgtggtgttgggtgttagaccgttggttccgctgctgctgctgttgctggtgtttcctcgtctgtgtcttcggttgtattctcaggctgtcctgagctgtaacctaagttaaggtaaataagtcctctatttattttaaggatttgcaatgattcatatttgtcaccgtggataccagcactatatcctgggactggtaccgagatcgcggttttgtaggaagcggttcgcgccgtttttcctacgacacgctcctattaggtgccgttgtacggtggtgccggattggggtgtgacagcagagctggcggggtagctcgtgccctactccctccttgctaatcgatttagagtaggtacaatagaaagctatatgccagctataaacacatatcgaggagacgaaagaagagagagatgagcagcgggctacaaatttgtagccaactacaggcagcataggctccaagacaaaatgtatttatgacgggtgggaccatgtactaatagtgtatgaattggttattaaattaactacaaataatttggatccagtagttgactatactattaaacttgctcttaggtgcattctcctccgctgtatctactcgccaactccctatcatccactttgctacgagtttgctttttctctaattcaacaatttatcatccactttgctttctttataatacgatgttgactgtatcaactgtttcttcattcgtcattgaattggataatttaaaataaaacacttaaaacacccttcactacatttatagtatatggttgggcaattgattgaccaactaacagttttgaaaaaacaaaacttttgtgcaggctcttttacacaatgtagaagtttatgtttgcgtttgaggaatttttttcattttttaaacgatgacagctagccagcggccagcagattagcacaataatactatgaaaagaccaaagtgacgtgaccaatggcatcatacagtaacagcacaagcacacactacacgcactcattgttgtacggctaaagaggtgcactggggccgactgggtatgcgttgcccacgggaataaacagcacgacgacatgggtgcctgggtgcaccgatccatgggccctcctagttcccacacccacacacccacacccacacgtcaaagacccacggtttccaaccgagaagattcatgcgcggctgcccactccgcatattccgcgtgaatcctctgctctcctcgccccgttctgcccattttgcagctatcaaccatcgcaaaccaccggcccagagccgcatcatcgtttggcttggatccgcatcactgattcactgcacttcgcccgccgtctgcaaagtcaccgatctgtttggtacttacttgtacctttgctcacatggtcagacacgctatgttatgcgccgacttgcaaaaattccactgctacgtagcacactcacctataaattgcattcacccgcttcacactttcgccaaacaaaaccaaccgaaaacaaacattcctctgataattaagttatattatacttccaaagaatcatcgccatcatgagtgtggagatcctcgacggcaagacggtcctgagcttcgtggaggacgagggcgccttcaactcctccgtcgacggccgcttcgccgcgctcgacaccaaccgcgacggcctcctctcctacgccgagatggccaacgagctcatgagcctccgcgtgctggacaagcacttcggcgtcgacgaggccgccatgggcgccgacgagctcgtggagctgtaccacggcttgttcttgcggttcgaccgcgatggcagtggcgccgtcgacctggaggagttccgggcggagatgaaggaggtgttgctcgctgtcgccaatggcctcgggttcctgcccgtgcagatggtggtcgaggaaggcagctttctcaaggttgctgtcgacagagagctggccaaagcggcttgaaatatacctcaaccggcgagcaaattaattttcacatgtccatttacgattttggattgcttcttattgttcttacttcttgcatttgttgagctatactatgtatcgttttgatatttcagatgaaaacggtacatcgatagaacacttgaaaaatcctgtaccatttttatttctatttcattattataaataatcggaacacgacaactgattaaaaaacgaaaatagtatttcctccttgtcaaaatataagaatttctgggtttcaaaatataaaaattactagctataaatctaaacagctgcatatcaagattcttgtgaaaaattattatatttttgaacggagtagtaagatacaattgggaaattccatactattttcaaccttacacgttgagtaattcagacatgagacgggcaaacgcgacacgcgacgagccaccatctttccaggccatggccacgccatctctgtgcgcctcgacacgctctctaaccttccttccatgctcggactccatgaccagcctcaccttcgtctccacctcctcggcggtcaccagcccttccagccatccctccatctccacgccgacgcccatgtcctccaccatgagcaccttgttcatcctctgctccgcgtacagcggccagcagagcatcggcacccccgcggtgatcccctctagcaccgagttccacccgcagtgcgtcacgaacgcggcggtggcgcggtggcggaggatgctcggctggggcacccagctgttgacgacgaggccgcggccgctggttcttgcgaagaacacctccggtaggagcgcgtcgaggtgttgggtgctggttgcccgaaccacccacaggaagcggtggccggacttgtccaggccggcggcgatctccttcagctgctggtcggactgttcacatgcgtcggcgatgctcccgaagcagaggaacatgacgctgcggtcgggttgtcagtcgagccacacgaggcactgatgtcggctgctctcatcaccggcggcggcggcggctttgtcgaccagtggccccacggcgtacaccggcgggattaccacgccgtcggggcagcagcgcgggtcggcgagagctcgcagcgcccgctcctccagcgacacggacgtgttgatcaggattccgtcgaactccgccttcatgcgcgcaccggcaaaaatcatggcctcgaaatccttgttcacctcgctaatcggcccaaaaaggccagccaagtgagaagccgacatgggtcgaacacccaagaactcgacaggactagtactatctcctcccagatgcttcttgaacccgtcaacaagcagaggagcctgcaagttaacggcgaggtggccggcgttggacgggtagaacatcaagacagggactcccagcttcctcgcggcttcatgggcatgggcgcacgatgcgtcgatgaccacggcatggaggccccgcacggagcggaggaagtcgtggaggtgctcgttgtggcgtcgcacgaggtcgaagtagttcttgaagaactgatcgttgaaggcgagcgagggagggtccgggatgcccgggagcgtgtggaaggagatggtggagctcttggaggagacggcgcgggcgacggcggcggcgaggttggcttcgttctccatgaccgacgggtcgatgagcgccacggcgacggcgtagccgtggtccaggaagacgtcggcgagctccatcatggggttcaggtggccgacggcgaggccggggtagagaaccaccgtcttcttcatcgcaaacgcaccgaccgggagggtggaatagctcgtcctttcttcgcggcactgaagcgcaacctctcgagttctctgttcttacgaggaactgatgaaatatgactatgagagaaagtgcatcctgatatcctcattatgtaggttttcaggcttcagcaaattttctttcaaaaattatcgaacgtatacagtataactagttgggcggcccacgcaattacgcggctagcacccaaacaaaatcatatattttttaaatatgattttacttaaaatttattaaatagctatcccattgttttaagactttgaaagaccaaaccttatcattctcgtctttctaattatatagtttttaaaagtcacaccagttgctacctcttatgtcatcttcttctttatttgcttactcgatctaccactatttctattcattcttctttaaacctttaaaaattagattttatagtttttagagtttattgtcacgttgggttttatttttataatttttagatgtcccatcaaacgttgccattatactcctctacggcatgtccactatttcttctctttattgtcattgagattttaaaaatcaaacataattatcgtttgggttcatttgtactttctagaagtcctgccaaaccgtcagcggctttgccattgtactcctctacggctcgcccgctgcctcccttctttattgtcgttgtgattttaaaatcgaacatgattattattgggttttttttttactttttggaagttccgaacctttaaaaattagacttgtagtttcattttttacaatttttaaaagtcccatcaaacgatgccactacgcccctctatagcccgtccgccgcctactctttattgtcattgtgattctaaaaattgaacataactatcgttggaattcattttttattttctaaaagtcccgtcaaccgtcggcggctctgcaactatactcttatataccccgcccgctgcttcttctttttattgtcattgagattttaaaaatcgaatatgaatatcaatggggtttttttttttactttttgaagtcccggtaaccgccttacttgtttgcttcacggcctgcctgacgtctctccttttaatcgtcattaggattctatttggtgttttattaaaaatttttatatgtcatatcaactgccaccactctacacctttataggcctgttacttaatttatctcatcatgtgttttagatgttcttttctttcaatagtctttatttttatcacaaactagctaggtggcctgcgcaattgcgtggctagcacccaaacaaaatcatatattttttagtatgatttttacttaaaatttattaaatagttatctgattgtcttaagactttgaaagacgaaaccttatcatcctcatgtttctaattatatactttttaaaagtcacaccaattgctaccccttatgtcatctccttctttatttgcttgctcgatctaccattatttctattcattttttttggaacctttaaaaattggattttatagtttttagagtttattgtcacattgggtttcatttttataatttcgaaatgtcccgtcaaacgttgccattatactcctctacggcccgtccactgtctcttctctttattgtcattgagattttaaaaatcgaacataattattgtttgggttcatttttactttctaaaagtcccgccaaaccgtctgcggctttaccattgtactcctctacggctcgcccgctgcctcccttttttattgtcattgagattttaaaatcgaatatgattatcattggttcttttttacttttaggaagttccaaacctttaaaaattggacttgtagtttcattttttataacttttagaagtcccatcaaacgatgccactatgcccctctacagcccgtccgccgccaattcattttttattttctagaagtcccgtcaaccatcggcggctctgcaactatactcttatataccccgcccgctgcttcttctttttattgtcattgagattttaaaaattgaatatgattatcaatggggttttttttactttctagaagtcccagcaaccgtcttacttgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatgctcttttctttcaataatctttatttttatcacaaattttagttatttataaattgtattcctaattgaaatcttatttttctttttcgaatttcagaattttttttataaaatagttaatatcgtattgtgttcttttaatgtttttattttttattttcaattttagttgttttaaaattgtatttctacttgaattttcttttaattttttctaattttagatattattttatttttattgtcaattttaattaatctcgtattgggttcttatatggattcttctttcaatattgcttatttttaattctgaatttcagctaattttaaattgtattccttcatgaactcttcttttattttcttttgctaatttcggaattatttatttttatttcgaattttaattaatctcgtattgggttattatatggactcttcttttattattacttatttttaattccgaatttcagctatttttaaattgtattcctacttggactctcatttccttttctaattttggattttatattatttttgtttttaattttgattaatgtcgtattagattcttatatggaaacttatttcaatatttcttatttttaattccgaatttcagctattttaaattgtacttctacttggactctcattttctttttttttcttttctttttctctgattaattgtggaatttctagcacccacagtgaacgtggtgcctcctttcaaagctgttttaataatataatagatattagttatttataaattgtattcctaattgaaatctttttttttctttttctaattttagatttttttaaaaaaatagttaatactgtattatgttattttaatgtttttattttcaatttcggttgtttcaaaatcgtattcctacttgaactctcttttcatttttctaattttggatattattttattttttattcaaaattttaagtaatcccgtattgggttcttatatggattcttctttcagtattgctttttttaatttagaattttagctatttttaaattttattcctacttgaactcttcttttattttcttttgctaatttcggatttatttttatttttattctgaattttaattaatctcgtattgggttcttatatggatacttctttcaatattccttattttaattccgaatttcagctatttttaaattgtattctaacttggactctcctttccttttctaattttggattttattttatttttattttgaattttgattaatctcgcattgggttcttatatggaaacttctttcaatattgcttatttttaattctaaatttcagctattttaaaattatattcctacttggactctcacttccttttctatatttggattttattttatttttattttgaattttgattaatctcgtattgggttcttatatggaaacttctttcaatattctttatttttaattccgaatttcagctatttttaaattgtatttctacttggactctccttttcgtttctaattttggattttattttatttttatttcgaattttgattaatctcgtattgggttcttatatggaaacttctttcaatattgcttatttttaattccgaatttcagctatttttaaattggacttctacttggactctcctttttctttttttttctttttcttggattaatgtgggaattctagcccccacggcaaacgtggtgtctcctttcaaagctcttttaataatataatagattgtgaaaactacatcgtaactacctactgtataatataacttgcatcgcatgtactctgatctccgtttattgttatttatcgctttgactttttctattaagttttttcaggtttaatcaagtttatagaaaatgttagcaacatgtataattccaaattagttttatttcatctaacattgaatatattttaataatatatttgttttgttttcactactcaccttgacattttgccctttccggaccgctacctgggtttccagtcatttcggctactgccaatatttttggaggaaatagccgttgttcctgatccttctagtcgggagcttcatatcttcaaggattgggtggagatggcgtaaacaggaaggaaaaaggaatttgaaatccgtcccttcccacggaatcatcgggcttgactttctttactttcccagccccgctcttgtaaaaaaaactcttttgttttgagactagctagtctctatggtttttggaaaactcttctcactctggtctcacttcgaggaatttctcgaaaaataatgctacatttttctataaaattggtgaacataaaaaatatttgactaagaaaaaagtcaaagcaacttgtaatatgaaacgggggtagttttatatataattttaaaccgttagattttgctttgagatttgtataagcgaaaaaaagaagcaaatcatagcgtatgcatacgcgagggagtttaatccgacatcttcacaatgtatcacataattttaaagttatatacatgttacatcgtagttacgtataaactatgtagatgtactgtaataaaaaaagtgactaccaattgatttttcgatagatttgaagcttgaaatattacataattttcaaccaatgaatacaaaccattttaataacaaaaacagaaggacaaccatgtcaaaaatcataagtctagagacaaacacaattgtaaaacctaattttagtgtattgtaactgagtgtatgtgctctataactaagtttaaatgtttaataatcaaatataagtactctataattgagtgtagctacaagttgaatctcaagtaacataaatcttcatgcaagatcctacggataaaagataataataaaaaaacagtagcctaagatctatcactctatggaaagatgtggagataggcccttgtattccttgtctaaaatatacgactaaacaaatttaggccctgtttggtagagctccagctcccaactcctaattaacttcaaactccaactccactagaagctagctccactgggagctataggtggtctaaaagtgtttggctaacttgctcagctccagaaatcctgaaagagaggatagggggtagatagacaatactacccttgtgttttttcactgttggcttaggattaactagtaatttgtccgtgctaacgctacagttatatttagttttatttggcaagtcatataaatggagttttagcaatgacacgaaatagatgtggggtaccataatgttcaacttttgtttcagcaatatctaaatttctatccaacttttttttttagaaacgaacgggaccataatgttcaatgattcatacaaaacaacataatcctgaagctttgctttctccttgagcatgatctaaataacttttccccatggcctccgcttgcctgaaagattgaacaatttaccattggtcaaatgcctacctgctgcaatgttatctacaaatgacaaacaactatattaagcagggatcttgtaaatgctaccaaacacatattttaccacaacttcgatttgagcaaagcgtgtagagatggacatgggtgcactgtaaaaacagtaataacttgagtgccaaacgctgcatttgcagcaagtttcaacaatagagtatatttttttctgaccaaatctttctagaaatctaagtgcagtgagaatatggttgaagtataaaaactaaaaatcaagcaataatagacacacagatcgggagaaattttaaccaacatctaggtaatcaatccccccaaaaaagaaccagatttgagggagggagtctagggtttggggttaccttcttcttgcaccaaatctgctaccccgccgccatattatagctcctgccgtgcgcctcctcgctgtggggagccactcccgctgccaagtgccgccgtgagttctcagccgccaagcccaaccgtcgtgcgtcgccctaacctctgcccaacgccgcccaaacctctactcggcgccctagccgcgagagaggaggcagccgccaccaccgctgccgtgcaccgtgtgccgtcactgctactgccgccgccgccttagtcctcccttccccttctctcttcgcggccttgcggagaagaggcgatgcgcttgaccacggggatgcgcaactcggctcgatgcggatggggaacgaaggggtagtgcggtggcattctgcgtgtaatttctttgaaaaataatgggtagcgctggaaccagttgagagtgaagttgtggagttgcgtttttgccgctccaccatgctagtgtaattttttggagcgatccacaccgctccgctccccgttttgatgaatccgaactgtttagcacaactccagctccaggtaagttggagttgggagctggagctgtgccaaacgggacattaatgtggagctagattaaattttattttaataatctgcacacatctatctcaggtacgtcatgtttattcccaactggaaagatttggactgtaatgaacataactttctagaagtaattattgacactgaatctccatcaatctccatcaatcgcggatgcagccgctttgaatggccttggttgtttgcttgatacggcttatagaaactgagtacaatttttcaagaaccagtcgttattaaagtcataaaacacagagaaaattgtgtgatcttgtagtcatattcaaaacaacagtcctctgtaaaacatttttgaaaatatttcaacgtactggtaggctgagttattttgttaggccctgtttagttccaaaaacatcacatcgaatctttggacatatgcatagagtattaaatatagataaattttaaaactaattgcacagttagggtggaaatcgcgagacgaatcttttgagcctaattagcccatgattagccataagtgctacagtaacccacatgtgctaattatggattaattaggctcaaaaaattcatctcgcggtttccaggcgagttatgaaattagttttttcattcatgtccgaaaaccccttctgacatccgatcaaacgtccgatgtgacatccaaaaatttccttttcgcaaactaaataggcccttagcttttccaactcatccctcttattttccgcatgtacgcttttcaaactactaaacgttgtgttttttaaaaaaaaaattctttacgaaagttgctttaaatagtcatattaatccatttctaaacgaatactccgttgtgtgtgatgattgctgagtagctaatagttaattgatcatgtgctaagtagctccattgcgtgtaggaggcattagttcccaacttccagtaccgagcacaaccttaataacttgactagcataacatctcgtcatctatgcttgttgacttattgggcgcaaaatttaactttttaagttatttttagattttaagggtttagttaatcgaatacttgactatattcgtttatttttctaggactgatcgataagccataacttaaccaattatagctgagctttagcagttactagtatttttatacttgctccgtcccataatataagtgattttagatgaatgtgacacatccacccgacaatatacttgactctttgcataaacatgacatccatcgcatatgaagcttagtgtcacaccccgatctggcaccgccgtgcaacggcacctgaccggagcgcgtcgtaggaaaaacggcgcgaaccgcttcctacgaaaccgcgatctcagtaccagtcccaggacatagcgctggtactcacggtgacaaatatgaatcattgcaatccttaaaataaatagaggacttatttaccttaacttaggttgcaactcataacagcccgagaatgcaaccgacgacgcagacgaggaaacaccaataacagcagcagcggcggaaccaacgaactaacacccaaacaccacaggcgacggctgggaactaggacgaaaccctaatcttcacttcacttcatcttcacttcaaggcagaggaactatatatatatttatatagagcaagggtgattactttcgtactcagcaagtcacgggaatttgggtgtttaatgcaagcttggaagagaggcaaggttgttttgcaaatcttttatttgaaagcattttgaaatcactaagtgatttatttatttttaagtttgggtcgaaaggagacttgcgtctcgattcgacttaagagatgcttttcaataactcaaatggtaatgtaccgacctcccgggtcaacaactcaaatggtaatgtaccgacctcccgggtcagatcattacttctcggctcccagagccatttcacttgattaagcggctcccagagcctttttcattttctcgaactcccagagtccagctgcccagcagcacaacaatccgcttccactcgggaagcctagtctatgatgcccgtagacatcccgaatcacacaaattcgtttctgaccactcaggtcatccatctgcctcataggctgattctggttacgattcccacaccacaataacttttcacaaagcacaggcaaacaaatctacacaacgggaaccacctcacatccgcccatgaccgtgggcacggctgttcgaacagttagttaacctctgtagaggggtacactttacccacaagatacgaacttattccgaacacccgtcggtatcggaggttcgcaacaaagccattcccaagccgacccagggatacctcatgccacatagaaggatcaaatcctcacataaatataggccattttagttttcacaaatcaaactccaaccacctcgatcggtaatctggcaagcttctcttccttgccttaccagaaacccggtttggctccaaccgaccccgccccggcgttcccaactattggcatgcgaggtttccctgaactgactagttacttagccagggtgtcccattccaccttatggttgcactttgattatgttcgatgagtttcccacaggaatcggtccttatatgcgaatacgggacagtgccaggcacaacccccgcatcgagagttttcgcagttcattttattttcaaacccaccgacgccacatgtcgggttttcaaggcttctcaaacccatttcccaaattttcgacaatcaacggtgtatgtgggatatttggtatacgcgctcagagagcacggataccgaggtaccacaagggtggagtgacaaggaatcagggtagtacaacctacaggaattagtgcgactactgggtaggtccgtcggtttgacatgcaaaccgaggccaagcatgttataggagtgattctaataatgcaagttgcaaacaaaatatattgatttttcaattataggagcaattgatcaaagggtgacttgccttgctcaaggtcttcacgaagcttaacgaatcttcgagaaatccttgattgatgaaaatccgcaaccgcaactatacgcaaacaatcaaaaacctaaacaaaagatcaaaagaatgaccctatttagactaactaatagtgccattagatagatcttaattttacggaattactggaagttgaacggagtcaaacgaagctatggatcgagagatatgaattttggaagtttaaatggattttctggacgagaaatgatttattggaatttatagaaataatattctcaagaatattattggcattcgctgatgtgcgggaccaaaggaaatgatttatggaatcttggaatagagaattgatttatggaaaagggaaaaaggatttatcaattcctttggaaaaggaaaggaaggagggatgcgaattggacttcctcgggcggcttaggcgcggcccaaggaaaggcgcgcggctcggccgagctactgggccggtgcgggcccattagggttcgggaggaggggggagaccggccgggtggacgcggtccacctcgcgggttccgggtggggcccatgtgtcggtcgacacagcgcatggtgcggagcgtgcacgtggcgcggggggctagggttagggtcggagtggcgcatggtttggtgcaccgggtggaccaaagggcggcgagccaacgcgcagccgctaggctctccgtggactgagcgcaccgagagggaggagagagcggacccgccttgactcggtctttgctgaggtggcgctgacgtggcacctccatggcatgccacgcaggccggcgagaggaggaagaaggaggccggccgagatggacggcgggcggcgggggtctcaccggagcacggatcgacggtcttcggtcatgggggagcacaccgggacaaagaggcggacgagaggggacgatcccatggctcggatgcgacggaggaggtccgacggcggcggattgcggcggtgaccgttggcggcggcaaaagaggggaatcgccggtggtcaacgagggttcgattcgaggcggcgggagcatatccggggctcggtgaactcatttccggcgccggatggggcaatggacctccaagggaggccggcgacggcgagctacctctgggagcgggcggcaatggcggcgaggccgcgccgggcggcggcgggcattggggcggcgtctatgcgcgttcgggacggctaccgagctactgcgcaagctagaggggacgaggatgagcgaggaagaggaacggagggctaccgcgtcgggacagggcgccgtgaccagcggcggcggcgtgggagagctctccagcctcgggccggggaaggggaagaagggatggcgcccagagtcctcttccgctccgcgcgcacgccggcttcccggcacgcgcaacagcgaggatggtgacggcgacgagtggcagagatggctcggcgtcaatggcgcggtggcgatggaagcgaaaacgagaggaagggagattggagagggggctcgattataaagggggcaatgtcggtttgggggggggaaccgaccttgcacggtcaaggaggaggagctggcggtcacgctaatggccaaggcggcggcaggcgatgacgcgggtggtgtcgggcaaaagtggaaaatggagggggaaaggggggctcaaacgggaaaaggaggagggagaggggagcgaggccgagggctctgcctccatccctgggacgcatgcgcacaggcggcagcgggccgggaggcagcgcgggcacaggcggtgctagggcttgacgcggcgagggcgcggcgaaattcaaaaggcggcggcgagagatcaacgccgggagggcgagaatgagaggggagaggaagagaagaacgaaagagagagagagagagagactctcggcttggcgtcggcgcacgcgcgtgcgccacacgtgcggagcgagggaggaggacggttgaggggaggtgggccgaggggaggggatccggcccatccaaaatatgaggaggcaaaatagactttcacagagaaattgaattgggagggatttggattttggatttcgaatttgatgcttggtcttagggacacaaggtggagtcaaggaaggaactaaaatgggaattgggaacaggtatttggcaaggattcaaagagagggattgaattttcggaatttgatttggagacttgaattggaagagaaattttgaggtggaggattttgattttgatgagagaaaacaacaggatttgaattgagatccacggcacgacttagactcgcacacaaagaacgaaatttccgcaattaggatttttcttaaactagtttttaacgtctcacgaaaagcggagcgttacacttagggatttagttgatggggcctaggactccaattaatttttacatgtaagatgtataccttatatgtatgacgtatgggcccccacaccatctaggaagaaggccccactcatctgttttcattctctaccaagaattgaatcatttactcccatcccctcaatccaattggcaatcaacgtcaaatcaagatggagaagcgaaaaattgatgtgtcctaagctcacaaaaattttttgcgtttccacgaagcctacaatcaccttcaggaggaggagcagcgcgtgcaacaagtggccgcctagacggcggatgagtccccactcacaaacactagtgaaccgtggtacttccttcgactactccctgtttggcaatagcagtgtatcaccctgctcaccaagtcgcattgcacatcatgacagatctgtgccgccacgccctagtcggctaattgttactcggtgtgcctaaattctaaagccctttccattagctatcaagttgtggttcaacgtaatcccttcctcactcgccatcacatcacccgatgtaggtccaagcatagaatgcttacactaggtgccccggtcaatttttatcatgtgccccggccccctagctacctgatttttaatttaacaaaatgtgaaagaacaatacatataattatgtcgatggattatattctaatcacaggatccatacctatacggtttgtctggaggacgtagaggttggatgctataaagagagcaagggagacaatgatttgtatataggttcagaccttttgatgatgggtaatagtcctactcttattgatcggagttgatgttaccattatatatcaatatctcacaggtacaaataggatggaaatctaatccaatttgctagtatatcaacttaaaacttggacatggtggttgatggttagctgttgtctagtttcttgagaatcgactcggtgaatttggaggtggctctagatctctcttcgctcgtattaggcttgccttgtaggtcttgtcttctggtatttatattcccggatgcccttttattcaaatagaactgaaaggtaaaatattgatacaatccgagtagttctgattgggcaacaaatgttttcttgaaaaccgtaaagctagcaaaaccttatcaactatcgaaacattgcaaaatatcggaatagaacctcggatacgttgcacacttgtgaaaagcgaacttcatgttaaggaattttgcctcatatgcaactattagtgaggattgaaagtaaaaagaaaataatttagatacttaatgaccatgacattgcttaaaaactaatactaacacataaggattacatctaagttttattacatttggatgggctgtctccattgacggttatttatttaaaaaattcggataaaatcagtacatcgatagatgaaaacccatctaacattttcatttcgattatcgatatttcaaaatataggaataatacaatcaatataaaaaatcagtacgtacggttgagaaattatgcactactaccattttcatcgttgtgcattgtccaactcggtcatgagtcgggcgaacgcgacacgcgacgagccgccatctttccaggccatggctgcgccatctctgtgcgcctcgacacgctctctaagcttccttccatgctcggactccacgaccagcctcaccttcgcctccacctcctcggcggtcacccacccttccagccatccctccatctccacgccgacgcccatgtcgtccaccatgagcaccttgttgatcctctgctccgcgtacattggccagcagagcatcggcacgcccgcggtgatcccctccagcaccgagttccacccgcagtgcgtcacgaacgcggcggtggcgcggtggcggaggacgctcggctggggcacccaggtgttgacgacgaggccgcggccgctggttcttgccaagaacccctccggtaggagcgcgtcgaggtgttcggtgctgggtgcccgacgaaccacccacaggaagcggtggccggacttgtccaggccggcggcgatctcccgcagctgttgctccgcgtggttcccgccgatgctcccgaagcagaggaacacgatgctgcggtcgggctgcccgtcgagccacacgagggactcgtgccgccggctggtctcgtcaccggcgccggcggcggccttgtcaaccagtggccccacggcgtaaaccggcgggagcaccacgccgtcggggcagcaacgtgggtcggcgagagctcgcagcgcacgctcctccaacgacacgaacgtgttaatcaggattccgtcgaactccgccatgacgcgcgctcccgcggccaccgtggtggcctcgggatccttgctgatcagctcgctcaacgagcgcccgaacaagtccgtcacgtgagaagccgacatgggtggcacgcccaacaactcgaggggagcgctgccttcttctcctcctcccagtttcttgaacccagcaagaagcgaagggatctggatgttcacggcgagggcgccggcgtcgcaggggtagagctcgtaggccggaaccccgagcttcctcacggcttgaatggcgaaaccgcacgacgcgtcgacgaccacggcgtggaggccctgcacggagcagaggaagtcgtggaggtgctcgtcgtagcggcgcacgaggtcgaagtagttggtgaagaacttgtcgtcgtcgaaggcgagcgagggagggtccgggatgcgcgggagcatgtggaaggagacggtggccgagctcttggaggagacggcgcgggcgacggcggcggtgaaggcggcgtcgtcgtccttgaccgacgggttgatgagcgcgacggcgacggcgtagccgtggtccaggaagacgtcggcgagcaccatcatggggttgaagtggccgacggcgaggccggggtagagaaccaccgtcttcttcatcgcaaacgcaccggagtggaatagctagcttcggcactgaatgaaacctctcgagttctctctgttcttcgtacgagtagcactcggaggaacttcttcctgcttaccctcttgttatttactcccttcgtcgaataaaacaaatcagaactgtatgcgacatatgttagtacaacgaatttagataaatatatgttcacattcatagtattaggtgtatcacatccaatacagttgagtttttatagaacggagggagtaggtttcaagtttccacaaattctctcgaaacaatcatcaaatgtaaattacaatgtaatttcaatttacacgtaagtaggatataacttgtacgtagcttttatataattttgaacaattaaatttacttcgagatttatgtaagcagagaaaggaaaatatctactacaacgtgcacgtacgtgggaggattcgatcccacgatcttcattttgtggaagcaacgtgttaccaagagatttttttaagttatatcattattagttatttaaattacaatataattggatatttgtcgacagaaaatatacggctcaaacaacaatactaactagccatgtggagctagaataaatcttatttatatactcgtaatttggacacacccacctcacgtacgtcgatacttgaaaacaacgtatcaggaagattgatctggactcaaatgaacatcgttttctagaaatggagtagttaacactgaatcattgatgacgctcacactcctttaatttaatactacagttgtgctgacactactacattatcgattttttctatcgataaaattgatttttgcaaatgggtgggtggccctctcgccatggccttagcgcttcctttgaatggcctaggtgtttatttgatacggcttatagaaacaacttttttcaagaatcagtcattagactcgtaaatcagagagaaaatgtgtactctctagcatattcaacatactaatcctcttaaaagacatatttgagaatattctacgcatgctagtaagattaataatataatgtctcattatctgttcgttgacttatgagatgtaactaaaatttaaaattttaaactcaattttaggtatttcatcgtaggctatttgatatgatgcatttcttttaaactactaagaataaaaatataataataatccacaaaccattataattttttggtttatgttttatggttgatcgataagccataacttaacctatcaaagccgtatatattagagtggcagtccattttctaagacattatatttaattatccgcacaaaagaaatcaatatataataaaaaatagtaattaccgttagtaaatttcatactcctaccattttttattctcgtgcgttgtctaactcgaatatgagttgcgcaaacgtggcacaataacgaaccgccatccttcgaggccgtgggttctacatgatcatctctgtgcgcctcaacgtgctctctaagcttgctttcaatgctcggactctatgatcagtctgaccttcaccttcacctcctcaggaatcaccagccctaccagccatccctccatctccacgtcgatgcccatgtagtcaaccttgagcaccttgttaatcgtcagctccacatacagcggccagtagagcatgggcatacctgtaatgatccccttttgcaccaagttccacccgtagtgcgtcacaaacgtgtcggttgtaaggtggcaaaggacatccagctggggcacctgtgtattgatgaaatagccgtatatattttctcctttagatatagaggtgagatttttattcactattaaaaaaaggtattgacaacgatgccctccccaccgacctcgaactccttcggtaggagcgcgtcgaggtattcggtgttggcatcgcgaacaacccatagaagcggttaccaaacttgtccaggcttgtggcaatttatcacatagtaaggtccctttgaattaaagaatttatggagaaatttcataggatagaaatcctataggaattttcctatttggccttttgattcaaaggattagagttttccaaatcgtataaaattcctatagaatagatcattacatgtagattttggaggaaacttagcaaaatgttaaacctcttggaaaaattcctttgaatctatctctctcatccgatttctgtgtttttcatacggtccaatcaaacaactattaccgtgtttggaatcctccgttttacacttatatctctgtcagaattttatgcttttcatattactctttttttttattcctactgttcataggagagatttcaaatgttttgctcgacaggtaaacccttagatcttgtctttttcacttgacatgaggttgcgacaggacgcactgtgccagcatagtcaagattctttaccaataagaaaataccaaagtgacaaacatgaccagggcactaaaaagtaaacagtaaacaatcagtgctcatttgaaaaacaggattttcaacacacaaaatagaagaagaaaaaacagattcaagtgtcgtatctcaaatcctgttggatggaaaagcttagaaaaactataggaaaaactgtttggatggagtcgtatgaaaaatacaggaattacacaaaataacgtatgaaaaatgcaagaattagaagagatttatagatacagagtaacgtatgaaaagtataagaattagatgatacaatgtaaatttttcaagaggttggatcttatgttgaaaaactttcaaaatccttatgatttgagaaaatcctaggattttgaaatgactattcctttactccgaacaaacatgtttataaacattccacgaattaaaccctgcaaaattcctccaaaattcttttgtttcaaaagaccctctaagtaagggcatgtacaatggttgttaatagtggtctcttagcgttgctaattaggaatacttattgatatggaagaaagagaaataggagagacaaaacatcgttgttatgcatgacaacagcttaacaacgactcttaatcactataatatggaaatatggttgcatgagggtaaaaaaatggaaagaatattaacaaatgaaatattttttgagttaatgattaaagcctttatcgactcaactattataaagatatggtctctaaataatcttatattgtttaagagaccatacttgtctctaccattgaacataccctaagtaaaccggggaaactattttaattacccgggtgattagaatccatataagagcagaccgctctcatcgaactttgccgacattgggtgcgccggcgcggccttgtccgttggggtatcatctccacatacaagccactaagcccacagtttcgggccgacgaaatcattcatgcgcgtctggctgcccactccgcatattctgcgcgatatcctcgtcccgtacgtgttgcccattttgccgccacaaccgtcgcaaattcgcaaaccgccggcccggagccaaccaaccaacggaagcatcggttggctccctccactacactgtactgacttcgcccatagcaccggcaaagtcaccgatccgcttggtactgaataaattggtcacgcacgccatagtagtggactagtatggtggtagctcaccatcgccgacttgcaaaaccagctgctacgtccgcgtactttttcgctgaagatcgagcacctataaattccattcaccagcttcactatgattcatcaaccaaagccaaccaaaaacttcctctgctgcttagctaaagaatcatcgccatcatgagtgtggagatcctcgacggcaagacggtccggagcttcgtggaggacgagggcgccttcaactcctcggtcgacggccgcttcgccgcgctcgacgccaaccgcgacggcctcctctcctacaccgagatggccggggagctgatgagcctccgcgtgctggagaagcacttcggcgtcgacgacgaggccgccatgggcgccgacgagctcgtggagctgtaccgtggcctgttcgcgaggttcgaccgcgacggcaatggcgcggtggacctggaggagttccgggccgagatgaaggagatgctgctcgccgtcgccaatggcctcgggttcctgccggtgcagatggtcgtcgaggaaggcagctttctcaaggtggccgtcgacagggagctggccaaagctgcttaaattaatatacctgaaccggcgagcatttaaattttcacacagctacgattttaattgatatatcttgtgttcacaatattgatcattgttatttgatagcctctgttgagctatatttcattgttacttgtgtaactgtgctctttgagatagacaaagataatatgatataaaaaaccagttttgatcaagagaatcggtttgaaagcttgtgtgtgtctactagataccagggtttcatctttcggtttggtcatttggaccagggtgcccgaaatatcgaaatttcagaaatttcggttcgaaattatatgaatttttgaacaaaatttgattaaattaaacaaaatattatcaaatttacaaaaaaaatgaaaaaaaaatcggtcgaaataatgtcgtatctgggttcgatccgaaattttgaacccatgctagctgccaggctttggattctgagcgccacgtcaggaacaataaaatatttgggcctctaactcttcgtgggctgatctgggccgtaggcagacgagagagcccatgacacgatctcatcaattccgtagtggccacgaactcacgtagcgcaaatgccgctcccgtttccgaatcgtgcgatttatctcctttctgtttccgaattttattagtagttgcgatattattaatacaggtttcgtagcggccgcgtctcctcctcccttatataaaggcagcgtttctgcaagttattacccaaatctacacgagagagagatcgttcgacgcatatagagagagagagaggcaagatgcagatcttcgtgaagacgctgacggggaagtcgatcacgctggaggtggagagcagcgacaccatcgacaacgtcaaggccaagatccaggacaaggaaggtaatataacacgatatcaagatgatatccctagcttcttcgtttgcatgttcatcttgtttaatcgttgatgtcttgatgtcgtctcgcgatgatcgactgcacgtacgtacgccgtacatttgctggcattgctcgtcccgttaatttagtgactcatcctttgtttcgtacgtcgtgctcttgtgcgtctagacagtagaaatcatgtgttttgcactagatgcgtggtgggttgatactgccgaaattgttcaatattgtagttgtagattagatcgatttgataaccaaaaaggaagccttgtacttttccattacattacataggtctaagcatgcgtgtgtttagtcgcagtaagcacggagcaacaaatccaatctagccatctgcttatagttcgtcttcgctgtgtacatgtttctattctgtcttagtagtttaaaaagatatgctagtatcttttatctcttgatagggagtgccttcatcgatgacattgctgcataactgtaattaaagactcttttttcttgttttcatggattaatattaacttccgagcccattcgactagctaaaattcattcatatctctttcactgttgtatatataggtatccctccggaccagcagcgcctcatcttcgcggggaagcagctggaggatggccgcaccctggccgactacaacatccagaaggagtcgacgctgcacctggtgctccgcctccgcggcggcagcaggggcggctacaccatccaggagcccagcctcctgctcctggcgctcaagtacaacgagaagaagatggtctgccgcaagtacgaactcatcttgatcctgtttgactaatgctatataattttttttttaaaaaaagaaactttacggaatgcttactaacaaagatctcagctttgaattttaacgcttaattcgtacgtgtattcctgttccacgatgcatcctaattaagttcctaaccgcaggtgctacgcacgccttcccgccaggtctaccaactgccgcaagaagaagtgtggccacaccaaccaggtgaagtggtccttttacttagttttgtcgtcaaagaaatgttttaacgtttttagatagtttgttttcaaaattggtcgtttggttgcatcagtcatgtacacggattcgtgttactccctccgttttatattataagtcttttttagcattgtctatattcatatgtatgttaacgaatctagacatataacatctatatgaatatggacaatgctataaagttttataatatgaaacgaattttttttatataatagatataaaatccatccactatttgtacatgttatttttttcgatttgtatacattgccgtacgttggttgtacggctgacctaatgttgttttcttccatctgaattttcagataaggccaaagaagaggtttatatccaagactgccaactgaataaaagagttgtcatgcatcagttgagtcgaagagtcttcctattcagttattagctcatatgttagcatcagttgagtcaaagagtcttcataaatgttagcctggctgcttatgctatttctgtttgtgagatttggttagaagtttttactgttcaaatctctatatacgcccctacttttctgtttttgagatttggtttgaagtttttacttgttcaaatctctatatacgcccctactgcgagacacctaatttcgtttacggttgcttaatttcctttcttttgcatgaatgttacgagaaactagttagagaagtttgatttagaacctcttatatataatataataggaaacggaaggagtgggcatgttccaaactcacatatataatcccagcgaagactagcagatgcgaagatcaggaataaacctttcgtggtttagctgatttgatcagacctcaccaaaatttctgaaatttttgaaattttgaataaaatttagttgtatttgaacaaatattaccaaaatttacgaaaaaaataaaaagttagaaaatttcagccaaaataataatgtattggagaggtctgaaatgaccgaaatttccaactttggccaagataacttgcccgatctcacaaaagtcaacacattcaaattaaccaaggtcatcaatggcaaatgactaatctcactaaatataattcaacacattcgaattaactgaggtcatcaatgatagattattaatctcagtaagttcctagtgataaaaaaaataatctatgactccagtacacaaataatgcttccgccgtttgttttgctggcaaccccacgagtgcttcccgtttctattgatggcggcgtggcgctagggcactaaacaccatgaacgtttgccataaatgcttcccctgttattttttttgcctcaccatgaacgtttgacatagtgtttcccctgttattcttttctgtaaggctagttcacaacatatgttcgtttgagaatttcggcaggcaaaacaagattattatagtactattagctattactgtaaacataaaacattgatgtggtgtggttgttttttttttcccaaggatgtaaacttgaatttatatatcaaagcgtaatgtcgctctattttgtgcgtgtgtttttttttcaaaaataatgtatcaattccttgtttaatgtatcaattccttttaagaaacatacataaaaccgatccaagtagctattagaactcgattccgctagttgcaacagccacgccacgcctactccgtacttactaagggaatcatgttcaaaattcggctaatcaatccacagaaatcctggcaaagatcaccagaatttctactaagtcatccagatcccaaccgtgaccgactcctgattcccggtatctacacagatcagtgcacgtcaataccgacgcagtcgttcgcctataacattggttgctttccaggcaagtcatgtgtctcatgcccatagcatacgactctctccaaaagaccaaaacccattggcccgtcccacgcatccactagaccaccacgcgccaagctgaagccggtcggcaattggcagctagcgtaccactcgatcaattccattagtaaactctcccctatataaacagcactcgcaagcatcgatctccactcaaattagccactccactccaagcaaaccgagtctcacttactctgagcttctctacacatccagtgctactccagtttaattagcatccgccaccatgagcgtggagatcctcgacggcaagacggtgcggagcttcgtggaggacgagggcgccttcaactcctcggtcgacggccgcttcgccgcgctcgacgccaaccgcgacggcgtgctctcctacgccgagatggccggggagctgatgagcctccgcgtgctggagaagcacttcggcgccgacgaagacgaggccgccatgggcgccgacgagctcgcggcgctgtaccgcgggctgttcgcgcggttcgaccgcgacggcagcggcggcgtcgacctggaggagttccgggcggagatgaaggaggtgttgctcgccgtcgccaacgggctagggttcttgccggtgcagatggtcgtcgaggaaggcagctttctcaaggtggccgtcgacagggagctcgccggagcagctgcctaaactgaactaattacagagcaaaaaaggagtttcatattttacacttccacgattttgttgtgattcattattctttttagataactagaaggccactctattgagtaatttcattgatacttaattacttatatatacacggaaggatacacggtgtaataatgcattagttttttcatgttattctcaaatcactagtcttttattattattattttgcctagcataaaagaagatagttgatcttgtacggatgtctacgtgaggaaatgaaataccagttttgggattttggattacatcagtaatataaacggtgaattcacaagttgaactccgtgactaaatcaattttccaaattttcttttagaattttactgcacaatttaagaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcaga

SEQ ID NO: 81148 - DNA, 6932 bp, Oryza sativa
tgggggtggtatagtcatagaacttgttaagttaacctaaaataaattgatgatgtgcactcatcttctccaggcgggtttggatcccgtggagttggcttcaactctaccgggtagatttagctaaatctctgccatctatttttttctacggctgataagaagccacatctcctgattaattttattaatcacatggatgtaaaggaaaattattttcttgacatttagcaatgataacgttgcaaccaacaaattaagttaacagagtacatgttctcttcctcaaattaacaataatatgccaacaaaatgtttcctcgtatacatataataacaaaagagaaccttgttaatcatattcaatatttcttttttatataatagagatgaagccattcttatgaaaaaaaaaagtcggccagccagaactggaatcactatgtcaaaaagcacggcatatcttctttctttgaacaactagttgttataaagattacatggaattatttatcaaaagaaaaaaatagttgaaattaaggtggtttgatctcagccgtagagaacagtacatgacagagatttgggtaaatctacccgctgaagttggagttaactctagcggatctggacccctccaggcatatggtcaatgggaaaaaaatgactcttccaacaatatatggacaaaaatccaactgacgttcaaccgaacttttcttagacaacattaggcacaagtcccggaggctcggtcagggttttttttttggataatctgatgtaattttacatttcaatcatcgttcatgaggtaaagtgagctacaactgagtttaaaatttggatcaactagaagtgaagttccaggcaaataagaatcatcattcatttattttctctactacacagcacacctaccaaaaagatatattgattaattaggtttggaattcacttcagtgttcatttctgccattacttttctgcatagctatatattgttgtcacacatattggatgacactaccaactgtctaatttgacatgctctagccatatgtacaaaatgagttgagttggtattaccaggcctagatattttaagtacttttatgtctgtactatatatgtcaagcatttgcataaacaatttagtagtcttaggagacgtcaggaatataaggtgaacttgtatgtacaaactcataggttggttgaatgttttgatcttctgcatatagatgcacagccacaccttaggttgagattcccgactcactcgagcctataggcagattcatatcgagaatgcaggatcagcacgagtgactcatactgatgatgacccaaggctctcttttgtcaagatgcgttgacctgtttctattttcagtcatctaatttgattactagctgtgaatatcggcatattgtgggagatgtagggcttatttggaagaacttaaaattctgaaaacagttggtagctagcttttaagattttataactacagcttctcagaatctggatgaaaagctgacctatttgggggagcttcttctaagagaagctgcaactcctagaaactccctaaacaggtccataatattcatggcccaacatttttttttgttaaaatgtgttgatgtgatatttctatctagtgtcagtcattcaacaaatgagatatcttgcatatgaggtctgttttttattttcttttttttttaatttgaatgaggtctggtttgagagaatagttaagtggcatggtcattttgtgggatatataaactgctggcatgaacttagaaaggaggtgcagaagtgggattagaacctaggtgggcaggtgggattataacccaggtgggccgtatgccttgctaatcgatcaagtgcttattcacttggaataaccagaaaatgtatctgttttaatccacttcagttgactcactagtcaccacatagatcaatatggaagaaaatgctctggcattagtccaacctacaacaataacataactgacctgccacacatacacatcagcatacgtgtttgctcacaggatatatatatttctatttgaatttttatggttcagtgcatcgcattttctgatcttactatacacctactctaggacagtaaagaaattgatctcatatttagttaatccgaggcacgcatggttttaaatagcattatcgatcatgtcaggactccttcaggtgagatctgtctcttgccagtaggtatatatcatcaatctcagtggtgaattccccctatttcaacatatatatttgtgcaactttgatatgtagtttgctggccactggtgtttacggtttacattcattggtgcattttaatcttttcatttacatggatgtgtacatgggtctttgagaaggcttacgcttaggaggtatcaggattgcacaattcagagttgagtcatttgacctcctccacgtcgtgcctccatgcttccggggatcgcgcacagttgctgctgggttagcgaacaactcctaggttggtgacatacgtggcgccctcactgtcccggtcatctctcagttcctgttagtctaggacgcggtggttcctacccagctctcgccgggtgttgaggatcacctcgtctggcgttggacgggtgaccagtgctactcagcgcgatcggcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagcgtggtattgatagccactctgcttgccccttttgcgctcaggagcttgagacagcgaaccacatcctcatcgattgcgtgttcgctcggcaggtctggctccgtgtgttgtcccctcctggctgggctgccctctctccccctcgtggcagctggctccaggattggtggtcatcctccagggtatgtttacctgagcaccttcgcagcggcttcgacttcttggtactcctagtctcttggcagctgtggaaggaacgaaactccagggttttcgactctgtgctcgcttcggtcacagtggttctagagtccttccgctcggagggccagctgtggtctttagccggtgttacttgttttggggatttcttgggagtgtagcgtggctctgccccctcccgctgtttggagttgcgtttttaaccgtcgtagtagttcctagcttcatgtccccccctttaggcataagccagtctaactgattgctttgtgtaacaaaaactcttttcctgctaatatattgacgtgcaatccttttgcgcgttcgcaaaagaaaaaaagagttgagtcattgaacatattggtccaagatggcctcctaactctggttagtacaaaacagcgtgagaaggtagacatttgagagggtttatttgatcttctggaccacagaaatgttcatggcccatatatatatatgatgtataaagtccacaatagtttggctttcttattaacatttttgcagaaggacataggccatgaaattgtgtatgcatgtgttactatgctagctcctgttaactccgcaatgatttttattttcattttaagattcgtgaatacaatgtccaggttaaaacacacccgactgatgaatgtacatagataagcatatgggcgtcagtcgtcagtcgtcagttagagttatctatgtgtaaaatcaaggagttgatttagattttgtgatgaaaatattggtggtttgctaatgttaatttgaagattttataagacggttgattttgtgaagtgtgcagtttcggttgaccctggcagttagaccggtcgtgtgtagccagtcagaccgcaggtgttgcggtggtcagaccggccggcccaacggtttgaccggcaggttcctgatcgtattcggtttcgggttgttttgttggatttggatgtttcttttggggatttggcttctagatggtttctatgcgtatggatactgttgttatactaatgtgagttaaggtgggacgaacttaggctcggaatatggtttcttggttgttgcatgtgcaggtgttgcttgaggccacgggagagtgttgccagtgatagatcggagtcaacttggaaaaagttgatgtccagggatcaagagatcatgcggaatactaaaggctagaggacaatgcacgtggtgatgaagaaatctatatggtatacaagagggattgtttacatatggaaagaggagtcgaatttggaagggagtccgaattcgggaagattgattgagatcaggaaagagataagttggatacttgcaagagagagttacctacgtggattaggagtcctaagttgtattagattcgtgggctttgcacagcctacctcatgtataaatagagagggagggtgaggcctcccggtatcggttttagagagactagagttgagagaaagttagggtttcgaatttagttcgaaattttggtgaggagtgttgttggtgcactttgtaaacactagttgatacaataaagtcgaaaagtttcaatctacatctttgagtttgtcatttaccggtatttctggatcccgacggtctaaccgcaggtatgcgcacggtctgaccagtgggatagtggcggtctgaccgtaggtgtctaggcggtctggccggcggtaggagggtggtttgaccggcagcgataggacttcgtcatcaacttcattcgagggtaatctttaattctgcaaaagatttttgggtttttggttttccctaccattcacctccctctggtaggtttgtttggtcttgtgcgatccttcactacgtacagtcgtcagtcgttagttagataagcatatgcatactttcgactgatataaagtcgacatgacttcgtctactccaattgctagtaatactcttaagacaacgagcatggatgaatcttccatccaacgctgttagagttgttccttaggggaatgcataaagtctactaggattaggaggcagtgggaattcagcattgagaggatgaatcctttcgagttttgaattgtcatatactctctggaaatcattgatcaggtggagcagtgattggcaagacgtgtctgaggtgtcatctatcacactcacacatgcatatgaggaagctgtcgaggatgaggggaaaagatagcagaaaggcattgtaaatttgttattcaaagtcgaacatgggcaactcctatgaaaaatggctcaaaataggcagcacaattcctggcagaaagtgtactctacattagacaagcgttgcccaatggaaacaagagaagcatgacaaattttgtataaactatctttgagttctaatttaatagccgtatatatcgatcatttaaataaattgtacaatttgtaactagctaatctgatgacaaaactttatcgagttttacacatgatgtatagaaaatgctcgatttgtttgcttctttttatagcttgaagtttgtagtatttctgttatttcatcatccacgtacaaagaaatgcattatgaaatattgacatttacatagattttgcagtggaaaatatatcagcctcacatatgcacattcatattgtttcatgctattatatggcactaatgtaggataatatgtgcatagacatgtgttctatcgagaattcgagatatttatggttttaaggttgggttgacctctcgagtgaagagtttgaggcttagtgctcggtgaatgtctttgttggcaagaacctttgtatgtaagtctaaatagtcttgtacagttgttgttaactatgtacatctgatttaaatatagatgtcgggttttaatcctttttcttataaaaatggttttgacgatcaggttgaagtcagctgtgataagcacttgctttggttctgcaaatatgtttgcaatttcctcagtcttttctttcaattcgagtcctaagttcattcatttacttacctaggtgcataagattttgcaaattaatgcatttcctctcgggtataaataattttaggcttaggaaatatccaaaatcaatgtaggatacaatgtctgaaaagactgaaagttgcatcgaattaggttactgtacaagtccacagtggcctgaccatgctcttttcgacaccaaaattatttggcttgagtttctaaattcgtgcatacaaaatccaagataaatttttaattgatcctcataatgtaattcctactaaagcacacctgactgtgcataaatagttcacactatttgctagctctaagactacgagcatgcatatatatgttccatactccctgttagagttgttccttagctaagtataattgcataaagtatagcaggcttaggaggcaatgggaattcagccttcagatcatggacacttttgagtttcgaattgtctccaaagatcatcaaccatgtgaggagtgatctttggacacgctcacgcaggccagtcttcttgtcaagtgtacgagggaaaggataggagaaaagtattgcaaatttgtaattaaaagtcaaacatacgcaactcctatgaaaaaagggtcaaaatagtcaggccaatctgtagaagaaaggtggtctatagtagacaaagtgttgcccaatgggaacaagaccaaagcatgacaatttatttataaattaacttctagttctaatttaatatccatatgcatcattaaggcagaattttatagtttctaacgagcccaagtccaaccataaactttatcgagaattacacacgatacacgaaaaaaactgctcttgtttggatttggtcgttttgt

SEQ ID NO: 81149 - DNA, 7916 bp, Oryza sativa
ctgcagccctgctcgtctcctccgccgcatgccgccgccgctcgcctcctccgccgcccccgccgccgctcgccgcctcatcccccgccgctcgcctccaccgccgccgccgctccctgtcgcccgcctacctccgcggcacgcgtgagtgagagagaatgagaggagagagagaggaatagttggataggagtatgacaggtgggtccacatttttttaataaataaaatgctgactggactgccacgcgtacgccacgtagagcaaatccaccacggtttgggtcgaggggggtaattcgtccggtttacatagttcggggtgaagaatgtccggttttgtggttcggggggtaattcagacgaccgcgatagttcggggggtaattcatactttttcctttaatatatgacgccgttgattttttaataaacgtttgacctttcgtcttattcaaaaaatttatgtaattatcatttattttactgtgacttgatttatcatctaatgttctttgagcatgatataagtatttttgtatttgcataaaaaatttgaataagacgaatggtcaaacgttagttaaaaagtcaacggcgtcatacattaaaatacagatggagtatcggatattagaatggattttttacacgaataaaaatactaattttataactcgtctggaatcttttcagtctaattaatccgtaattagcacttaggctcaaaagatttgtctcatgatttcttccctaactgtgcaattagttttttttaaatctatatttaatgcttcacgtatgtgtctaacaatttgatgggatgtttttaggaaaatttttttgataactaaagcaggccatataattaatactattggcagcgatgacgtcagtgccgacttcatccactcttgcacgtataattaattatattattacttctagattactactgcccggacgggaggtgatgccataggctacagcaatgtgtgtaggtacgtggttcttctgcagccatggaagtgtgtggtccgtttgtgtgcatattctttacctgctttgccggttgaatgtcgatgcaaaagttttcaattacggatagttgttcatgtgtactcctctgtcccttaaaaacataaatctaaaattagatgtgacacattctaatacaaagaatttagacagagacatatctagatttataatactataatgtattatattcagtactaggttaatttttttatgggacgaagggagtgagtgatcttgagaagcatatattgtttacggtatgtggcacttacatcaggtgccatatggcagaggatatcaatatatgaagcactccctagattaatatatatttggggggggggtaaaattgatttttttaatgtatttacaatgaaagttgaccgtgatagcgaagaaaggaaagcacactagcgcggtagcattttgtttaactcatgtttatccatgataaaatgtgtagtagtagtagtatacttgaactttttgtttcattctcatgaatccgtgcggcatcaaatactctctccattccatattaattaatcatcatataaacatatagaaatttcaaattgatcatcatataaacctggtccctttatttgacatgcagtattattattgcatctatgcatgtaaattgagtatccatgcatacatttagggataggtaagcatttgtttcttgtgcatacgaggagttatagcctacatgtttcttgattctttccctccacatacttagattatataaaatgcataatagttttttcttcttagtggaaagacttatatgataactaatatgaaatggttggggtactagctacgggcctatacatcgcacatgatctagatccaccaatcggtactacaagtgtaactgtacacacttgcgtacgtcctactagtagctagtaggtagtaattctatgtcctatagaaactaacatttaaagttttcactaatatcctgcaaaacatgtcattcaacaatataatcaaagaagttccctaaaaaaagaattaatcaataaagaagtgggaccatatacttcaaaaattttaaatatgctaaagattattttgccatgtgtcgtaatttctgtgaccatatagctcctgcgttcgaaatacaacatggcaatgagttgtggaaaggatcgactaattaattaattacacgcggagagattattcgtgctcctgtcaaccacattgcacgcacttgaccataaaatgacagctgagtcttagtaacctggtcatttctagtaggaaaactaatttgcctctaaaaccttcttacaaccgtcgagttttgtgggacgaaagaagtaggtgaagtagtagagtggagcagaagatcctgagcctcgagggatcaatgcgtgcatgcgacagtgctgacctttccctgtcgccctgtcggttccctgttggatgatgattccaggtgatgagagagtggcgcgcaagtagccgccgcctccttccatagcatatccacgaaccacgatggccgtccgtcaaggggagcgaggggccgcggtttattggctccgtagtacgtactacctccgttttaaaataaatacagccgtaaatattcctccctaacatttgatcatccattttatttaaaaattttataaaaaattcaaaaatatttagttacacgtaaagtactattcatattttatcatctaataacaataaaaatactaatcataaaaaaatttcaaataagacgagcggttgaacgttgaacgtgaatagtgcagaactacacttattttgggacggagggagtacgagctaggcagccgcgtgcaattttggctgtgtttagttacacactaaaaatgaaagtttaattaagttttttaaaaaaattggaagtttatgtatgcagaaatgttttaatgtgatgaaaaagttagaagtttgaagaaaaaattgggaactgaactcagcctttacattctctttcaatgaacgaacgctcgatcgcaggttgttgacggacgcatgcatttccacgtgctgaataaaaatcatactccagcaatgagcctgctgcctacttcgatgcgtcgcatatggatatgggccatatgcaatgcagtgcaccccacatcgttccatatacgcacggcgcacaccctgctaattaatttggtcaagcctgacctttactgctcgtgctaatactaatattcaggcccacttctattcttcagcttcaagcacacttaatttccaactattagatgatactttttttttaaaaaaaaaaatctttatagaagttgttcaaaaaatttaaataaaaccatttttcaagtttataattattaatacttaattaattatatgctaatgagatttctcgtttcgtgtgtggtacaaatcttgctcatccacctgtaatagaacgaatcataagaatgtgttctgttggttgatttatcaattccatgccccaaaaaattaaaaataaaagataaagttctattttatatttttggtgcaaaataaattcgcatataacatggcattaaccccagctcaccaccatccctgtaaaaggaagagtaggaggggggacgccccaactctctcaattctaaaaccctagaacctaagtcgtccgatcaactgatgcgggaagagattagtgaggtgatctatataattttcttttgttttattgacagaaaagccaacgccctatacttctcctacagtgagaagaattacgagaagatgagaaaagaaagaacaagaagtaaatcaaagtgaccggcttcaatggcttcatcctcaagttagcagataaataaattctgcattgagtaaaagtgatcatgtttaaactaaatcattgagattatgtaaattagactcaacacgttcaaaactccattttagtttggctacttcctcaatttttgttagcacacatttaaaattgctaaacgttacgtttcttctaaaaacttcctatataacgagttgctttaaaaaaataaaaaatatatgtttttcaagattttaataactaatacccaattaatcatatacttatcacgcttctcgttttacacatggctaatcatccgttcaaaagcactttagaatgcaccctaataatagcatcttctaactaaaaaaattatctcaaaacatatcaatttctagctacttcaatcacaatcatctctcatttaatttctctatttttactttctcatgtcttaacttatcacaaacttttctcatttaatttcacattttcccttaatttccgtaaaaaaatacttatatatttttagatggagggcgtagtccactgtgatgctacaatttgtgattttagattttcgggctttcttcattgttttttgttactcaacttttatattgttatgaagaaaagtaaaagaagatgacctaaaattattattaaaaagagttaaaatccaaaattagcttgaaaaaagctgtaccaaatttaaaagctacctttgcaaacataggtagagggaggaatagcttcaaattaacatattgtttttcaacgagcatgccaacttcgctgtgttataaggtgagggtggggaaacttccctttcagcatgagaatcgaaacgatggattagtgcacgattaataaagtattataaaaaaactctaaaaataggttaataaacttttttaaaacaacttttctatatttattatttttatttatcttaaaaaaaggcatatcttttagtagttcggtaaacgtgcgcgtgaaaaagggagcgagttgcgaaagagaagaaaaaacacacccaccactatatgtcttcaccgttgacagcacggcatgtacgccaagctgcatcttacatatgcctcctcaatatatattcggattccttatacttttaataaaaatcagcgcataaaaatctcttatactactgcagattcttcaacttttttacacctaaaagtctgaaaaacctttttgtccaatgtaaaaacatgggaagaaaggcttttaccctcgtgggattctagacacttgagtacatgaatccaaaaaaaaaaggcaaatggaccttttggatttagtgagcataggcgcagaccatacacgactagatgtggaatttacacttacatcttccctaattgaaaaccgaaaattccttcttgttaggttgaatgaaccgtcaaactttcgtataccagtagagaacacagtaaaaagcataattaacttattactctaaacaagtttcagatgctgatcgactccaattaccacatggttggtccacatgtaaatcagaaaagagagtagcgtcgcccaacacatatttttaacagacataatactaggattaacacagcaacttaggcaagcaggcagcatcaagttaccagatatggaagctgcagcttccagatgcctccactatctaaggctcctttcatcttgaaagaatcagcacccaaaatttcacactagatactgcttttcacttttctcaagttcagaacgttttacatgtaaacaacgcagaatcttcagattttcttggtataggcactgaaagaataacccagtgtcaaaagcaaaaggtgatctgatttggagacaaagatggagagagagccccacacctctcagatctggcacatttttcttaccaacgtagtacatggtatcttgtcttccagaagggttgggccctgagatatgtagccacctttgtcttccagatgtctgaggcatatggaagaggacatgagattttggattagtatgcaatcacatcaaaggactacacatgtaattcatgcttagtgaagacgacagtggaacaatggacctaagcttgaccacagcagcaccattaattcaaatgttattctaggatttgacgatttgttactgattctgcaggagcctaagggggataagttactagcgagaatgacctggccaacttttgttttgattaaatgtaagattattcgtcacaaactagcataccggttcacacaattgattattctttggtagtattgcctgaaccatcaatcaacatatatgaccctccgtacacacaaaaagacattccgccatatgtaaaaggtggactccattctggaacagagaatgggtttcgtgaaaatgcattattgagcaatacaatggttggtttaactccacgagacctacaaaaaatcaaactaacaccagccttgaaatcaaatacagtgtcatgttatctacctatccaatatccaggtgctcagctgccttaatatagaaatgcaggaaacctattagtagcattgaactgaccgggatgttaaggtctatataaactccttgcagttcaataatttattttgtttatatcaaagatctcgatcatgcaaagtaatttgtaggtacttacaaaaatatttttttgtaaattataggtgaggtgtttgattaaaaaaaattataagtgagggttttctaatgttaaaaggctcttcataattttggttggttctgcagtgtaacatcagtagcatgtaacaactagtttcactacaaatggattgcatcaatgtcctctccaaaagagaaaagaaaaaaaaatatttgggaaaaagatcggaagggtgtgaattgcatgcactgagccactgactactccactaccagcaatactatttcaaagcttgtgccatttagtattgagataccatacaagcgccagacaaattattaaagaaaagcttcattggtaaatgatgagaaactaagcaactgacaaggatgtgtaagatcataaaattggggagattaaaagcatgacagcaaatctgaaagttctatcaggcttaacatttgtgattgtctcatgaaatgtttgatacgaagaaacaaagtacatcactgatgtgcgtacggcgtaccatctagtgccagaatgctaggaccacagcaatactgaaaagtatcaacaaagcaacattcccaccaggcaaaatatcttcacatgaaccagacgatctgtatgaagaaacatacacaaaactggtcattacacactaaaatgataatatgtcgaacactaaatcatagaacaccaacagtttagaaactcaagttttttttgtgttactgtagttttataatattttatattacaaaacataacatcatttaatcattttaaaaaaacatgtcttgcatctggaaccaatgatcctatgtcacatatattgcatcatgttactcacacacacataagataagatgtgaaacaaagtcaaagatatctctggtttgccaagagaatgaaagggatggatagctacttaattttagaattataaagctggcttggttgttactaattcacaccagtgactatcatagttcttgaagagtgacaggtttaaatctagaaaaaaggtacaactaatgtctcgaaaaccatgtgattgtattgacaaaaggaggtgaaatgtcctatcttgaggctaacttgagtagtaataatggtttgttacagatgtgaaaagaatgagacacatgattcacaaagaaagtacatcaatagtgatgttaagaatgatattttgagctggaggttgtggacaggcccaaagctctgatccttgaataaaatgcatgatttagtgccttccaatggttttcgtattcagtacatgtcaatcttgctttcaatccctaattgttacttttacaacctcttttttaatttcctacttgacccagtacaatatgaaatttcagtcttgtattttgtcataagttttcttagttaccatgcaccatgctg

SEQ ID NO: 81150 - DNA, 5308 bp, Oryza sativa
gggctgcgccggtctgaccgcgcgatacacgccggtctgaccggcaaccactgcacggtctgaccggaccacatatccagcagtacctatagatcacctgtgaaatccaatcatctccaaaaccacttcgcaaataaattccaaatatcaaaaccaataatctctccaatgccaattgttcatcacagaataataaccaaaaacacctttgattttacaccatctctacaggacaacctttgaagggagatgacgatcgccggtgattagcatatggcggaagctgtgctccagctgtttgatccagtacaagaaagatataagagagcaattcatttcccctttagattagaattgaaggtctaatgtaattcaccacaacaaattcatagatacatacagagcataaaacatcatatataatcttagaaagcaagtaatttttaaatagatagagatcccaccatatgtaaaaacacaaaaaatcaagtgagcattggttttttttttttgcgaagggtattatttgttgttgatttgtctgctacattgatttatcctaatactttcaagtaggctagctgtccaacgagaagttatcaagaacagagtttcaaattttagagtgcccactctcagaaaacaaaaaagagagccaaagcatttcaggtggaactgatatagtgggaatttcggtcgaaaattgtgaaccgtggaagaacactgtcaaggatgatttgtatggtgaatggtcaaacaattatcttaactgaagaccctaacacaccatcatttcggtgacttgtaggatcattcctgttttctgataggaaataatcagatggttagacaagataaatgtagagaagctactcatcacctcatgtgtactccccgtttcacaatgtatgtcattctagcatttcccacattcatattaatgctaatgaatctagacatatatacatatttatgttcattagcatcaatataaatgtggaaaatgctattgtgaaacgaaggaagtatgtaagaagcacattctttgttggaacttcgccggtatgactcgagtaaaagagagtcagataggattgggaggaatctaggaattcaaattctcaataaaccatgattgtggtagttctgctattcatgtttgtgtggtagctaagtctctttttacttacttggtccaatatagcctatagctagaacccccatggcatgcgctcacgttgtgtcgtacgagttgagcatgatcatcaaagtttcacagaagtgatatttgttgccatgatttgttctgtagaagtcaagctgattcagtttgagttactcagtttagaaatcaattactgtgtctgtgctacccatatatgaacatataaagccattgggttggttgcaaatatctgttgttgggctacttttcttggctcttatgcattatactcgaagattttcttttctttggtctttattttgtgccatgaatcagctgcttatattggccaggtaaaccctctatgccattaacatgtcaattgtttttccaagtaattcacaaccgcgtagagaactcgaactcctcctcaatatgagttaggaatatacatcgttatgtggatgcaaatgatggtgtgctacttatcatgagcattccaatttccaagtttccaacatttgggacagctgttccttggctcatcattctctcgcaggccagagcgtgattgttcatcttcctactcatctcaactccatcacaatgctgtagatgaaggtctgctctttgatctacacaataggaattagaatgcaattcatttcctctttagatttgaattgtaggttgttagcatttggggatactctgttatgtactctgtttctgtaccctgtttctcacgtgactagttcagctcatgtgagcacgacattatcttgtaatgacctgggtgcatgtgtggatcccgtgtcgggctagcggtggttcaattgtacacaggtcgacacatttaaatactctgggtgccattcaggccagggttatgcaatgagaaatcaaacaaaacaactacctccctgtctctgttcttcttcttcctcctaactacccccaaatcctctcgattctaccccaatccgatcacccctaaagctggcaccacgccagattgaggaggtgttcgtgacaaatctggtatcagagctgtcgttccttgcgcgatctagcgaagaagaagaatcagccaaccctaacagcgaggatggtggtggcggagggagagatcggtccctggggtctcgcgtcaccaagctcacctccaacctcaacaacatcttggggtcactccaaggactggagaaatggattccgaatgtggatgcgggcatcaagtctctccatcaagctgtggacgagatttcctcgcgtgtgacggcgttggagacgaagcccgcggagtcgccggcaacggcaactccaccacccttcgggcacggcgtgaacgatggctaccaaggtgacacttacgagatccctgcgatccaggagcgaaccctggtcaagggtaagcgactccaccagatttctccaattacttttgatattggggagagttcagagaaggggaatttccattcatagagtagtggtagaaatgggggaacaaggttacctaaaaccgattttcctaagtttgacggagagaaccctaaattgtggaaaatgaattgtgagaagtattttagcatgtatcaggttccctttgacacatggtcttcctttgctacacttcacttcattgggaatgctgccttgtggttacaaacatatgaagagttgcattgtatagagagttgggcagagttagtcatggcagtgcatagtaaatttgggaaggataagtatcaggagtatttggaagaattagaaaatttgagtcaagtaactagtgtagagagttattacagtaaatttgaggaactcatgcataagttgctagtttacaacaaggggtttgatgagacattttttgttaccaaatttgtcggtggtttgaaaactgaaataaaggcagcaatcaagctgcataagcctcgaacagttgatgctgcgttgtccttggctaaaacgcaggtggaactacttggggaaatccacaagaagagttatcaacggcactcattcaaggaagttttcaagccggttaataagatgccatttcaagggaaagggattttgggagcagctcctgaggataacaagaaagctgaagagaaatcaaaatgggaggaacaatttgactctttaaaggcagcaagaagggcaaggggtgagtgttttaaatgtggggagaagtatgggcctgggcataagtgtccgaagtcagtgcagcttctattatagaagaattgttggatgtatttcagcttcaggaggatagtaaatctgaagaaggggatgcagaaagttcagaggaggaattggtattgtctgaatgtgcagctgcaggcacgatgggcaggaaaaccatcaagtttcatgggtaatacaaaaacaacagttgcttatcttagtggactcagggagctcaagtaattttctagctgaacatgtggtcaccaagttgggcttacagtgtcagcaagtggaaggaactcaggtgacaattgctgatgggggcaaattattatgcaacagaattgttcctgcagttgagtggtggtgccagggtcaaacctttgtaacagacttcaaagtattgacactgagtggctatgatatgattcttggtatggaatggctggaaacctttagtcctatgtgggtggattggaggaggaagaagttaaggttcacatatcacaaccagagactgacttttattggggtcaaagatcaaataaattctggcaagttgattatagcaaaacagatgcaagggctctacaaggatggcgctattgcccagattgtgcagttgtgccaggctgaggttccagcacatgcagggcagacatacccagctgagattgatcaagtgattgctgaattcaaagaaaggtttgatgagccatagggtttaccaccccatagacagtttgatcacaatatccctctactacccaatgcaaagccagtgaccaagaaaccatatagatattctccacaacagaagaatgagattgagaaacaagtgactcaaatgctccaacaaggtataatccaatcaaatgtcagtccttttgcatcaccagttttgttagttaaaaagaaagatggcacatggagattttgtattgactatagggggttgaatgagatcactgtgaaaacaaatatccaatgccagtagtggaggaattgttagatgagttggctgatgcccaatggtttacaaaactggatttaaggtcaggttatcagataaggctaagactgcatttagaacccatcaggggcactatgagttcaaggtgatgccatttggccttacaatgctccagccaccttccaaggacttatgaatactatattttctgcagtgataagaaagtttgtgttggtctttgtagatgatatactgatctatagtaagtctcttgaggagcatgttgatcatctgagaacagtcctttccgttgctgcaacaacatggtctctttgtaaaagctagtaagtgctcctttgcccaacaacatttgtactacttaggtcacgtcattggaattcatggggtatcaactgatccaaagaaggttatggctgtacaacattggcccattcccaagaatctgaaacagttgaggggatttcttggcctcgcaggctactatcggaaattcattaaggggtatggtattcttactaaaccgttgacagagctattgaaaaaagacgtcaaacacaaatgggagcaacaggagcagacagcttttgatgcagtaaaaatggcattgactcaatcaccagttctagctttaccagacttttctaagcaatttgtggtggaaaccgatgccagtgacaaaggaattggcgcagtgctgatgcagcaggggcatccaattgctttcattagcaaggcattgggtgttaaatcccaaatgctttccacttatgaaaaggaattcatggcaattttgttggctgttaacaagtggaggtcttacctgcaacatgctgaatttgtcatacaaactgatcacaagagtttgacccatttgaatgagcagcagctgggtacaagtatgcaacagaaggcttttgtgaagctcatgggacttcagtatgtgatta

SEQ ID NO: 81151 - DNA, 9762 bp, Oryza sativa
agatggctgattaatctctaagatgtgttcctgttaatcttccaagctttggaataatcactaacggtttatgacttcaagctaaatctcagactctgaaatggttctgatagaaccttcagatgttataggggtcaagcattggctgttctgtagtagaagtgtgcaataattctgctatatattatcagatgtaaggaatgtatggaataaacagtatgaaatttgtttcaacaattcatgcatattacaaatggacaacagtttccgtggactaataatgaattctctagtaaaaaagttaatgttcaagttttacactatcaatcaaaatgcacacagtactcccattttgccagcctcgtcttcgaattcattgaaaatcaaagagctaggagttaagaaaaaagaaacgtcagggtttttcagtacttatcatgaaacaaacaaatgatacccgtgctttaatgtggaacatattgataaatatatgttaaatattataaaatgatagatagatttgttaaaatattgctaaaatatatgctaaatattacaaatacttgcatgccaatttgtggaaattaaatagattacaaatgatgttgcatgtttgcatggggttaaatatgtagttattgctagtgggtaatgatgtgacatggttgcgtgttgagatttagagttaatgggctgtaactttatagaaagtataggtcaaccccttcaggatatagattatatataagaagaaagtcacaacaaacgacacaccacgtaattattggaataaatgggctaggcccaatttaattcaattaaaatatcaagagcccacaagtaatgttagagacaataatactgtcttgaaaatttaggtggaagaacctcgacttaaatagggtgatatggagattcactgttgaccagtataggtgatggttggactgccacgcgcgcacgtgccaagtgggcctcggccgtgggcgtggcgaggcgaggtggccgaccgagctgagcctgcctgctgctcttccgttttgtaacagatgagaataaagtcaccattaacaaatgaaattcattgtgttataacctccccaacaaatgagagattcattgtgttataacatccacaacaaatgagagatttattgtgtggtaaccttcacaacaaatgagatttattttgtggtaaccatcacaacaaatgagatttatttgtgtgttaatggagatgtctctctctatatataacgcaaggcagaggctctcaaagattgtgtcttcctcctgctgttgtttcttggcgatactctccttctgttcctgcgttgtctctctgtttccccagttctgttcgtcccgcatgcacgggtgatcggaacgagcaggtgcctccaaaactccgtccgcttgagaacctgaacgggtaggcgggcgatcaagtttttgggtaacgcttcaagcgcgactgctctgcatcatcttcaccaacatattgacaaccggcgacaacaacaacactggagacaaggagaaggagcctcccgtcaacaccaacggaggcaatactgcctcaaactccagcggagggctattttcggggtataacgtttcactattaccattcgttcttcgtttcctacaactgtcagtcgcaatattattgcgttctcttatctatgttgatgcttattctatattaaacatgctcatgttgtacacatctagcactgccactaaatctactcaaattacaaatgtcatgtttattgtcttaatattttagattaaaatataccgaattatgaccaaatttccaacagtaaacagataacctccaatgaccctcattcttgccacattgaactctcactcacttccaagaaaacaaacattgagaatcttcactgaaactttgaaggcatctggaattcctagcagaaggaagatgacagtgttgctctctagccatttgatacctgaactgggtctcagcagataggactgagaatcatcaggaaatttaccctctcggaaatactgtttactttctcaggaaatttaccctctcggaaatactgtttacggtaggttttttgcacaaaattaggatgtgatttatactataccgcccattttgtctcaagcagccatatgtgcccgaaggctgttctgttttacctaaattgtatcctccttgtgagggattcatacaatgctcaatttggtcataacctactgatgcagattggagaggttaagcttttggcttagccattaaaactatgcacaagtttagcagcaagattcaaactaatagctagttgtatgaaattgcacacgaagtaaatttagacactaaagtaggccagagagccagagtacaagcatatcttcatgtttaggtgaaattcatttttgttgttgttgtatattttgcaaatgcatatgcgaaccacacaagtagccaactcaagttcaatgaagccatagcacactatccatgcatgttactgtcttcaaatttaactgaaagctttgtactgctgcactttaaagcaaggttgcattcagtgaagatcactatattggagatcacaccatggatgaaagaccatttatatagccacatgtgcttatttttctcagtaacatatcttgttgtaagcaatccagactgttgtaaacctgcatggcaatatcaattgctgcttcagtcatatgctcatagataccaaaattggatgtaaggattgggaatcatcagaaaattagccctcgtaacattgggggagaagctgcgaaaaaatttctatgcaacacggactaatccctcatctctggaggcctcttctggtattgtgacaggtagctgacgaggatcttaaagcaatctccttcccaccactcatcctccggcctgcgcgcttgatggacgttggtgtggcaactgccggcaccaccggcctcctgccctggttctggtttgtcgcttcatggatgctgcccatacttctacattggtgaaatggggctttctcccccactggaaatatagtcatatataattcggcatattttaatccagataaataacatagtaagcatgacatgttaataatggagtgatccaatgattagtactaaacatgaacatgctaataacagtaatagcatcatctagtaacatatttaacactaatatgagtagagtaatatacccagtgaacactcgagagaatgatgaggcattggtgttgcctccgttgatgttgacgttctcggttttgcctcctacagtgctaccattccctcctcctccagtagcactggcaccgggtagacatgacgttgtagagagagaagaccttgacaaagaggatgcagtaccgagagtagttgtgcgaagaacacgctcccaaaaacataatcgctcacctaccaatgcaggttcttaggtggacagagttccggaggcctgctcgttccgagcactaatgcgcgcaagtcctcaggtggacggagttcgggaggactgctcgttctgagcactcgtgcgcgcaagtgctcagaactgaggaaaagcagaagtagtgcaggaacagaccagaaggtgtggtgtaccgaggaagaataggaggatcataggagagatgaaccgagaagtgagttctttctgtctatctcagaggaagtgataaggatgcgcgagagacagaggaacgttacaggtgtctatcccggaggaagtgataaggatgcgcatgagagagaggaacgttacggccttacggggagttcatagcgattaatgatgatgatttcgtccattattggagaaacatcatcattaatcaccgtcggttacacctttactttcagtaacatcaccattaatcactggaggaggaatgttacggggagttggtgtggtgtaccgataaagaacgggaggatcacatatgagatgaaccaaaaagagagttctttttgtctatcccggaggaggtgataaggatgcatgcaagaaagaggaacgttacagggagttgacacaatttattaatgatgatgattttgtctgttattgaagtaatgtcatcattaatcgctgtcggttacgcctttgctcatcaaagcattatttatgatgatttcgtccatttttgagtaacgtcatgattaacgccgtcagttacgcctttgctcatcaaagcaaaatgttagggagacaggtagccgtccgcaccgcactgcacccatgcttaggcctcggccatggcttggcttgacgcgcgcatgtgtggcagtcctaccatcacctcaaccgctcaacaagtgctctgaattagcagtgtatataaggtggtattaatcctttaacattatttgtcggcccatgaaatttactaagattaaatggggcctagccgatttaattctaacatgatcatggctacatatactggaattcaccactgcaccactatcaaagtctgtctgcagtagtggatataggatttcaagctaggctgtgtattcactcaaccattgccgataaaattcatcacagggaaataaataatgttaggaggaggaatttctagataatggaataaatatctcggtcggcctctacatcttgcgatatcaatgaacacaacctcagcaaccacaccatgaaacagtaaacaatccaatagaaacaaacttcttaataataatcacttgtccacaaatcctatgttattatgaagtaaatgcccactaacctctaaagttcaacatgcaagcatgtcatatcatcacccattagcaattattatctagagtattttaaattacatgccagtgtaccatattatcacccactagcaattattatctagagtactttaaatatcatacaaacatgatatatcattttcaattttgttatatttttagagcttaatatgcaagcaatgtcaaatcattatctccacatcattttcacattatttcatcctatacatatatcatatctgtaatgtataacatacattctttcacatattccgcaacaaagcgcggggtatcaactagttctattaataaacttccacccatgattggtggaatgttcccatcaaaagtttccaaatgaaaacgcacacctttatatttccattccaccttttgtatcaaggataaagaatgaatctagtgagtaaccttgagattacctgcatggcaaaagtttgtacaggagatatattgcatattgtagttgattgtattgagcttcagtggccagtgtatatattgggtacaagagataaggaagactactatacaaatcaaccatattataatatctttctaactatcatatactctaacatcccccatagtccaagcatgagcagcttagacatttagagacttagactggagaataaaccggtgatagtgctgaacgatacccttgtgttgttgtcgaggggagccgaagtgaaggcacggtggagtcatgattgatgtagttgtgtgcagagtagccatgatcaaagtagccagagtcgggttgccgatgatgtgcgaggtagccaagctataaaggcacaaggagcgccatggagtggccatgttggatggtgtcgtggaccaaggtgtgcgtgaggactcaccaagaacgaagatggtgacacgatcacagtattcgctgaggaagccgactatgcattgctggggaacccatctttactcccggtttgcaaaccgggacctcgaatccgggacgatttttttattttttcatgttttttgctgcttgcatattgatttccataaatcgagttgctctctacatccgcaaatcaaagattcacagataacatcacaaagcacaaataacatcacaggtccacatcacaaattctcaaaaaaaatacatcacaaattataaaaaaaatacatcacaaatgcatcatagattcacatcacagatcaaatacatcacaatttttttaaaaaaacatcacagattcgtatcacagatcaaatacataacaaattctaaaaaaaagaattcctggtgctgccgcctgccgcccgctgcctgctgcgtgccgacgtagagggaggagtggacgaggaggagggcccccggcggctcggcgagccgtgggctgctgcctgccgcctcccatccgccagaggggagggtgctaccacccgctgcgtcccgcccaccaccgcctgtcgccactcggctgagggctgacggagtggaggaggaggaggaggggatcggaggagaggggagaggggaggagaggataaggaagatagagagagagagagagagagagagaagaggatgagaagataaggtgcgcggttgcgatgccgaggagataaggaaaagagagagagagagagagagatgccaatgacgtgggagagatatttatcaccaaccggaactaaagtttgttgggggcttgatagctattgaacaggaactaaagatcaaaaagtacctataggcttttgaatcgggactggtgtgatttttgcatgacccaacaaagatcacttctccagtagtgatggaaccatggaggatgagacgtcaccgggcttgccaaaattgggtgacaacttaaaaggaaggagcacaatggtgttgcaaataccgtgtgaacgaggtaggataccagcatgaaccttacaaaattgtcgaattgaactagaagagaagacctccaagacagttgcgcagtggtgttgccaataccgtgtgagcaaggtaggataccaccatgaactttgcacaattgttgaagtgaactagaagagaaagccaccaagacacttgtggtgcacagggtgatgtaaaggtggtgcacaggattaggaagaattaggaaatgagctctcgcaccatgggggggattttgacagttgagtttgtgcagatctatcaaagatgccaaaccaagcctgccagccagtgaacctgcgaactcattctcaaaatactctagaataagcagaaagataattatccaccactgggatttatgcaggttgagagtgatttactgaaatacgccatcataaagaaaccaaatatcaatgtttttaatacaaatattaatgccagattcataaacatggaaatgcatgatggctcaatcagaaaactgattaatctctaaggtgtgttcttgttaatcgtctgatattagtacatattactaacggtttgatttcaagctaaaccttggtctccagaatggttatcaaagaaccttcagagataaggggtcgagcattagctgttttgtacatacaagtgtgcagtaattctgctatatatattcttttgaacaatatgaagtttgtttgacgtcaaggaatgtatgaagtgaacaatatgaatttcgtttgaacagtgcgtattcagatggatcataatttccgtggactaataaggaattctgtaatagaaaaattgaaggttcaactatgatttctttgttactagcaagagaactggtacttctgctatttgttaccagattttggaaaccaaaatatctgtcatgtaggatatgtgtaggatccaaatttgatataatcgatcaaaacgcacacagtactccaattttgctaatgtaggatccaagtttgagctgatcaatcaaattccttggaaatcaaagagcatgtggtgttcctgtctttatttaaataagtgctgtcaggagccagattatgaaatgaatgtcataagaatggacgcatcatatagacagtgaatggccattatatgtaccaatgccctcatctcttgccacacggtgaacacacattccgaaaaacacacatcaagaattttaaatgaaaatttgaagcatatgaaattcccagcagaagaaggtagcagtcatgctctagccgtttgataccccaaatttgtgtgagcagttagcactgagaatcaccaggaaatatatactcagaagaatcttgttaggtggtgatctgaactataccatcagttagggatgaatcgaggttactacaaaaagaagtgttggactcaagctgccatatctgacccaaggttattcagctctgatggttgtttgtatgccaactgtcatagcgcattggctcatcccaattcgttgaggacatgatttgaaagcttaacaacatttgggatcttcaaaacttcaagatggcaatcgcccagtgatggaaatattaagctcttgtggtcgagccattaaaattatgcacaagtgctagcagacaaattcaaactaatagcctgatttctgagattgcattcaaagtaaattaaaacacacgagtagtcggagagtcggtacaagcatatctacgtgttttggtggcacttatttttctgattttgtagatttatatcagcatgtgaaccaagaaattatctaactcaaattcacacatggaggtgtgcaattcaagtgccaaatttcttagttgtttaacagagaatagcattcgtgaatcatgataggctgaagccttgaagggatggaacacatggagcaacgcaagaaacaaaactcaagtattaatttcacttctgtaaataactcgttagttccacagtaattaatctgccaaatctctccagtttcttgattcatatgcattaaatcagatattttttttaactttgatctgtaaatcctctatgtcagtaactttgatattgtagtttttcaaacacttcacaaacgcggagaactcgatcaaatttgtcctcaatttgatgcaatcattcatggattgggatgcgtcaggaatatgctcccatcatttcagggatgcaactgacagtgtactgctgactaatattccattcccagggaagcaccacatctagtactagcttgcatcactataatcgccaaccataggtagcttgttgatgtttcaactgatcttaaccagatcactataattgctgtagtggaaggactaatgcaattcatctctttatatttgaactgaacgtccaatgcaattcatctcagtcgattcagagatccaaacagagcctaaagtatcaaatgtttgatcgtaataagcaagtagtataaatagatacagatcacaccgtatgtaaaacacaccaaaaaataaaaaaaccaagggagcatgttctacaattccatgtaggccagctgtccaattccaacgtgaagctataaagaacacaggggtttttaattcctgagagccaaagcattttggtgtctaaaaagttcaagaatgttgctccaagaaagtttaagaacacattccaacatgatcagtaactaaagcacgaaacttgaccagtctatgtataataccataccaaacgatgatccattgtcttttaacgtttcaaagcaccctctccgtttcagattataaatcatttgactttggtcaaagtattttcaagtttaactaagtttgtaggcaaatatattaatatttacaatactaaattaatttcattaaatatatttttataatatatttgtcttgtgatgaaaatataaattcttttttctataaatttgatcaaacttcaaagtcaaaacgacttataatctaaaatggagggagtacttgattatggtttttctttgtcaagatttcaaataaccgtttgacaggttgcacatttcactatagacttgtcaatctcaaatacatgatgtt

SEQ ID NO: 81152 - DNA, 9233 bp, Oryza sativa
cccgagacccacatgcccgtgcccgacccacgcccgccagctctatcgggcaaaactccatgcccgtgcccatgcccgacgggcacgggcatgcccaacgggtacccactggataccacaaagttaaaaacaaatttaatcacagcaaaaccacatgtacacaacacaaaatttcagatctggcattcacatacacaaaatcacaaatatacatacacaaatactaagatacacatacacaacatcaatttcagaaaatgcttgccgtcatctgtgcacagccaccgccgtcgtctctgcgtcaccgcgccgcccctcccgtgtgccgccgccgcccctcccgtgcgccgccgccgcctgctccctcccgtgcgccgccgcgccgtcgtgccacccctcccgtgtgccgtcgcgccgtcatctgtccgccgccgcgccgcccctccgcgccacccctcccgtgcgctgccgccgtgccaccccctcccgagcgccgccgccgtgccgccccccaagcaccgtcgcctctacctccgcctcccaacgccgccccctcctgagcgccgccccttcctgactcctgtgcatggtgcgccatgccgccgctagacagagacagagagacacgggagggagtgagaactgagaaactagggttagggttaataagttgtgaaatatataccatctgataatgggccaatggttgggcctaactcctgaggagggatgttaaactacaggcacattttcgggtcgggcatggattatccacgggcgaaatgtaaaacccggctgtgcccactaagttagctggtgtcgggtcaggcgtgcccacggacaaaataacgcgcccacgcccatgcccatcgggtcgggtatccgcggatacccgagcccgtgggcattactaccatccctaccaaagctgctactgttttggctccctggtaggccctccccctcgcctcgttctatctttctcgcactagctaacaaatctctgacgcattttgacaaggaacacgtgactaactttggatccacgttcctcatctgggcacgggagagaccgacgtggctgggaatattcgagttgaagggctgaggatgaatgccagcggtgctcactataaatgcccttagtgatctcgtccaattattaaaaaaaaaatcaaatactctattcctaagtacaacaaaatcaaatcgtaaacaaactactaataaaacatgggaactccaattcagtgactttgtgcatgttggccaattgatttctctactcttaagggtttgaatgaatttaggtaatatttttctcccattccatatagaaaatgaactaattcgtacaaaattcagttagaacactatacacttgatcatcaacattgtgatatctcattagccgtatatccatgaagatcgtcaccgactaagttgcagttagtggccaaaataatatctacattttggagagaactcgctcactgtttgctgcccagatgcatccatcagggccatttcactctgctatggaaagatttatgcatccacaacatgttgtaataatagcttaggcaaaatgatattcaaagcctaagatgagaaatcaggatttatgtcagcatacaagaaagcattatatccacccaaaaatttccaaagaaattagctttgtccatccatgtccagcacatcattaagcatgcgtgaccccagtactgccactctatttcacaataatacaaaagatcttgtttacaataacataaaagataacattaacagtgtagtctgcatatgacattctggacatgatacacaaccaaatagtgtactctgcatcacaacaagaatcctactggcaatgtgaaatcaagccaccaattcacccaaaacagaactaaccacaaacatcacatgcattgctgctacaccgcaaagatgatacataatgaacaaaaactgaaccatgcgaagtaagctgaaaaatagttaacaagcgcaatgaacaatccatagcaacacccaaaaggcaaaactgcatagtgcaaacatgaccatagctggaatgaactgatcaaaacttttcgcggcacaacagagtatatcgattggatgacagccaaaatttcagtggcgataatagtttgtaaactagcatacatcatcatgtatgtggcatgcctcactgtaaactaacagaccaaaaaagaattccgatacaagaaaagcacctgttcatctactggcaagtgcaagcatgggtgaaatcatcccttggatcccctgcaatgtgtgctgtatctgaatctcctctgcagccatcctcttaagatttctaacacaaccccttaggttctcatctgatcggatatcatccgcgcgcatctccagcaccttgtttgccacccccatcaagaacctggcataccttggcaaggttgcatttcggtgcaggaacagcaggagaagaacgagttcttccgtgtccaagttctcgatgcatctgaccagctttctccttgaaactagctcctccatcaccgccactatgctccttggattgtttcgagctaacgctgaaactagagcatccttgtgcctgaacttcctcagcaacttatcgtgttcagcaaccttcaccttcttaggcttctcaatcacaaggtcaccttccttagccttcgcattttgtccacggaggaagtacctatagttggacggtgccaaccgccgcttctccggcttggttggtgcccaatcaagctcaccaccaacacccttaccctcttcctcgtcctcccctgtcgacttctttttcctcctacccatataaattgtgccctttgaagatccagcaaccagcactgtcccacacggcgagcacgccaaggaaagcaattccttaggatatcgcatcgagtgcgtgagcttaagctcgccataatcaaagctcttgacataaccatcactccccgcgctaagcagccgcgtctcgccggtgttggtcatcttggcgagcgcgagggccatcaccgtcttgacatggctctccaccgagtggagaagccgcccgccaccaatgacatcccaaatcctgacgacgttcccgccggctgtcgccagcagcccgccggacggcaggaacagcacgctctccaccaattcgccatgggagaaggacagcgtcgacgtcttccccatgcgggcgtcccacaatttgacgatgcggtcgtacgagcccgtggcgaagatgttgtggtcggcgggggacgcggcgccggcgcggatgtagtcgcggtgggcggcgggggcggcgaacacgggcgtctcggatggcacgtcccagtaggcgaggagcgcgtcgtcgccggcggtgaagaggtggaccttgtcgccgccggcgacggggtagcggacgacgcgggtctcggcggtgtgggccgtgagcgtgcggagcgcgcccgacgactgcttcttgtcggcgcggaagacgcggacgacgcccttcttgtcgccgacggcgaggagggagccgtcggagcggaaggacggggagaaggcgacgtcctgggaggcggggatgcgggggagcggggagagcgggtcgccggagaagaggagcacggaggtggacaacgaggcggcgagggtgggggccgacgagggggagaaggcgaggtgggtgacgttgaactcgttggcgggggtgagctcggaggcgcggaaggagcgccagtaggaggcctccggggagaggcgggagggcttgcggccggaggggaggagggcggggttcggcgccgccgggaagaagggcttggaggtgtcggcggccatggcggcggcgggggcggcggcggcgagtgaaaccctagtttgtgggggagaagtgggggagagggggtttatgggttttggactttgttgcagatgggccgtggagtggaggaacgagttctataggagaaatggcgatggatggacaggggaattttacaatttggcacctgtttctccctcttacagtatgccaccgagaagtttgaaaatttttggaaactactcgcaggagatgaagttctttttctatattgataccagaaaatatacccgtgaattgcaatgagggaaggctattttaatcttattattgttatatgatttaattaaggtgaaatttgctgtgttaaattcgcttggatatattttttttatagaaaattatgagctgcaattaagagtatgatcgtctctaaattagcttatgagtttttttaaagagatttgttataagattcattctgtatttcaaaagcgaatgaacttttaaaaccgactcctatacggatgacgtatcaaagtaccggcaaaaacatctttaatttttataatagtagagataaatagtatggagaaaaagagaaaaaaagtttaaaatggaatagtcaaaagaaacaatcagatctatttctctctacttgtctatttttctttctgtttcatagtcttatacgcaatcatttgcgtatgaaaaaaacaatttggccatttggggcatgaaacatttgtggaatatgagaaaaaaagtgcaacatctggatataaaaatgaaactttttgagaactggcatataaaataaataaataagttaaaacaccattaaattcaaattataacatattggtctcacacacgctacgtatagttgcaacgttggaatcatcaatatatttatagagaataccttcttcctaaccaaacggtttgagcccaagatcgttttctttgaaaacagaggaaaaacaagaaaccacagtccgacataacacaacttggaccccaatgtcactatgtagggcgacatgggcaatgaccaaactcactctaccgccagccctcctcccgccatccccttcctcgtaaccgccagagcatggcagcagccgtatgtgcagctacaaggacggtgacggcgggcctctaatctatcgttttccattcctccccatcctcgagctccgtgaggccacgacccctatgatgacgatggtgattgtgatagggatagccagatctggagccacctcgaccggatacaacatctccctggatagatccggcctagatcccacatccctgattagattcgtgcgcagtggaggtatcgaaagaggcgagctcgacaagcaaatgtggtgacatcggtggttgggtggcatcggtggtcagatgtatggactatggtggtggcatgcctgagtgggagaggccagcgaggattggtcggaagaggcggtgacttctcacctagacttgttgtctccgtcgactagatccgatacgggacgacggtctagaacgaggaaggctggcgagggtgtgcttagtgggtaggcgggggcgaggttggcgattgggcggctcagacagtcatagtggagatggcggtgtgcttgagggggcggcatctgatatggaggcagcccatgaggaggttgctgagggcctataaaggggtgttgatgtggtgactatgtgctggtggtggtcgacttggtgcaaggtagctatgatgatggggggagaagcctctaggtgaaagcctagctcgtatttctatgagctggcaacgatgacgttttgggcatcacaatccctcgtgggggtgttgttgagatgtctctttccctccctagcaaagcactttggatgaaaaccttgcccaagttctcttgggtgggagacggcaatgctctcagtgtcaaagccttacaggaggtgtcatctttggaggcccaactctgcagttccttccttggggtatctgttcgcctaggacaacactcttcaaagttacatggcggtggacatgtgcgatggatgagcgaatctttcttctatgtcgccctctctctctacactcttaggctatggtgatgactgggagccttgttttgtatggggtgggcgatgggtagtgcttttgtggcccttgctctcctggcgacgagcggtcacgtatagcagtggtcagcttggtgctggatcccttccttgtggtcaggtgtgaggttgtatctggcacatggtatcgtttgtttcttttctttttcctagttatagcatcccagggctttatagtacaacattttatagcaaaagttgcattcaatgaaatcacaatatttaaaagcacatcatggaaccagggaatcatgcttactctgtcttcagcaacatttttgttgtgaactctcatctatagtgcaagcgatccagaatgtccaacctgcataacaacattgctgctcccagatctagccatatagccaccaaatattggatattaggattgagaagcatgggaaaattagccctcgcaaggcggtagagaggatttctacaattgtgtttttgtgtagctaacaattcaaccaggcaatctctccactttaggcagatatgtgaaaatgtcgaatgatgcctgcgaaccactgaaatggtgaagtgctgctgaaaaaacaagtagaaaatgctgaaagataattatccacataggtttcatgcaactggacattgaacatctgaaatacaccaccgtaaagaaaccaattactggtgtctattcggcaatgtttttaatgcaaactctaatgatagtttcataaacatggacatgtacaatggttcgatcatatataactagataatctctaacatgtgttcttgttaatcatataagtttagcaattattgttataaaaaccggtaccttaaactacatcggagaccaaacgcggaagaatgccataaaagatccaaacttgatgacaattctgaggtacgatatttgttaacatagttaagtggaaaccttgatctaccgtcgacagccatcccctattgcatatgttaaatcgtcatgtggttacaacatgcatgcctctctatttaagagagagcataggtcagaatccgactctactactagcctaatacttagcataactccaaaccctaaactgtaacgactttgtgcacatattggataaaaactctaaccattatcacaaacaatttatgatgtcaagctaaatcttagactctgaaatggttgtcaaccttcagagattaagggcttagcattggcggcttagcattggctctttttcaataccattggaatactctaaaataaagtgttacaatgatatccgtgtgcttacaaatttatatgtgaacgtaacaaatcccaaaaggggtggagggccggctgggatttttatttatttttatttaagttggggttgagaagacctataagttatctctaacaacactcaaaattatgtccgttacatatgagagacaattatcggtaacgggcttagagccattacagataggctcatcaataacagcttcttcttttttttagataatgaatcaataactgcttcctaactgagccattgcagatagggtggataatgtctgtaacgactcctcatcaactgtccattacagatgagtgttaatcctaatggttcagatgccacccgttacagatatgtgatttgtaacagatcgttatagatgtgagctagggtcgtctatgctagtgcacgtagatagagaagatccattatatttgtaccaatggccacacagtgaactctccttcacattcaggaaaacacacattgggagtttccaatggaaatggcaagcatatggaacttccagaagagaaagatagcagtgttgctctatcagttagtgatacccaaattgggtctgagcagttagggctgagaatcaccgggaaattcaccctcaccgaattattatttccagtatagttgttgtccataggtaggagatgaaccgtaaccgtccgttagggatgaatcgaggatattagaaagaaatttttgttggcctcaagcgcccatttctgatcctagactattaattccgttctatcgaggttgtagtgatcttcagattgttggttgtctgtcaacagtcataggctaacaatatctgggatcttgaatactataagcgcagttgtaccattaagaattatgcacaaagtggtagcacccagattcaaaataatactacctccatattttaatgtatgaccccgttgactttttatctaacgtttgaccattcgtcttattcaaaaattttatgtaattatcatttattttattgtgacttgattcatcatcaaatgttctttaagcatgacataaacattttcatattttcacaaaaaaattgaataaaacgaatggtccaacgttacttaaaaagtcaacggcgtcatacattaaaatacggagggagtatatagttagttggaaggttggactcaaagtaagttaaaacactcaagtaggccagagtatgagagacatatcttttatttaggtgacatatttttctaacttttgtggatgtatatcaggatgtgaagcacaaaattagctgcagcacatggtggggtgcaataatgcaggtgccaaattacttggtcagttaacaatcaatcacactcaagagatggagcacaagaaacaaaactcaacgcttgggaaatgctattataatcaattaatccgaattccgtaaattacttgttaattcccaaattattttctgaaatatactataaagtttcttgatttttttaagatgcattaatttgacatattcttaagtttggtctttattacgtgccatgaattttctatatatatattgttccgttgaaccctctatgccaataacacgtccatattgttttttccaagacttcacaaccacgaagaactcgaattcatcctcaatgcgagccaatcatgcatggatttcaggggtgaaatccgtgtgctgcttggcattccaattctcttgaaggcctcatctacttcatcgctgtatcgccgaccagcttgatggtcttgctactagatctcgactagattgcagtcctgtaatgtggaaggggtgtgctcttggatcaacacaaaagagtcttcaaaaaaaagattaatagctgaaaaggaattggagagcaattcatttccccacagtatatctgaattgaatgtccaacagaattcaactcggccaattcagatatccaaaacgaagcctaaagcatcatgcatgtaggtgatcttaataagcgagtaactcgaat

SEQ ID NO: 81153 - DNA, 11583 bp, Oryza sativa
attgtatttatctgaagactttcgattgttctaacacaatcattgctgctactctattattttttatttattttcactattttttttaattttctagaaacgcatgatgctaacgtgaagtgacgactttccctcgttccgactctgtagtggattaattgtaatcctattgttttagggccggtttggattggattcaagccaaaacgtgccctaccaagattttgggtaacataaatagtaaatgtgctagtttggattgaagctaaatagttggtagtgctcatgctcaatttagctatattctaaaatcttcttcacaaccctactaaaatttgattttatattggtatcaaaccaaatatagattagctaattttgccctacctaaaaattggtagtgccaaaatctactaattaattggtagggtagagaagcaagaaggcccttattcttttttttcctttctataatggctctgtacgtgctaccttcagtacttcacgttgccttttttttttccagcgaacggcttatcgcgggggaagctgatgggccactgaccgcgcgcagccttatcccctatatactatatactagtagtatattgtactcctcctcatactactatacaatgtatttgtatttgtacacagatatatatacttttaatatatacataccaagtcattttttatgtatgaaaaatatatacacgtatacaaactttatatgcatacatatgcaaactttgtatatgcacgtatgcaaattttgtatacgtatgtacgtatgcaaaatttgtatacatcgtatacaaaatttgtatacatgtataatatacaaagtttgtatatgtatgtatacatgtacaaactttgtatacgatatatacaatgtttgtatacgacgtatgcaaagtttgtgtatatatgtagaaactttgtatatgatgtatataaactttgtacacgtatatatagatttaaaaaccggaaaaacgtatatatattaaaaaaactggaagaaaacccaaagaaaaaaaagagaaaaaatggaaaaccgcaaggaaaaaacccaaaaaaaccgcatgaaaagaaaaaaaaaaccgaaaaaagggtatgtggtgtgctctcccaccgccctcctctctccgtgcacgccacgtggctgcgccgcggggggtggggggggagggcgcgcgactaaccgctagttagcggtttcggcttatcgttgtgtgaggaggagcccatgcgcatgtacatattgcggaaaggccgtgggacaccagggcgaggcccaaggtcgcacgccctagctagatgcaggcccaccccgcatgtttctatttttctccgatctctcatgatgcggatacttcacccatcactttaacacgtggcagtttctcagagaattcaaaccaaattcgttgggtgccacgtggcccaatagaaaaccagatcacagaccctaaattcggtcttagagatttcttgccatgatacagaaatcattcgcccaaccttgacgcagacacatgctatgctaggatagcccgtcatcgccgatgctggaccacggatcgcctagagaagagaggattgccaaagtagagtcttgtcttttgtttgcaaatcaaaagcagattcaatgcagcttggacaaaattgttgatttctctagtacccctctgcttcatattataaatcgctttaacttttttttcttaatcaaacttataaagtttgactaagtttattaaaaactagcaatatctataatactaaagtagtttcattaaatctagatttgaatatgttttgataatatattattctttaggtaagtttaccattctttaaaagatactaggaggtaccatattttctgatgtgtaactttggtaccttcatgtactataggtataggataccaaaattttaagtataaaatttaggtaccttgatatacttttctcaatgactgtaatatttattttgtcttgtgcattggaaatgtttctacgtttttctataagcatggtcaaaattaaagatgtttaaggtcctataatatgatatggagggagtagcaaggatgatctttttgtttgttcagttgtaaaggaacttccctttctcacttatgtggaaattaaaccagcaagaaaagaatgctatcacttgtcacagctctaatgatgatgctgtaacattgtaatccaatccttcaatcagcctccatactagttatacaactagcttactaccactgctacactatataactgaccaaagtttcttctctgaattctgatcaagacactgaagtctgaactacatacagtgtacagtcacctaaacatgaattctgaacaacttgatcccttgtaagctgcttcttctagggacatataagccatgtcgacggattcaagccatgtaatctacaacaaccgaacagccctagtcacctgtaaattaagagagttgagaggcactgaacatggaaaagaacatataaataagtagtatctgaagtatcatgttctcctatgaaaaattgtactcttttcgagacagagtgtggttgtgagtttgtggactacactatattgtgttcatcaaatatgaaacatgtgctgactagattcattttcatctagctgaatatgcgccaaagacatgctactaatttggaaatgggaggcttcgggtcattgcgatttgcgcagcttgatcaacctacagtgccctcttccttggccgtctcaagtttccttccttgccatgacacagaaaaccagggtttacagggaaataaatggagggaaacaacagggtatacaacaattccagggtgacctggatggagccttgttgaggaatctttgctctctgttgtcatgttgtttttttatgattctttttgtttgtgaagttgtaacctaaactttgcgccttttccttcttaatgcaatatcgcacaactcccttcaagttttctgtttataaaatttgcagcatcattcttgtcccacagattcagtccaactcactggttacttaaaccatttcactgaatctgtttataaaagaacttttctttctcacatctatggagtgaacacggtcagtcagaacatacaaacaacaagcaaacatggtaaattaaccagcaagaaaaaaatgttatcacttgtcacagctctaatgatgatgctgttacattgtaatccaatcatttaatccgcctccatactagttataccactagcctactaccactgctacactacattcctgaccaagtttcttctctgaattcagaacaagacactctgaagtctgaagtacatacagtgtacagtcacctaaacatagagagctctgaattctgaacaatttgatcccctgtaacttgcttcttcaagggacatataaacctgaccacattatgtacacagcaatcactcttaggcctgaatgtctgatgatagatgctgcctggcaatgctgccatttggccttccatgcgtcaaggtttgtttaagccattaaatctgcaattgttaagcagctaaaagtttttctttgcaaaattcgttgaggacaataccttataatagaaaataaaatataataactattttactagtgcctgaaacttttcagatgaacaaaaaaactcctttcgtatgacataacgtatgtaattcaggtgttttcacgttatgtttgccgcgtacaatgttatttctcataccagatagtttcgaagtccaacgaaagttttcttcaaggtatccctcgtcctacctatctgatggtgacaaggtggtcaaaacaaactgtccaaatcaccaaattcagctcattgactgaagaacaatatcacttctagtctcatattctcatgctattcactcttaagtcatgttgtaatcggcaatattcgagcagccaaattcatctgtaaagagacttgagtcacttgacagacactgaccttggagaaaaaacatagagaaaatataggacttttacggtacattctactgcaagtatatacttgcagtatataaaagggtatgtttggtatttgttaaaaatctgaaaatggctgtttagtcatttgaagttaggatttatttttatcgggagtaattttccaccggtagtagagattttttggtcgcacttgcatctgaaaatatttatcagcactgttaagttttggcatgcatagccatgatccatcaatttgatagatggtgactagttagtccatacttttttgccagacatatcaagttctcagtatctactatgttgatttctcagtttatgatgggatgatttgccagttttatcaatccccgcacggaggcggcaccaggagacagtcatgcaaaatgaaaacgactatggctatcagtacaatttctcaatggggctggggctggcgaccgggcgaacgagaggctgggacgcgtcgtcgccgacggcaccgagtttggctctggcgcttggagagttttggttgtcgacggcggcgatagcgcatggaacgaaggaaagctaacctctcgagcggatttatctcaagccggatctgacaaaaaaacgcgaaaatacaaaaataccctttttaatttatactgcaaactaatttagagagagatcagatgaatctgtaccgttggatcgtttatactgcaagtatatacttgcagtatagagtaccgtaatcagtttgtgagctctgattctgaggtatccatgttttcctatgaaacattaggcttggactacatattaagtttatcaatattgaaagttgttaagagcattatagtcttctcccatctcttttacatatcatatatacctatttggcctaactcaatattgcaacaagttcgatcctcaatttctctcttctttcagtatttgacaaaagtgaaacaagtgttccctatatccatgttcatgatgagttatctattcgaagacgtgccggaaatcctaattaatttggaaatgagaggcttcgggtcgttacagtgccagatcaacctacagtgccctcctccttggccatctccagctttctgttcttgccatgacagagaaatccttggccccaatttgttgcaaatactcgcaagacttgcagtgggtgtcgctgttactggactgcatcatgccttgagaaaagagaactatcaccccagggaactgcatatgtgtgatcaagttacacagagaaacattgatcacatttgatgaaattatcagggaactgcgttttgttctgtatgattgtgcttttggttagctattttgtttgttcagttgtggccagactctgcacttcttcttgatggaatgaatgcgcacacacatctttcgcacattccctaaaacatatgtgtgcacttcttgttttctgttataatatttacaggttacagcaccagttgttgtcccacaaatgtgctcagctcaagccctatgtccaagtcattgattagaccatcccaatgaattgaatctcttgtactaaatgaagttctctttctcacctgtggagtggtcagtcaatcagaaagaacaagaaactagggctgtgtttagttcccttcaaacttctaactttttcgtgtaggatcaaatcacagtaactaagccaaccagagggggagtgaatggttggtatacccaaaaactgaaaacttttagcggaaataaaagctaccctcaaattcgacggatcgcggtctgaccgaaggtgttgcgctggtctgaccgcctgataaacgtcggtctgaccgatgtagattgatcggttgaaccaccgagatcgcctactagctcctgccttcgctgccggtctgaccgcctcgtacccgccggtctgaccgccgcaatgttgccggtctgaccgccggtgcgttgccggttagaccgccgaaacccggagaacacaaatcgaagaactcttaaagtggatgacgactttattgattctctctgtgtttacaaagtgcaccaacagcactccttacaaaaatttcgactaaactcgaaaccataattcaaaactcaactcaattgctctcaaaagcgatatcgggaagcctcacgctccccctctatttatacccgaggtaggcagcctaaagccacgaaccaaactcatactaggagtcctaaacaccttaggaaaccctttaacacaagaaccaaactttacataaccaattataccaaatttggactcctttcaaattcgacttcgcatcccatatgcacacaataactccatcgtatgccatatggaatcttcaccaaccacgtgcatcaactctagcctaagtatcccgcatgatttctgaccaccacggacgtcgtcttatccccaagccgactcccggtccatcaccgcaaatactctccccgaggcatcgagtcacctacacatgaaataaacaaagaaatcatattccgagaccaagctatctccaacttgactcattagtagcaaacaacagtattacatacgtatagtatccatctagaagccataatcatgaaataatcacggatatccaaacaaacaacccgaaaccgaaaccgacacagagtcggccggttagaccacgggctaggccagtctgaccgcgcgatacacgccggtctgaccggcaacacttgcccggtctgaccggtcacatgaaataacagcagtatcctgtagattcaccagtgaaatccaatcatctccataaccacttcgtgaataaattccaaatatcaaaaccaataatctccgatgccaattgttcattacaaaataataatcaaaaacacttttgattttacatttcgtcacatcaaatgtttagacacatgcatgaagcattaaatgtagaggaaaaaaatcaattgcacagtttccatgtaaattgcgagacaaatcttttgagcctaattacgccatgatttgacaatgtggtgctaaagtaaacatttgctaatgagggattaattaggcttaatagattcgtctcgctgtttacagacggaatctgtaatttgtaattgttttgttattagtctacgtttaatacttcaaatgtgtgtccgtatacgtcaaatttttttttgccagaataactaaacacggcctaggtaaacttgaaagaaaatactgttctcacaggtctaatgatgatgattccattggaatccaatcctcccgattcttttctgattaagatatatattttatctcggtttccgttaccacacttttcaaaccactaaacggtacattttgcacgaaaactttctatataggaattgctttaaaatatcagataaatctattttcaagtttagaataattaaaacttaattaatcatacgctattggttttcttgttttattatgtgaactcaaatagggtaaagtactaacagaagtttttttttccctttttctgaacaaggctgaccaaattatgtagcccgcaatctattgctcgatactccctccttactcataaaagaagttgtttagggcaatgtttaagtcaaaccttcggaatataaatcatgaataactctcaagttgttgagtttaaaaatataaaaattatatgaatatatttgtcttgaaaaatactttcataaaaatatacatttatcacttttcaataaatatttttatagaaaaaaaaatcaaagttgtgttttggagaccgtgtcgcttttcaaaatgactttctttactagtaccgagggagtacatgctttggcttccctgaaaggcgaagggctgctcttgacctcaattctgcatcaatttttaccatatatcaaggtttgtttaacccatcaaatctgctctcattaagcagacatcttggcttagcacattaatatttatataacatactgtatataataaccagttactagtttctgaatcctttttttagatgagcacagaatctatgttcgtcaggcagcgtttgtcatgttccttcatggatgaaagctgtgtaacgtcatctttgtcgcgtacaattttatttctcaaattgtcatgccagatactttcaaagtccaatagaaaatttctacagggtatcgatcgtcctgcccgtctgatggtgacaaggtggtcaaaagaaactgcccaaatcacaagatttcactgctagtctcatgctctcatggtatgatcactcgtcttctttaaatgcacaacaatccgtgtcaaatcatcaaaagcaaggaactcaagcaatggcaaattaaggagggatgtgtttagcactcagttaatcgtctgacatacaattcttaccgcatggtaaaccagaaaaaagaaacaaagaattttgtgaattgacacagcttgtacttcagttcagatactatggcctgcttggactttgttcacaaaattctttgtttcttttttttccggattgtcacagttcagatactatattcacaaatgtatctaacttaagtactcatgttctctgatgaacattggactttgttcctgagaaagagtgaggttgtgagtttatgagctatattatgttcatcaagggtgaaacatatgcttgctccatgttttctgtttataaaatttgcagcatcattcttgccccacagatgagctcaactcaattcctatatccaagtcatggattaaaccatctcactgaacctctctttctcacttcaacagagaagaacacatggtaagccagaaatgtataaagagggtaatcacttgtcactcctctaatgatatgactgcatcgtaatctaatcctttaatcagccaacatactagttataccactgctacactacactttgtaactaactaaaggtttcttctcggaattctgcacaagacactctggattctgattgtctgaacaacatacagtgtacattcccctaaacacagagagctctgaaatcttaaccacttgatcccctacaaactttcttcttcaaaggacaaatgaacctgaccaaaaagtctgtttaagccattaaatctgcaaatcttaaagcagccaatatttttctttagcaaaattggttgaggacaaaaccataaataaataaatacagtataaccaatttaggctgtgtttagttcaagccaaagtttggattttggttgaaattgaagatgatgtgactgaaaagttgtgtgtgtatgacagattgatgtgatgggaaaaataggaagtttggatgaaaagtttggatctaaacacacccttactagcgtctgaagctcggatgaacatttgactttgttcgtcacacatagcatcgtcatggatgaagtctgtgttcacgtcatctttggcgcgtagaatttaatatcacaaatcatcatacctgatattttcagagactaataaaaaatttcttcagagtatcgccttgacctacctatctgatggtgacaaggtggtcaaaagaagtggcccaaagcaccaaattcagctcattgactgaagaaggacatcactgctagtctcaacttgtatcaaatccttgttaaatcatcgaatgaaaagaacataagcaatgccaattcaaggatggatgtgcatttatccacaaatcttgagcacaacatggtgaacttgatccaggaaataaaaaaaaaaagaattgtcacttgacacagctctgatgaatctgtgatgatgagtaacactcagtatactacattaattagaatcaaatcattaatcaaatctccaatctggagtaacactgctaaactagaaactaacctgcatatcatactgctcataagccactaatccttaaccatctctgaattctgaacttgcctgagaactctgaatactgaacatgtctgaaaactctgaatttatatacagtggtgcagtcacagagagagagagagagagagagagagagagagctcagaagaatggcgcgccgagcggctccgtcttcgccgccggcggcggcgcgagcatggagaggtcgtcggcctgcagcagcgagccgaggccctggaggtcgtcgaggctcatccccatgagccagtcgtcgtcgcgcgcctcctccttgggcagcagggcgtcgtcgaacgacgccgccggcagcgagtagtccatctccgggaacgcgtcgctgtcgacgacctccgactccggcgtccgcgtctccccccacgactgcgccgccgccatggcctcctcctcctccttcctgctctgcatcttctcccactcgttcttcttgttgtacagccggcacagcacccagtcatccagcctgagcgcgcccgcgcccgcggcggcggcggcgccgcccttcttggcgaggcggtactcgtgcatgatccactccgtcttgacgccgcgggggggcttgccgtggtagaacacgagcgccttcttgatcccggccgtcctgccgttgtgcagcacgggcttgtcggcgccggtggccttccagtagcccgaggcggcggcgcggttggggcgggagccgttggggtacttgcggtcgcgcggggtgaagaagtaccactcgcggcggccgaagagggcgcggtgggggaggtcccatgggtcgtggcggtagaggtcgagctcggcgatgatggggaccggggcggcgcggcccgcggcgcgcgggcagaggtagtgcgccaccagctcctcgtcggtggggtggaagcggaagcccggcgggaggttcaggtccgcctccgcgtcgcgcactcgccgcttcgccgccgccatggacacgaggtgttcgatcttgggacttgagggaatgagggtggtgggttgttggatgtgagtggcggcgggggtgggagggagatatatatagagggaggtgggaatggagaagattcgtgggaaggagagggggggtcgaggtggatatggggagggtggaggaggaggaagaagcactgcagcggcatattcggtcgtctgtctgtcctctgtcggttactcggttgatgttcatctgctttttttttacctttaattttaaaagttaaccgttctaaaatttgttttaaaaatctaaacctttttacaatgttagcctgcttacgcgtggcaaaataataccgtcacactcacaaagcccgcaatggttgtgatagttttgtcatgtcacggtgacatagcaggacaatattgtcacgccagctaggggtgaaagcggtcacggaaattaccgatcgaccggatgtcgttttcgtttaaggggtactgtttccgaccgtatcgattttggctatttttaaattgagtaaagtccatcaccggtccctaaacttgtactgctgtgtcatcccggtccctaaactcgcaaatcgaccgttcaggtcctcaaacttgttctactgtgtcatcccggtccctaaacttgcagatcactcgtttaggttctccaacttgttcagttgtgtcaccccggtctctaaacttggatttgaatatcatctgggtcaaatag

SEQ ID NO: 81154 - DNA, 30285 bp, Oryza sativa
ggtttatagagacggagtgggagcggcaaggtcggttcgaggttggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagtgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaaaacgaaagacaacaggagctaagccttgactagaactgcagtgggaacaccactccacaggcatcctcgacggcacggacgaagcctactcctcagagacacctccatctgacacatactcgaactctggggttgggaaaaatagagcaagactgagtactacccactgtactcagcaagtcataccggaataggggtatgatgcagggaatcatcaaagaagagctgaagtggttcatttgcataaagcgagcatttataaacagaagtacaccggagcatcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaatatattccagggctgacgtcatcaattgggctccggcggcgaatctctacggaggaggggtggacgaggtggacctcggccgcgcgaacccaacggcggcgacggcacggtgcggcggcgagtgtagcggcggctagaggcgaccggagtagcggaaacggcggcggcggatgggcgcacagcgcgggagcgatggggagctcgggagagggaggcgaaatggggaaaaagcgagacggagcgacgggggagcttaaatagggagagagagggccggacgtggccgggagaggcgggaatcgccggccgacgtgggggagtgggggaggcgagagaggcgggattcgaaaatcgaatcccggccatctcgggcgcgggcgcgagcgggagagagaggggagtgggtgcggggaacgcggcgcacgcgcgggcgtggtcgacgtggcccggaggaggcggaggcgtggacgcggcggcggtttcgggcgcggcggttgctggcgcggcgtcggccggaggtgggggaaggacccgacaggtgggccccacctgtcggcgaccccgggagaggagggcggcgggcggcctggctgggcctcggcctgcagccggcccagcagggagggggggaaggaagggaaaaaaaatgggccgacggcccatttgaaaaaaaaagaggaaaaagagaggaaaaagaaaaagaaaaaggaaaaaggattttccctggaattaaaatattgcttgctcaattttaattcgttaaagttatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaatcgggtgaccttgtttctggttctcctttcactggtatcaagtatgcgaaccggcttctccacgtatgttaggtcctcctggatatcaatgtgttccgaatcagcctgttcttcaggtacccttaagcacttctttaattgggacacgtggaacacgtcatggatgccgatcatattggatggaagttctagctgataagcaacttccccccttcgttccaggattttgtatggccccacgaagcgtggtgccaacttgcctttcgtctgaaagcggtgtactccccggagcggagtgacacgaagatacacgtaatcccctgcctcaaaagtgagctcccttcaacggttatccgcgtagctcttctgtcgagactgggcaatcctcaacctttccctgatgattctgactttctcttccgctttcgctaatacctctgtcccgaacaattgacgctcgcctgtctgatcctagaagagaggtgtgcggcacttccggccgtataaagcttcaaacggtgccatctgtagactggcctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcaactctgctatttcagaatcgtttacttgagctgctttgacttgatccacaagcgtaggccatgccttcagagcggccacaaacccgtgttcaacaattcccacgttgagatgctcaaactcctgccgcaattcctcacacataccctcgatgcacagggcagtgcagtaacttttccggcttaaagcgtctgccaccacattggctttacccgggtggtagtgaatacccatgtcatagtctttgattagttccaaccatcttcgttgtcggaggtttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccactctgccctcttgcattaggacacatccaagtccgtgacgggatgcatcacaatagacttggaagtctttcatctggtcgggtagaatcaaaactggtgcggatactaatttctttttgagctcctcaaaactcttatcgcactcagctgtccatttaaacttctcatctttcttaagcaactgagtcatgggtcgggcgattctggagaagttttcgatgaatcggcggtaataacctgcaagtccaagaaaacttcgaatctgcgacacggtcttcggcggggtccatttggtaaccgactccacgttcgatggatcaactgccacaccctgagctgtaatgacatggcccagaaatttgacttccgtcgaccagaagtcacacttgctgaacttggcgtatagctggtgctccttcaacttctcgagtactagacggagatgttgttcatgttcttcttcggactttgaatagataagaatgtcgtcgatgaacaccacaacaaacttgtccaaaaattccatgaacactttgttcatcagattcatgaagaatgcgggtgcgttggtaagtccgaacgacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttggttgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctcggctaattcgttggccgccattctgtacggtctcttgtaaattggagcggttcccggtgccaagtcaatccggaattcaatctctcgcttgggtggcatggtagtgaggtcttcggggaacacttccggatactcgcagactatgggtatatcttccaatttcctcaaactcttctccacggtgtccactgggatttccgcttcaatctgattcaaagagacctcttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcattggtgtgctaagttcctctcttattaacccatgcatcccgacaaatttctttgaaatgaaagaatgcgttgcaccagaatcaaaaagtactgttgcagggattgagttaacagggaacatacccagtacgacctctggtgctgcttgtgcctcctccgcagatgcgtggttgacacgagcctggataaaccttggctcggcacgcctaggcttcgggcatttgtcagcgaagtggccaagctcgccacagttgaagcaggaccctggttttgctccagtctccttcttggcttgcgcgggcgggcctgactgtgccggtgccattggtgggcgtggagctgcaccgcggtttgactgacctctatggtgggtctgactgccaccggcgccctggggaaagttgctagggttgaacgggcggtactgacggacgatcatggtggtaggtccaccctgctgcccaggagcgaagcgcggcctctggtgacttccctgaggtaccctgaactgagcggccttcctcttcctgtccatcttgttgcgttgatcctcctgacggattgccttgtcaaccagcctctcgaaatcggcgtaatctccagatatcaactggttggttagctcgtcatccagacctgccatgaacttttcctgcttctcggcgtcggtacggacatcctctggtgcatatcgcgcgaggcgattgaactcatggaggtactccgtcacagtcctgttgccctgatgaagtgcccgaaattccctcttcttttgtgccacgaccccgtctagcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcagcatcctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgctgttgctgccctcgcctgttgcgcggctaccattcctggtgtagaccatctggagggaaaagcagacgggggaaaagaagaaaaacagatgctcaggaactaagctttattacataggaatttaaactgcaattgttctgatctgaattaaaacacttaaagagcaagcaaaaatccttattaagacagccatatcataggcacatgatatcgaccgtcgactaaccccaaacaagcaacctaaacacacaaactaacaagcagaagctagacagtcggtaaactaatggaaaacgagcctaatgctcggaacggctcctgcggtcggtggaatcgaaggcgtcctcctgctcgtcaccaggtccctctgagcgacttccggaccctggcagataagtctcgccgctgcccgactctgagccactggagctgctgctgctgagatcgcggctgccactgggagtagcagacaaccaacctccgttgcctctggctgggcccctggcggctgatgctggagcgaaggagagagcggacgcgggagctggagctggagttgcaggaactgcgggcggaactggaggtgctgcgggagctgctgatggaggtgggttcctgggcgcaagctggatgcgcacgggtgcagtcgtcgtcttgcggggcgtggtgcggatccggactcctcctggcgcgggaagaccctttaactgagcgttctccctcttcagagcgacgatcctcatgagcttcccatcattcaaggccttggtcgccttgtgcaggtccgagtgcatcctatccaatcccctcatcacagcacacatgtgaccaaaggtggtgtcgttctcgccggctgtcggacggaaagtactgacatcatcactgctggctcgacgagggtgaaaccagtacgccgtgtcgtggaagatgtagttgtggcgctcccgtagtctggccatcatcaggtatgctgcctcctgacaggcgtgatctgctgtgcctccagatgcctccaccaccatgttagctaggcaggtacccacgtagccgtggacctccagacgaacacggtgaggaagctcgccactgagcggtggaatcgtcgtgtactctggcgcgttggggtagcctaccaccagcgtcatacatgccaactctgccacaaagtcgatcatgccttctccgcggtggttgggtgggtggccggccatctagggaagacaaaggagtaggatcaatgcatgctcaatccaaatttaaataaagcaataaaagactcaaataagggaatcgaataagagcgaaatttttatgcatagatcattttacatgagagcgaataaataagacggactcacataacgataaaataatgagaaattagatacatactaataataacaaataaagcataaataccttgcaacccatgttcctgagctatgacctaatgcatttcacccatcagatcccaactgactgacgaataaatctcaacagttttactaaaaccctggactgacttgttttgaaaaaaaatctcacttaaacgagcgaccaagatttttttccttgaaccacaagaacagatcccaattttcccggaataaaatccaattgcaaagaacatatgcaatgaaaaggattcagagggctcttaggtttttccatttggcttgtcctacggtcaacctggctctgataccaacttgtcacgcccagaaattcccgaatagaatttcaagcagaatgtgcattaaaatcccgtccaggaccagccggggtacacaaacgacaatgttgacattcagatccacgtcttacaaacatcataaaagtcttacataaatgcagcagaaaaacgaaagacaacaggagctaagccttgactagaactgcagtgggaacaccactccacaggcatcctcgacggcacggacgaagcctactcctcagagacacctccatctgacacatactcaaactctggggttgggaaaaatagagcaagactgagtactacccactgtactcagcaagtcataccggaataggggtatgatgcagggaatcatcaaagaagagctgaagtggttcatttgcataaagcgagcatttataaacagaagttgaaagatttaaacagttgtaataattaaacaatatcaactatccactgtccaacgctaacccacgttgcgacaggcccaaccatccacctaaactatccaattttaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatatcagaaagaggccgtgacaggacccttcgcataaccccctctagccaagcacaccacacctcaggtttcacccccgtccccagcgggcaacgggcagccccctctcgtgcctaggtgaatccggaagcgacagaggccgtcgcagggcccgccccgctccatcacgcccacccttgcctggatgcgtcgactagaggaaagctatactacaagcccagccgttgcccacgctggcttgtggtaagtacgataagttcttccagggcatcccgcgaaccggtccttaactgccatgggtgcgacctgctaaaccatgcacccacagcccaccatgtggtttattttaattaaccaacaccaaagcggtgtcactaatccaacaaagccattagaaccaacagtctaaacattaatgtgattttccccattgtgaactagttgaactaagcatggctaagcaattcctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaagtgacaagcatgacttgccttgctctgctgctggagaaacctcagcgactatttcgaagtacaccggagcgtcggaggaatcggaatctagcgacatacaaagcaaacattgcaaacaggctataagactactgaaacagggaacaaaaccatttttaatggattctacacatttttcttgatttattgagacttgaatgggcttaaacggagctcggatgaattagttatgaattttagaagattcactatgtttattactatacaagaaaaaccttaaatcatttattgcgcaatatattccagggctgacgtcatcaattgggctccggcggcgaatctctacggaggaggggtggacgaggtggacctcggccgcgcgaacccaacggcggcgacggcacggtgcggcggcgagtgtagcggcggctagaggcgaccggagtagcggaaacggcggcggcggatgggcgcacagcgcgggagcgatggggagctcgggagagggaggtgaaatggggaaaaagcgagacggagcgacgggggagcttaaatagggagagagagggccggacgtggccgggagaggcgggaatcgccggccgacgtgggggagtgggggaggcgagagaggcgggattcgaaaatcgaatcccggccatctcgggcgcgggcgcgagcgggagagagaggggagtgggcgcgggaaacgcggcgcacgcgcgggcgtggtcgacgtggcccggaggaggcggaggcgtgaacgcgacggcggtttcgggcgcggcggttgctggcgcggcgtcggccggaggtgggggaaggacccgacaggtgggccccacctgtcggcgaccccgggagaggagggcggcgggcggcctggctgggcctcggcctgcagccggcccagcagggagggggggaaggaagggaaaaaaaatgggccgacggcccatttgaaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacagggagctcgctacccgggaggggaaaaagcgaaaggaggaggaggaaagggagctttgctccttccggtttgggaggaaagggatgagaacgagccgcgcctcacggttttggatgcatgcggcatggggcgccgggcccgagaggatgacgccggcgatgactgcaaaaggacggggacggtttgaaggcaagcgcggacacggtggtcgtcggggcaggcgacgaccgagggtggcgatggcggcacccaggcggtcggccactcgcacgggcgcgcgggaatcgaaggaggcggccggaattttgggcggtgtcggcgggaagcgacgccgagagagagagagagagagggcgctctctgagggagtcacgtgcggcacacgtgcgatggagaggctggcgaaagaagaggatgggccgaggatggtttcggcccgagcgagttggagggaggcaaaatagacttttactggaaggtttgatttggagagaagtttgatgtggagattgaatttgaattcaatttgtgtatttgtacacgagggttcaaggtggatccaagggaggggtcaagaaagggcttcaaaagcgggaattttggtatttttgggatggatttatatttggcggcacgaaggattatttcagaggatttcaaaaatggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagaggtggatcggaaaaagaaagaaggaatccaacctatgagggaggttaaatagactttcacagagagatttaattgggaggttttagagttggagtctagattcgaatttcggggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcaagattatttcggaacggaaatcattttggggagaactcaaggcgaaggggattgaatcttgggatttagagttcaagggtggaagtgatctcgatttgcatattcagacttgggtcagaagttcgagaaagaaaacagggtagattgatgaaccaatacagagagaaagatagatgaatcaaaacctaagaggttgaattcgaatttgagaatcggtttgaaggaaccaaggagagagtttatgacgcgaaggtgaatccttggacggagttagggttcgggcattcgacaaagttcacggatggggttccaggaggggattccgaatagaaggaatcgagcttcgggactacattgggatggaaattttgaggagacgatctttgataacagggtatcgagacaagggagggatttaaattgagatctttggcacaacttagactcaacactcaaggaatgaaattttcgcaattaggatttttgccgaattagtttttaacgtctcacgaaaagcggagcgttacactaactgagctaccacgcgagttaaaggaggaggagggcgagcgaggaagaggaacggagggctatcgcttcgggacagggcgccgtgacgagcgacggcggcgcgggagcaagctctccgggagcggccgggaaaggggaagaagaggtgcccggagctcctcgtcacacgtccatgcacgcaccggcctccctggtgcttggcgacgaacggcgacggtgcgagccgagcagggcgacaaggcgcggcaggcgaagacgagagggatagagaggaggaggagcttggcttgggttttataggcacgggaagtcggttttgggggaggaaaccgacttaggtggtcaagggagctcggctggcagtcgtgctcggagctagcggccaagcggcggcagtggaggtggtcacgggtggccgggctgagagggaaaaagcaaaaaggggagaggaaaggagctcggctccttgccgatttgggcgagcagagggaggagggagagcgcatgagagaggggagccgaggctctgcctccacgtcttggacgcacgcgcgcacaggtggagcgagtggcagggcggcatgggctgctgcgcggcgcaggcagccagggctaacgtggcggcgaccgagcagtcggccacgcgcgggcgagcgcgtgcgcgacgcgagggcgcggcgaaattcgaaaaggcagcagcgggaatcggcgccgaggggagttcgtcgggagagagagagaaacagagagagagggagagggagagagggtggggacagggagggagaggagctctgcctccattgtttggaaggacgcgacttggagcagcggacagggggtgacgccggtggtgaccacggaggtctctgcctcccggttttggatgctagcggcgtgcagcggcagagcggcagcgcgcgaaattggtccatccaaaatagagggatgcaaaatagacttcttccaagaaattgatttggagaagatttgaacatggaatttgacttggacttctggattgggatctggatgagaggaagggtctaggaaatgatcaaaaggggaaattttggatattttgggggtcgggcgaaaatttggtgaggatttcaaagagaggacttgaattttggaatttgatttggagacttgaatcggaattggaatctcgaggtgggcgattttgatggcgacgagagggaacaacgatggagattgaattgagatccatggcacgacttaaactcacactcaaagaacgaaattttcgcaattaggattttgccgaattagtttttaacgtctcacgaaaagcggagcgttacatctgcacccttgaatcgagcagggtgagaacgatatcatgcaggaatccggaaaactcaaatcataccttaatgggaaatcctctcatttttgcatgtcacttaaaaagtcatcaaaaaatttgaaaagatttgataggatagaccaatatgtgatatgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagccgtacagatgccgtattgcggttaggaaaaagaaagaaacaaaagcgaaaaacgggagtcgagaaggtgtgcggcgccggcgtggttgtgattgacgctccgaggcgtcgtctcgcttccagtagcccagacggcgcgccgttttcatgggccttagaccttccacgacttgctcataggtcacgggtgatgcacgaatttaggccgaggggtttcccatgtgatgaaaatagggggggtaagtactaaagctaaaaattggaccaggtgcctgagaacccccttcgtctattgggctccgcacctacggccacggcctcgtcgtcaacagctgggagccccagccgagcatcctccgccgccgtgttcgtgacacactgcgggtggaactcggtactggaagggatcaccgcgggcgtgccgatgctctgctggccgctgtacgcggaacagaggatgaacaaggtgctcatgggtggaggagatgggcgtcggcgtggagatggagggatggctggaagggcgtgtcaccgccggcgaggtggaggcgaaggtgaggctggtcatggagtccgagcaaggaaggaagctgagagaccgcgtcgaggcgcacagggaagccacggccatggcctggaaagacggcggctcgtcgcgcgccgcgttcgcgcagctgctgtccgacattgacgacgcccgtggcaagcagagtagtgtcagcgtttagctccactttagaacacgaaaataatttcacaattcccactgaaatcatgtttgtagtactcgaaatcgtttcatcgaaacgttgattttattgctgacaccaaataattcagatcaaacaaaattttccatcccggattacatagctgaaaggctgaaatgccatttcagcaagaggacagtacgcacttgattagtatacactctgtaaatactacaaaaatctctcgatacacctgcaaatctgtaggcagaatctctgacgcctggcgatggcgatggcgatgatcaggcagctttggcgagctccctctcgacggccctcttgaggaagctgccttcctcgacgaccatctgaacggggaggaagccgaggccgctggcgacggcgagcatcacctccttcatctcggcgcggaactcctcacggtcgacggcgccgtcgccgtcgcggtcgaaccgggcgaacaggccgcggtacaggtcgacgagctcggcgtccgtggcggcggcgccgtcgacgccgaagtgggtctccagcacgcggaggctcatcagctcaccggccatgtcggcgtaggacagcctgccgtcccggtcgccgtccagcgccgcgaaccggtcgtccaccgtcgagttgaaggccccctcgtcctccacgaagctctccaccgtcctcccatccaaaatctccacgctcatctcgcccgatcgaattcttggctagctctcagctggttcaggtgttgtaggtgtttgacgagatgtgagaacgagttgccgctatttatactgtcgaatccgcgtgtctacaacgcgttaattaatcagattattgcgcatggtttttggcctggtaatatgctgtgggatgtgccaatgttgacgagttgtttttcgccaagtgaagaaatgctaaacgtaagcaaagttcttgttcgcctcgagggagatacgctagctgttgtataaagaaaaggagaggaagcccatggattcgggccggtttaggcaggttgcagatcatatgacagtgacagtgagttggaatatcattgacaggacgcggcgaatctgcgccttgctctgtgcgtggttaaattaaacatagcattgctgcagaggcagaagaagcgaagaacttttccttcatttattgttgtaaaaccaagcacttacgcaaagcttatgttagcatgtgaatatagtacgtgcagttgcagttgagccaaatagtactcccttcgtcccataatataagggattttgagtttttacttatactgtttgaccatttaactcatttaaaaaattttaaaattattatttattttttttgacttactttattatccaaagtattttaagcataacttttcgtttttcatatttacacaaattttttaaataagacaagtggttaaatattgtaagcaaaaacttaaaaactcttatattgtggtgacggagggagtaattggcaagctaactttggtccgtagctcaaatcaggtttggcaacttcatcactttgaggaaaggcgtccggcagaagcaggcaagcagcagcatcagcagcaagttggtcgagatagaggataccatgaaatgaaacagcatgtgccaagcccactttaccacaccgatggtccttactccttaaacttgtgccgatttgtggttggtctgccgacagacatcacctcgatcggccactggtttctctcgatttcaagaagtttctatgatgcccatgtactctcatcatgtgaggcccatacggtgaccaacgaataggactcctacggccccatcttttatgtatgcttatgtttaattattaaccaaaatttaaattttaatattaaatttaaagctgattttgagatttttttttcatcgaagtttatttttcagcctttacttttaggtcgttaagaacacgtaggtaaaagttttattcacaaattatttatcgttttgggtttgtttgtgggtcccgataggatgtgcttttggcataaaattacaatttgtcaattcaaaagcatacatattcagttaaaaattgtttcaagttgacttttatatttaaaatattcggtttaaattttggtccccaaaattgtttgcattaaaccatgccaatgaatgaaatgtctaccacgcatcttgtttttttttggcacagtttgcccctaaaacaatttcgccctaaaagtgtgcgtagggtagtttagacgccacaatagaaagttcatagaatatatttttttctttttgaaattgttttaaaattcttctaaaattcattagcaaagtgcatatatcaaataattttgggatggtttggttttaagcctaaatttggcttaccaatatttggcaatttcaatagtgtttagtgtctatttggtttaaagccaaattttggcatgcctaagaaaatatgccattttaatagttaacttaggctattttggcttcaatccaaatacaactttaccttctcaaaattagtcataccaaaacttaccaaaaattggtaaggccaatttaggccacaaaccaaaccagccctttatacataaagttttaatgtataaaatttatgcaaaaattagtagtgtacgtgttaggctagtataaacccactcaaattccatgggccaacgggcctcctaagggaaagggaaaacgggcaggaaacaaatgggccacgaaagtttatgcacgtgggctgtattggaaatttggaatgcatttgcgtaggcctcggacacggcctactaaatagaactggactgcaaaagcccatgtccccaaagcccaaaaatctgtgagcccaatagcctgcttccttgatgctctgaagtctgaattgacaggcatggcatgccttgcaagagaaagaaaattgctttcgatttgcctttttctttgcgtggatggatgcattgtttgaacgatggcggcagatgtggatgtttgtccagcaaagcgtgtgcttcgtgacaaccatttctccccgttctacgtcaatcctctccttttcccgtgttcattttccggtggttatcgtgtcattagtccacaataattgcattccagggacatctcctgccatgctgaagaataaggcatcgtcatctgcatgcaggaatggaaacacatagtattagttttttttattttttctggtcttggattcattaaacaaagctatcaaatgcaatgcttttcttcggtgtgatgggaaggaatcatgtttcatgtggacaaacatccctgctacgaaaatgcagagtcgattatttaggagatgtagtaattgtttagtgatttgtttccttctgatggccgtaatgtgacctgaatatgatgttaaagattttggggatagtcaaaaagagaaagaaggttacatgcgaagttctcagggattgcatcaccctacagtttaagggggtaggttaactagaagtgatccataagggcagcaaccacttaaaacaactgttctattcaagttcattagagaagtcagaggtagtgaaaggagaaggtgactttatgctactgagtagtgagtactagtataatcttgaagtaggcattgattgtttaatattaaggagtagtgcattgcttactgcagttctagaagaaacaaaaacaagggctctgttcttggcagaatgactttaaatggaagaaatagtatattttaaccaatgttcacgtttcttggaaaggagaaaaacaagttgaaaattggattggtttcattaattataacctgctggcctccaaggaattttatttccacaatgtgatatattaattaagaaagctcaatatagcttgatatgcacaaaagatatgatattgttgaaatgtattggagatagtctgtacacaaagttatatttttttatataggaataaaaatcattctgtcggtagtaatttttaactgagtcatcgatatagatatgaaaattccaatatgctgtcagatccgtcgattttgtagtcaatggattttaaggatctcacttgattggaaatgacgaagcggtacgaaatctattttttcttaaagcctaattggcaatgacagctcatgaaatgagttttcatttctcggatgattaacgagttgttacctaccgctgaacaattattattctacatttgatgcaagggaagatgcttaatcccaccagatacaagctgcatcaggccatcacacgagtcaagtggtcatctcaccgacactacaaaatcagctcaaatagctcattcggttatgatttccaattattcgaatccaatttttatatactatgttcagtatattttattatccttgctgcttttttttttgggggggggggggggttcacaagaaagaagtacacaattaatcacaacaatactctatgaaaattaaaagtgtacaatatttaatttgtcgccgggcattttctgtttaatctgcaacaaaagctgccagttacacatagggtgcagttgaaaaggtgactagaaatggaagctatcgtacctttttaatgtgattatactttaacatgaactctattcaagagatgtattcttttcttttctggaaatatcattatcgggaagcaaaaaaagctagctgatagcagtttgccacattttttcatggaaaaaggttctatgtttggttcctttaaggagaaaaaatgagtttggtcttagtactttgagtatcaagcaagttgggggaatccttgatagaaatggagcattggttgcgttgtcaaatttataaaccacacatgataccctaaggcctaagctgaattggattcttccgagaaatagccttgataatcaacttctatactatactcatcagtgtcttctgaagtttgcagtacatggtctgagctccagcaaagagtgattccctttcactgcagatagtacttcaaattggaatttctgtgctctgacctttgaggacacacccttacttctcagtacattgtgcaatcttctttgtcctgcatgcatctgtacttgcaaaatatgctaaaatatttttgtttgtctaatggatctaggtgccagacagtgaatagaaaaattacattagtcatcttacagttttgaacaagaacaattaaaaaatgccaaagcctgcaagttggttttgagaagtcagatttgcgagaaatacaacactgcacaattacaagttggactttacattaaaactagtatcttggccagacagtacacactccagggaaaaaaaagagtgcgaaaaatacacgtttgcgccatttgttcccatattacatacaccaagaaaaggcaaaacattacaaacatcaaatgtgaagaggaatttatcagtaaatgtgagataaatgctaccctatttctctcaaataaatcgaaacaaacagaatggaaattatcgtgtacacttatgtatcggtgatccgtacacgatatgcacgaggtacaaaaacttaaaactaattctacaagcacttaataatggtactaacactaaacaagcagtgcaatttactcaagaacagggagggaagaaagctaggacagaaagaaaagggcagctaatacctggccagctttcattatgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcaggtttgcagaatctgaattctcccctgcatttgcaatgcaatttggagttgttgttaccttttgcaaatttcatagtttcatctcattgagtcattgtggttaatagcttggggctacttattgttgaatgtacttttatgcttatggtatattttgatctttttcatatgtaattcttgaatgatcttgagaaattaagattttttttagcacatgagggtatctctttttctttaagtcgaagcgaagattgttgtgtatgcttggtgtagactcttgaatgttcagctttggtagttggtccttctctttttgtctttgtgctgtgctgagatctaaaagacataagtatcttttttgttgttgaagcaaccagtttatcatgtgtcctgattttggtaggtgacactatcagactactactataatgtgaccacctaaactagatctaatgatcgtgatgtcactaagcagttcagttcaaatacagatagatctcagccaaaaaacaaacaaacattttggtttttatgatcaagaaaattcatcttgcattgatcactgtacaatgtacattgcttaaatgatctcagggatcaggatcagaggagaagagaagatggagttcaaagcagccatgttcgcggccgccgtcgtagccgtcctcctatcgtcgccgtcaccggcattggctcagaagaagagcccgccggcggcgccgtcgccggtgtcgcttccaccgagcttggctccggcgccggcgccggcgccgcactacgtcgacctcgccgagctcctcagcgtggccgggccgttccacacgttcctcaactacctggagaagacgaacgtcatcgagacgttccagagccaggcgaacaagaccaaggagggcgtcaccatcttcgtccccaaggactcggcgttcgccgccatcaagcagtccaccttttccaacctcaccggcgaccagctcaagacgctgctgctgtaccacgcgttccccaagttctactccctggccgagttcaagaacctcagcgagctcaacccggtgaacacgttcgccggcgcgccgtacacgctgaacctcaccgacgacatgggcaccatctccgtgcagtcgatgtggtccaggcccaagatctcgagcagcgtgtacgccacgaggcccgtggcggtgtacgcgctcaacaaggtgctcctgcccatgcagatcttcagcaaggacccgccgctggcgccggcgcccgccccggcgccggtgtccggggcgtccgacctcgcgcccggcccggcgtccggcaagacgggcgccggcggcggcaaggcggactcgacgagcgccgcgtgcggcgtcggcgccggcgtcgtcaatggcttggtgatggcattggctggtagcttgatgctcctgtggtgatgatcagagagagagagagagagagagttcttggagtcaaatttgcaacagcagcacattgttcatgcttctccacacttgattctattttgaattgatttgaaagagccattcttttggacatagtaggcaatgtttgtaggatcgaattggagtatttttttttacaacgtattacgatcataattcataattactcatctgctgatggatgaatgaatatgaaaaggggtttctcttacatttctactacatctcttctgctcctctgtttgacgatgacatttcactagttcattattcagaaaaacaactacgtactactataattgatttttcaagaaggaaaggaagatcactactactccctccgtctcctagtaatttatccaaattcgttatactagggagggatatcttcggttacttttttttttttagacgaagggagtactccgttgtgaccgacagtgtaggtctttgatgaatcagtcccttccatgtacgaaatgattcatttcaaatcactcccattgatgctcaccaccaccagccacgtgagccatgtcatggtaagatatgttcagtctactacagtacactgatgattgatgaggttgttccatcttggcataaacaacaagtgtgagatgaaccgtcattggcgagtggttgtgccgagttgaaagattcacagataggactataggaacacgtagtttatgttcgaaattttgaaggattcttcgcttgcctttggcgtgtcgatcgtccgtagaaatttagaggccaaccatgtgcgacgagcatatggtgtgctcgtctcctcacatgcggttagttttttttgcgtgtccagagattctgttccggtgagaaattaatgttctcactagttcagatcttcggttcgatccccatttgactcgtgaattattagtctaagtttttgaacatgtgttcgtttctctactggagtaagagtatgttagtagcagtcagtcagtgaaacactcgggaagtacgtttctcaagtcaactttactacagcaagcccttataactctaggtacttatcttttcgcttttcgcttatgattatacttatcagccaaaatttaaatttttaatcttaaatttaaagttgattctaaggtttttcatcgaaatttattgtttagccttttttttttggatcgctatgaatacgtaagtaattatttttcgtttacaaatataccgtttcatgaaacgatggctccatactaactttactacggaaatcaccaccaccagcagcagcaagcaagcaagcgaacaccggcgtcgactcttcggtcgtcggcgccgagccgtctctcgcgagtcgcgcctcgtgcatccactcgcacaccggcggtgtcgtgcgcgcggcgcggagacagtcgcggttacgaggccgtgggggccttttttccgcgaaagggacggagatgatggtgcgtggctgttacaggggctgtggcctgtggcgtccgcgaacggaggcccatgtgcaaactcccggaagtttatcactgccgcgcgcgggatcagaggcagcgacacgcgcgggccgtgggctggtcgggtgaaccatccgttgccggttgagggctcctttctttctttctttctttttttcaaaacgaatggaggagcgtcaatataaacaaactgtacagtaaggaaaaggagaaaaagtaacggaattgctagaaaacttccgtaagtttttctctcaaagcttgcagatttgtagtcatcggatcgcttcgagatttgtacatactgagaaaaaattgctagaaaaaattatcacacatgtcacgtgtaaaatcccgatgatagtcaatcaaatcatagttaaatacaagttttatataggttacagtataattacaatacagttatatttctattatactatagttacttctaaaagttcttcactaaaaaaatttgcggcggtattttagatactcccaaaagtaaaagctagatccttaaacccagctagtgactagtcaaccaagtagccaattttctgaggcccttgggcttctccctgatctttgtgactaggccggttgcccagagctacttgtgctgaaaggttcttgattcatttacttccaaatccctcgcgagactagcagtattaacgtgcggtgcggactgtttgatttggtgctcctttcgaacacatgagtagaaagtcacaaaaaaagaagaaaaacatattaattaaatgtcatggcatatgctattatatgaaaatttaaaacattgtaatttgtcaaatgagttgtttggatgctcaacatgaattttacaaggaaaatatccgcatggaagtatgactgtaaaacatctaaaggagtaaagtacaccgtactatctctgtttcatattataagtcattttatctatttttatccagtcaattttttttagatttaatcaagtttatagaaaaaatttagcaacatctataacactaagttagtttaattaaatgtaatattgaatatatttttaataatatcattgttttgtgtttaaaatattgctatatatttttaaacttgatgaaactttaaaaaataattagtagaaatggttgaaacgacgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggtatggaaattaaacgcactaatagccctctggactctggagcatgggcatctgcatacccgtttaatgccatcagcatcaaactaaggtgttgctaggcaaatcttcatataagttttaaaattttatttcagattgatttcagtggtttacttagtaattttcgttcattttcgttgcttgttaatctacctaaaattacttataaaaaatcatattcgaaaattcaaaatcaaattaggtcgtaatgcacgtcaaagtcaagtgcggtatgttaagggtctattgggttcaccgattgaaaaaacagaactgaataatatttcctccgtatcgaaataaataaaattaatattggatattacatactatagtactacaaattttagatataaagtaagtgcctacttcttctgtaaaaaaacaaacctagaattggatgtgacaaaacatagtataataagtatggacatacttgttataaaagtggctccaaaatcacatcggaaaccaaacacggaagaaaacgctataagatcaatgtgtgttttaattcttattctgtgataaacaattggcatgttttggagataatcaattttcaggtgatgatcggattcactgttattttatgtgaccggtccgaccgggtggaggttgccagtcagaccggtgctatgtgtgtggtcagaccggccaggcccgcggtctgaccggccgacgctgagtcggtttcggtttcgggttgtttctttggatatccgtgattgtttcatggttatggtttctagatggattctatacgtatgtaatactgttgtttgctactaatgagtcaagttgggaatagcttggtctcggaatatggtttctgtcacgcctggaaattcactaataatttccgaactaatttgtgcataaaatcctcatccaggaatcaactgatgtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatacttaacaagccacacagcaaatatgcaaatgcacaaggataccaaaggatggcacaatatagtctcatttgcgaaagcagcatttagcaaagagttaagagtagtaaaacagtagagtaattaattagaaattttaatcaacactgaacagcacacccatgctgcacaggcccaaccatcctgaacaaccatacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggcaagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtggacttatctccgccacttctcagtctggtgctccgcaatgaaccatgctatacaaaaggtaaagccgttgcccacgttggcttgtggttggcacggttaatgtttcacaatagtagcttgcgaaccggtccttaattgtcatgagcacgactctcaaaaccatgtgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccggcgcactcgcgaaccttcgaaacgacggaaacgacaagctaacacgcaaaacgaagaaaaagactaataaaaaccaaataaacagtacataaaaaataaacaaacatgtagatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacgttaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccagagcacgggagacgacgacgatgacgtcagcggtgacgtcatcaccggcgacgactcgggcacgcatgcccgccggcgaacgacggcgcggtggcgcgaaaggagagcaccaaaacgatgcgggcgacgcggcgaactcaccggtgaccaaaacaacggcggaagatcaacggacggcaacggcgacgaggaagaagcggcgaagaccttcggcttgacgacggcgatggtgttccagcggtcgacagcgacggcagaggggcggacgagatcggcgacagcttggcgatcccgatggcggctttcccgagcgacgacgacgaccggagcgacggcggcgcacggctagacgaacggcggcgacggcggcgcaaaagctcacggggctagggcactacagacggcggcgggcgaaggcgagagtggctgcgggtagaggggagctcgggggtccttttataggggcaaggaggcagcggcgaaggcccacggcgaccggcgacgcgaaggaaagtttatggttcggagagagagacgaatctgattcgagatcgaatccacgagtttccaaactgaattaggcgatgattccaaaagagaaaaggtagaggagatcgagaagatcatttcccctctattgatttcaccggatcgggaaataggcgagcgaaaaaggaaaggcggcggcggcgcggctcggctagggttcggccgggcgacggctggaggaggaagacagccctgacaggtgggccccacctgtcagcgggcggatgcgcgcgcgggtggctgctgccggactgggccgactgggccgagggagagagaggttttgggccggctttctgcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggattttcaaacaagaaaagctcttaacaattataattagatcattaatgatcaaataattactgaactgttctttgtatcatttaggaattgagctccaaaaaatccgagaaaatttcagagagtatacttaatcatagagaatttaataaaaattaaatccatccatgctttaaatttaggaaattttatttcccacatttaacttcacttgtaaattaatgaacgtttaatataaattctaataataatttattaaataatttataaatcctgaaacaaaaatcaggatgtgacagtttctttgtttgtttcatgtgtaggtgactcgatgcctcgggagagtatttgcggaaatgatcttctcgatctcctctaccttttctcttttagaatcatcacctaattcggtttggaaactcgtggattcgatctcgaatcggattcgtctctctctctgaaccctaacctttccttcgcatcgccggttgccgtgggccttcgccgccgcctccttgcccctataaaaggacccccgagctcccctctacccgcagccactctcgccttagcccgccgccgtctgtagcgccctagccccgtgagcttttgcgccgccgtcgccgccgttcgtccagccgtgcgccgctgtcgctccggtcgtcgtcgtcgctcgggaaagccgccatcgggatcgccaagtgtagcgcccgttccgtcgtggcgcctagcgggaaaattatctcttaaaaaccctaattgtgaaatttgtttctttgcttgttgtctagtgtccgtgccatctcaagatctcaatccccgatctatcgtcgagtccaatcccgaatccaatccttccaaatcaaattcctccgcaaaagtctattttg

SEQ ID NO: 81155 - DNA, 8306 bp, Oryza sativa
tttagaccggaatgatacaataaaccaagtttaggaatctcgatgtgcgctttgcaagttcgtggatctaagtgaaacctgctgacaagtttaaggaccgctagtgcattttactcttatatatatatatatatatataaaaagctatatgattaagcgatgcatattaaacagagggatgatacaatcattcaaaagctatgattaaagcgatgcatattaaaaggatgcaatcacaaggtcacaacaattggagagccaattgcacccagtctaacgtgcgccaaaaaaaaaaagaatctgatacggaaagaagaaaagaaaaataaaaggaaggaaaccgtgcgcaaaaagaaaaacaaaagaaaaaaaaccgcacaccgcctaggaaaccgtgcgccaaaaaaacaacaaaaaaaaagaaaccgcacggtgcttgcgcccccctctccacgcgcgacccgtgtctagtcgcgcgggggagggcgcatgcgactgatcgctcattaacattctctctccaattgtgcctactgcccactgcctgcgggtttccgtggtcatcgcgataatggcggtgatactttgtaaattgtgttcatctgcctgacaaagaaaaaaaatgtattcatctcgtaccaaagtcctagtccatatgctactccatccgggttgataatacttgtcattttggacagagacacggtcttaaaaaaataactttaaccactatttttttataatatgaatagaagtgttaacaaatatatcattttattgaaatatttttttaaaactaatctatacatatagtcaccatattgcaaagataaatattttagaaattattcgtaatcaaatattttaaagtttgacctcacttttgtccaaaacgacaagtattattagcccggagggcgtacatttcttaacgagcctaagagtaactgtaacggcgagagctaaataggagaaaatcatatcataattgcaaactgcctaaatgtttgactgctaatcaaaaggccataaaaggtccataggtggttattattcctttgtttgtaagctaaggctgtccaccatgaaaagaaattcatacagcaggcatttatcaactcaatgcagctcaacatccagaaagagtgggtctgatttagtctacaatttcagaccatgtgttgtgaatgtacaatgaatcacgtacaaatgacaatacaacaaaagttaagcaagaatagcttgtaccggtagttgtgataacggtagactatgggcgtattctttccaatagactctcagcttcaataaaccctccaaggggaccaagaggtgtatattttacttgcctccagctgttaaaatgaagtggtataaataatttccaaacggaaaaatgccacatttcaaatgaagggaaaggcgtatagcactgtaaattgagtacctgggcgtaaatggcaatgccaagcagtgaagatgaaggtgatcaacactattaaatggtggctggtgaaaaccaaatctgcaatacacaacaagtttacaagaacgcagagaggaataacgctcgataagtatattgtgacaatggaagtttccccatcaccgcatattagtgttactgcttatcagcaaatgagagagctttcaatcacatgtacaacaagaaatatagaacacataaataatatttctttttggcaatacctctgttcctccgaattgggagcatcccgattgagtaaatctcttcctactgccaacatgtgactaactgaaaaggacaaaacatgccaactggttggtttgacttagacaaagagtaatagggagccaaggttgcaagaagcgagaaggaacaaatcacccacctaactggtgatcttcggtggttctttggagattattgacagtaggtatatgttcaatgggtatgacaagatagtgcctgcaaacagcacaggataccgtaaaacaaatgttaaaggaaaaatctgacaagctctgggtcaatagttaacggtggaaaactgaaatcacatttggacacttggtgctaaaaagattacagggccaaaatcactctggcatagtggcatgtcaaagacagaaccggcataaagagctcagatcgacttgttattatgtttgcaacttttgcattgagtacagaagggtgttcatcatgtctgactgatccagttaaccatatagtacaataattgtcggtagcaatttattgatcttcaactgtaagctatgtgatattacatactccctccatactcgtaaaggaagtcgttttggacagtgacacggtctctaaaacacaactttgacttcttcatacggtttcaaaaaaaaaagaaactttgacttcttctttctataaaaatatttattgaaaagtgatatatgtatacttttatgaaagtatttttcaagacaaatctattcatataatttttacattttcaaactcaacaacttgagagttattcatgatttatattcctaaagtttgacttaaacattgtcctaaacgacttcctttacgagtatggagagagtatgttttccactatttgtaaatagagaggtgcaactgtgaagatatacaacatgttttttcattgctcttctgtataatatagaaaaacatatgcttgtgtatatgcacagtaacttgagaattgagataatcaagaacatccaagtaggcgatccacaagacttggttctccatgacctcttggtggttggtatatacccaaattcagacaacagttaagattagattggtacagaggaatcagtcgcattgctattcagctgatcaccaatattgatcggccatcaaaatacataatctcctgctaaaaaaacctaaaggatgatttctttcagcatgaaaatatagccacttatataggaacgatcaaggcataggtctgtttgttcaaaaaatatatatattaaaacataggtctctctgcaatgagaagcagagtaaaaagagataatatggtggtaaaaaagtgtccaaatatgaaaaattcgcactgaaacttataacaagctcactgcaaccaagatccacagtaaaccattatttgcactcgcaaagtagttatagctaggtaggagacataacaagacaacaaacacaagttagttaaagccttccaccttgcattagttgtatagtagaaatatagatggtaaattcaatccgagtacatgtgaacccaatcacttctaatatccgactacagctattatacgtaataacaaggaaacgccatatccatatttccagaccaatcccccccaacacgacgcagtgcgcggagacatagaagtactcctacctgaaagccgacgggttgatgtccttgaacgccatgaccctgtcatcctgcggaggaaaccaaattgacacgagttttagcgaccaacagcaccagatgaacggggattattagatcggaagcggcgacggggaggagggtacggaacggagtagaggaggacggtgttgcaagcggggtcgcggcgggcgatggggcagaacacgcaccattcagccatcggggccctctccgacctcctcgccacggtgccgccgcggaagcagaacagcttcttcatggcaccctcggcgcccgcgtggagcggttgaggttaggtgggatccccaacgcggcgtggacttggactgtttccgcacttgcgccccggacgcggcagccgtgctcgtgctcgtgctcgcgggtgggataccgccaccgccgccgccgccggtatcgatccggtggccggtggcgcactggctaatcgtccagtgattccacggcccagcgcaaccggcaaagctgtagcgtcagtttcctggtcccttggagaagcccaactcatcacaggcccaactgagatgggccatgaatttggttccaagcccaactcagcaccgcactttctcatttcttgctgggaaaaagtacacccaagttctctcaacttgtcatcgaattacaaaatcgtccctcaaccacaaaaccagatatatgacatcccttaactttacaaaaccgttccatttaggttcttcggtggttttgactccggttttgtacgacgtgactgctaagtcaacatgggacccacctgtcaggatgtcacgaaagggcactgatggagacgtcggctgcgcgccggccactgcacggcctcgcccccgcacggccgccccggaccgcgccttgcaccgaactccgcagcgtcacaccagccgtcgcccagccgtgccgccgctctggccatggccgccgcgcctccccgaccacacgaagtcaatgggaaaagaaaatgaagaaagaaaaaaaaagggaaaagggcagagcagcgagcagccctggccgccgtgctgctggcactcgccgcgccatggccgctcggccgcatcccgcgccgagccgcagcttagccgcatcccgcacccacccggccaccggcgtcaccgcaccgtgccgtgctaggccgctgcaccgcatccgccgtccacggcgtgctcgcagcaccacgccatggccgcttgatcgcccccgcgccgccccgcatggtgtggcgccatgagccgccggcccgccgcacgccggccgccacgagcccgtgtcctggccgcgccgccgccgtgcgtccgcgtcgcggccgccgcctagccgccaccgcgccccgccgtcggccgccgtcacgctcctgctcgccctcgctgcgcgccgcgtgccgccgctgcccctcgccggacctcggtgcgctaggtccccgcatggttggcaccttgttaacgtcgaatgtgattggcctgcagcaggatggcatcccccatagctgtactgcgggcactagccacagcccatctgttccaacaaaaaaaaacataaatttacgagtcgatgcaggctattagcagcaattcagcatctaatctgcaagaattctcacacacacacacacacacacacacacttacggattgtgaagaatttgagcgggtgtgaggctgtgagctgcagaaacggagaggggaagaagcaccagatgagcaaataaaatccaaaaaacaatggcggaagctagcaaagaaatggagggaaggatgggttcacaggctgttctgccggccggccgctgcccttcttcctctccgcgtgcactcgccggtcgggagggagatcggcggggagaggagcaggaggcaagccaccgctgtcctcgctcgcctcgggacatcgccggacacccaccgcctccactctgagtgcgtgcggcttttccagcccccaggagcaagcgagcggcagccccgagtcgtcgtcgtgctccaaggaggggaaagagagggatgctgacgtggcatctaacatgtggggtccatgctgattcagccgtcacgtcggacaaaaccgggatcaaaaccaccgaagaacgtaaagtgaatggttttgtaagttgggatattatatatttggttttgtggttgggggatgattttgtaattcgatgacaagttgagagaccttggatgtactttttccttcttgcttcacgctaattcttccaattttttttaaaaaaaatgggcgcttggttcttccgtgaagtttatcctgaatttatataatggtcaactgttaaaaaaaaggatgattagtgatgaagcaaagaggaagggaagttttcgaccattacgcacgttgccggtgggtgtaaaattcaattctgattttttatttccgttggcaacaaccgaacttgacacgcaaagaggccgagccgtcatccacaaggtccagagtctagacaaccgtgggccacgaatcacaagagcttgactggaccggacgcgagcagggctgcttgaacgttggacggggtagctcgaagaaatgaagaatgtttggtctgtcacgagccgcacccgcacgactgtcggatataattaaagttggtccatgtggctgaaccacgtcggaaaaacataaacgaaggtgtacacgctagagatggtaaattacttggctacgaactttctgtgtcaagcttgcacacgcagctgctggataaggtctttttcttttcttatctccgttctctctgttccttgtgcatatcagtacgtgagcttggagccttggagcatgtctagtagtactaggatttcgcttttgtctcccgtctcccgtggacaggatcgcttgaccaacgcctgatgatgataattaagacctgcctaagcaacacctgggacatccgtattatgatattatctgcactgcgggttacttctaaatgatcaccgcaccccctcgtcgttaccaggctgcctcgtgcatgctcatcacaaaaaggcgtgctttgacgtccctcgcgagacacatcgcatgcagctgcggccagtctcagtctgccatgtgcccatgttcttcctcgaatgcgtctgtctcgccggattagcctgatggaaacgaaggtgaaatttaaccgtgaacagtgcccggctttagctgtgacagaggtaggaaaattcggcagatctcgaaagcagaagaaggcattgcagaaaacgggcagcgccgccgccgattcacggcaacatgcgccgttctagagaagctgcaagtaacatgcattattgcctcctactcctagctagtactgcggtatacttatcatgggtctttatcgaccgatcaagagagctccaatgtatgcatgtgcagaaatgttgcaggtaggcgatagcgcatgttactcgcgctcaccgactagccggtttgctgtcgttggaggagatcgaccggtattaattgatcgcgtcacagtactatcatcatctccgcgggtctctgtctgcgtattaaactcctcattgctgcaaaaatgcttggagtggattccatccacgtagctagctagcgtaatgcttgaattgcgacgacgtcttcaattatttggcagtccagataatagatcggtgctagctcgatcgatcagccagttgctgttgccagtcaccggtttgacgaaccggatagtgtatatccactcaatcgatcgatcaaatgatctggggattgcgatgaatttttctccctcccatttaattctcgcgatgaatagttgaatactggatcaggtgttcgatggatttcgtgcgtacaagtctgtgatcgtgtgcgtacacatagattgattaatttatctttctttgcgtgagtttgtccacaggcacaccacatatgattattagtatatgaattgccacggtggaggttagttccggcaagcaattaacagtagtaggtctcattgaggtgcatcagtggtgacgacatggatatcaaggagagatgatgatgcaacagtggagttgagagtcgatcctggctgtgtataggaggggccaggagcctccttgatgcaccgttgaatagaaattttaaacgtcaaaaaaatcgttggtttctttccttcagaaaccaagcgagtggtgtatgaaacaaactatatatgaacattctcggaatacgcattgaacaaattaacgttcaaggtataggagctatggtttaattccacctgtcaagactatttttgggaggaaaagtacatatataaaaggttttatctcattagaaatttcgaaaaatatatatgtatgtatatatatgtgtgtgtgtgtgtttgtgtgtgtgtgtgtattaattatttggcctccttacatgtacaacatgtaaatttgtagataagtttcaagttctttttgcatttatactcttttttaaaaaatataacttatccgttatatgctatataaatttttgttattgttattaatgtaaatcatatttcatacgcaacatccgatatttttgtgttttgtgatattatctattttaagcaatttctctgctcgtataccacacaaaataattttataaaataaatataacaaaaaaactttaatctgtaataaaagattaccacttactgtacaatcgttttgtacataggccatacaacaattttcatttttattgaaacttttaatgaaataaattagggattgtttacattgtatatctctaagagtattttgggtattcttataagggtgatcaacccactggtatattgtaaaacattgttaatgtcaccggtatataatagaaattaagagacactgttagtgaaatcgttgagctgaaccaaactcagtggcatggagtcgattctctctt

SEQ ID NO: 81156 - DNA, 2196 bp, Oryza sativa
tatgcaattcagtgatcgaataacgaggttggcaatggcattcacgccggtgagcaatcttgcacgtaccgctggcttggctgtaagtcaatttttcatgtctgcataggcacaggcgagttaatactactccaccatgtactctatctgactctgagatccttcattcatgcttcactggcatccacaatggtagagtatcctttaagcttctgttcaggcgtccatttcatatgtacgtacactatacgtgaggtactagtacaatatactccgtactagtacaggttaatgcatggttgtcccgttctatttatctactttaccatattattgtcataaattatttactccacacctataataaaaccaaagtagacaattatggcgaacaatctgcttcaaacgggagtgagtctttgcaaaggggtagtgaatgagaattcgaatttcaaaccacacatatccgagaagaacggtgcgcgcaacgcgacaacggttcgcgcaagcagccaaggctaacgtacaggctgcacaatgatgcaccaccgttcgcagccaacggtgagaagaaaaggcaggacaacggatggcgcgcggcagcagcggcggaacggggagtcgaggagacgaagcagcagcagaggggggctcggcttcggactccggtacagaagaaaacaagaggagacgtcgtgaaaaaggattgatggatcgaacgcctgccctgtgccctcatcgccatgatgtactattgtactcctcctagtgtgaatatgtgatgatgacgattgacagctacaggcgacgtacgatggctggccggagaacagctgtgaggggagtcgggtacgtgccgtaccgacgagggtccccgccggccgatcagtgggcaccgcctagactccatatagccgcagtgcgaagctgaaagagcgaacggccaatggcccatggccaatggaaaatacgtgctccctccatccaaaaaaaaaaaaagacaaaccctgatttccgtgtccaacgtttgaccgtccgtcttatttgaaaaaatataaaaaaaattaaaaagataagtcacacataaagtattaatcatgttttatcatctaacaacaataaaaatactaattataaaaaaatttcatataagacggacagtcaaacgttggcacgggaactcacagtttacttcttttttttttttttttgagacggagggagtatagctcaacagtactgtacatgcaattgcaatgcaagcactccagttcaggctggttctgccaatggggctcgggctcatcattggcatctctcgtactgctgtactccgagtacactatacttcgagcaggttgggccatcgctgtcgtccagtgtgtactgctggggttggcctttgtgtaggtcatagtagctgatgagacgaatgacacggattaggaacactggaacagaaaagaagcagaggcaaaatggaaagagacgcgacggccagtgaaagatttccccgtctccgcgtgcactgaaacgaacaaatgcaatggaacattgctgttgagttttaagagcaccaagtgagataaaacaggtgccagatcctttttggtgtatgtacatctgcactatgatattgagctgttgatcattcagagtgacgacaaaactaattttacaaaggcgcaagacttggcgtctactttcgaataaagtgaaagtgagaagcattccattattattcgtttgcgtacaaatgtacaatcagagagtgaccaatttattgccactttataagatgcaaaagaaccatgactgccacttttttcatgctagcttgcctcttggttgtgggggcagatacaaacggctacatactagtataaaaaaaatcaatttctaactatatatttggatattagatttcataaagaacaacttccgatatggcacatccaatatatatttgtttcatgatgatgtgtatcattccgagccgatatttattgtagcaggagagaaacagggatgtagcaggtgcaagaaaccaacagagggatgatacaaacattatatatagactaaaatacaccagcggttcttaaacttcttatcagtaggtttcacttaggtccacgaagttgtaaagcgcacatcaaggtccctaaacttggtttattgtatcatcccggtcca

SEQ ID NO: 81157 - DNA, 5572 bp, Oryza sativa
aaagtttaccaaagtatgatataattcaattgtattaagagtagataaggtgtaaaactattgtattgagatttgataaaataaagatattgtattgatatgcgtgggttggatgaacagttaaaacgatggtagcaaatgagagccaagctggaatacatgttcgcaaatgcttttacaatcccagcattgatgtgccaatagaatattgccaaccattatgcgttcgtcaggtgataaatggcctagctagagatagggttcatcactcgtgccaaaacatattactgtgcagctgcgctgagcaattcaattgattggcgttcggtacaccgtgacagctcacgcatcctggattcatctacgccgatccaatccaaacaccaacctccgcagctcacagtgaactgcactgctaggctctgtgcactgcagacagggtgctttctgtttttgagtcctagtaaatgcaaatttgagaaggaagataaatattttttgcaagcatgtgacaggctcgttatgttgattagttgatatgaatacagagtactacacccattctaaaatatagtaatatttgaatagatgaggcatatactacgactctgcaccgagcgacatcgaacctatatgttgatcagtctcgagctctgaatgcatactcactacatctaccgtatgagcacgttggttcagtgcgcctgaaggatgttagcaatgccatgatgttatactgttatacagttctgtatagtggagcgctagatttatatgaatcgttcttgttgcacaccacagtgaatctacggtttgtcaccagctgaacagtttggtagtggtggtagtatcgataggaaactggtcacatctttctttttgaaagagagcaccattgcattggaattttggatctgctttcaaatttgaagaggacttttgaagtttcaaactcaagtgtggattctccgcaacgtatctactgtatgatgcggatccttggcagtagcagagctgagcaaaggaactgttcatcttgatgacattttcaaccataccatttttttttgtcaaagttgcaaaaaaaaatatctacgtttagtttgttgccaaatttgataaatacatgaaaaatcctgtcaaatttttagtaatattgccatcttgctaaaattttagcattgccaaaatttggtaaggtttattttggctacaatctgaatatgcccaaaatctgtcttcctaggcctacacctttcctgcctgacattgcccaattagatcgtcattggtttaattatttagtattccctccgttccaaaaaaaaaatattagatatgccatatgtatgtctagattggtagtgactaggttattttttatgggatgaaagtatttaacactaggtgggatattttctagtataatgtatctggaactctctatcagatactcctacattcattatacaaaaaaatgtttcatctaagattcttactacttcctacattctataatataagcaacttaggacggaatatgacattttatagtacaataaatttagacatatatctgtctagattaattgtcatatgaaatgtttcatccagtcctaaattgttatattatgggacagaaggagtatattttagacatattttctattgttcatccacattttaagtatgatactacctccatcccaaattatatctatttctagcacagtaacttgtattaaaatgaaactatttctccacctaccctcttctctcaaccaatcacaaccattctcttcacctattttctcttctcaaccaatcataacccctccaattaatcatttctacatacttacttaatatacgtgcctaccttaaaatggttaggttatgggacggagtaagtattcggttgttcatccagattttctggatgattccagattttttttttaccacacacgtggaccacaaaactgttgtaatctctgtagcacatcgaaccttgcgctgcctttccctcaggagacaaaccccgccagctcatgctcggctcaccactccacacgtgcgcagctccccatggcccgcttgtacgccacactcatcgctcgacagctcactcatcagcggcaaagctgattaccaccaccactcgatcaatctctcaccggatcagcttgaaaattctggagtttatctgcactgcatctctcgtgcaccagtggttgatcaatgattcttgcatcaaatgtgccaaaggttcgagtttgtttactgcagtttctctgttggtagcaaaaacccgtgtggagacatgtctcgccgtccgagtcgttgccatcggttaatcgttaatcaggttccatacgggcagagcaagacagatttacaagcagaaacacgagaaacaaaacagtaacgtcgcaagaagaacaatcctacagatacatgcatggcagctaccactagtctgtactctgtacacctgagagcttaggacaaatcatactcgatcatcgtaagtccgcaccagcagctcaccggcgcgagagcgtgtcccacaggtccgtacaccggcggcgggcgaagccgacgcgaccggcgtccacgtcgtacaccacctcgaacccctgctgctggaagttgccaagcgtccctgccggaccaccaccgtcttcgccgtcgtcgttgttcccgccgacgttcatcagcatcaggcacccgacgctccgcccctcctcgctcttgaaccccatgaagtagttcctccgcggcagcgccaccgtcgcgttgccacggaagtggagcgccaccggcggcacggcgcggtccgacggggagtagtggtagcagggggcgagccctgtctgggcctccgcgccctcggcgcgcgtgaaccgcgccgcggccatcgcgcgcgcgaactcgtcggccacccgcgcgaacgtgtcgctcggcagcatggtgaacgtcgtgcccgagtccaccaccatcccgccgttgccgtcgcggtccacgtccccgagctcgggctgggcctgtatcctcttcccgcccaccgagacggcttcgagcgccaccgagtagaagtaggggtgcttcgggttgtgcagcagcggcgtgtacacgaagtccgtctcggaggcgccgatcgcggcggcgtccgtgctgcggccgaggatcagcgggcttgaccggatgagccggtcggcgcggaatgagtgggcgacgaggcagtaggaaaacctgccggagagcgacggggcgagctgggccgggagcgagagcgggccgcgcccgaacccggccaccccgacgggctcggcgagcgccgtgtgcgcgcaggcgaaggtgaagttctccacggccatggacgcggccagcccgacgcgtccgcgcctcaggttcgcgacgaggctgccgtccccgtacgcgtagtacagcggcgggcacgcgtgggacgcgcacgagtcggtctcgatcgcgtcgagcgggcaccgcgccgcggcgcacaggtcggaggtgggcgcggaggagtgcgccgcggagcagagcggcgacgcgcaggagatgcggcgggagtcgatcggtggggggagcgggctggagtggttgccaccaggcgtcgccttgccttcgcagagcatgcaggtgaacggcgcgcaggggaaccagacgaggtcgctgccggtgtcgaggaagagcgacacggagctggccgtggaaggcgggccgaccgagagcgacagcgtgtagtcgctccccggcgcgagcggcagcgagagctggcggtgccgtggaggaggaggcgcgcggcgcgtgccgtggcggcggccgcggtggcgcgcggcggaacggagggaggaggagcggaggaggcggtggatggtggcggtgtcattggctgggcggagcgaggagagggtgttggtgagcggcagaagcagcccgtggcattgcagcgaggaggagacgagaagcaagccgaagcagaggaagcagagttggaggcgcatggtgacggggcgctttcgcgcacggtggaatgctcgggtttctggcctcaggccgcgggtttagaaggggtttttgaagcggccgagccggcagcagcatcccggggcgtacgtggggacggttcaaacaaactaaactgtgtatcgcgtgggggaaatccacccggggagagcgcgagccgcacggaggacacgcatgctgcacactcgctcaggcgctcgcgcggcgcgcccgcttggttgcaacttgcaagcggctacgtgacgagacaacgtgtggatttggagtcacgggacggcgagtcactgtgcggatgtgcgcttggacgcgagcgtgtatgcgtgcacaagcgcaaaccgatcgagccggggcggatctttttttctttgcgatagagagccggggcggatcaggacggagcagtacaggcctacagctacagggtagcagagcaagcaggacaaggggacacaggaagctagcgagtggtggcctcggagtgagagtagctggagtagtgtcattgcattttcaagtaccacgagcttgcgatcgctatggttttttactggtagttgtgactttgcgattactgggagtggtgactttacgacacggctcgattgaaacttgaaaggcgcacaactcgcctgttttacaaggttacagctgcatgtttcagctctagctcttttgaagttgaagcccgatcaataagtttcaacttcacttaaaacagaattaaagataggtgaagagctctagtaaattaaagtagaaaggtaaaactaggtttcagctactccataactttacttgagattcaactcttaaaattaaatctagaagtttaaactcaaccaaacgagttttactattcatctgtcatctcatgctattgctagcctggtgcataatgcgtcccgaaaggctgaaactataggtactccctccgttcaaaaaccgtgagtttccgtgtcaacgtttgactgttcgtcttatatgaaatttttttataattattattttcattcttgttagatgataaaacatgattaatactttatgcgtggcttatctttttaatttttttcataactttttcaaataagacggacggtcaaacgttgaacacagaaatcagggtttgtcttttttttttggacggagggagtaggtgaatggactgctagtacggagtacatccaactattatgtctcctttttatcttctgtttaaaccacttcagaaagttttagtagttgaaacccctcaacataattaactacccttgaaaacgtgtgatcgttaatctgcatttagggtgttgcttccatagaccataggttaggttaggaagattgaaatcagcaaattaactattgagattaaggatagcactaattaaactgcagtctgtaggtgtctgtcaatcagaacaaagacgtgctaatcaatcttattcgaaaaaaaaacgtgctaatcaattgtaggggaccatttgcagagtgcttatcgttgcatctgtggacggatcagatccat

SEQ ID NO: 81158 - DNA, 6753 bp, Oryza sativa
  unsure (1)..(6753): unsure at all n locations
taggataataataagcatgtcgtaaagaaaataaagatctacactgcatcaaatataagtacaaacccgtgtgtaatccaagtactcgagtttcagtagacagttaaatctaacttctctacaaaccccagaagtatgttcaatttttcagtggaacatgagaattattctgaaaagtctacaggaaatgaataatttctgatttgaaagttaaacatgctaatatgctatgagtgcctttcaattcaaatcctcagagggagccttggaaatcatatgatccatttgcttttgtgtagtattccaactacatatagaaatgacaacacataacataaagagtgcggactaggtatttttttacagaaatgctacaggacagtatcccgttcggacgggatgatacccggtaggtatcaggtgatacttgtgaagtatcacgtgatacttgatacctaactgatattgtaccgtctgaacgggataccgttatatagcaaccccttttttaagaaagtgcaaataatcgcattggacagctcttaatccattttttgggggttatatgtgagaatcaacaagtgcaccctctggccagttctggactgttattttccgcctaacataaactgtccccttaatattactgattaatctatgtgaaatatatggcctgtgagaaagatactgttctgtcgaaggccccaggaccctatatttaattgttggggaataggttcattggttattgtttaataaggctataaatggttgattattgttcatatttccttatagttacttcccttatgcttggacagatttaacacaaaggcaatctttagtgcaaagcaaaagaatgatttacttgctatgttttctgccacgtagtttacttttttagcgtcttaccatgttgcttaagcattgttatgggaagtactgcaatttagaaaatactatccaaatcatgaaaacaaattgtaagctggctagctaacgtctaattataatctttaatgcaaataatatgtagcacctcaaatgagtgctgctgtttggtcatgctgaaacagaggtgtgatttcgacattaacctttgttaacctctatgaggcaggctttggtaaagagactggatctccaatacaaaaggagaagtttcttcccatattggcgatcagctttaagtttcgggtttcctgtgacgatctatccatcatactcatatgatgataagcatcatcgtgatctggaaccattcatctataaacgtgaatcgagggacaaaggatcatctccagctccaaaccataacactggccttttggcaagcttgcggcaacccacaaccaattatcaattgacaaggcaatttggtactgctgcattaataaccaatcatcaaacaaagaggctatttggcacggctgcattgacgctcttgaaagtcttgaagaaagcatgaatgaaaaggtatgccatgagttctgttttctatctgcatataacataactttcgtggtgtatataactgaaaaggtatggtgttgggggacgggaagagcatcttcttctggtcttctggacagacgactggaccggatgccaattctatngcttccgatgggggttccatcctgaaccggatgccaattatatgctcttacgtcaaaaacatggaaaggacagttcactccaagtttattttatttttaaaataagatagaaaatatgtaaatttatagctgttaagccaaatatttttattgagaaaaatattatatattttactttatgcagtcaaatttgtttctaagccatccggatgtattggatctgatattattaaatacaaactctagatgtttctgtatcgtttatttaatagccgctgcaatgcgaagtaaatgaacctgtaatagaagggtaaatgaagctcacggatagaaccctcctatatgtcaaatattcttattaactgttgaggaggaaacatcatgtgtgtttttcatagtatgccaagcacaattttgcagtgtttttctttcaaaatgtagctatcgtagtcttagtgaatagaagatagttgttgtacatatgggatcttacgagggtgaaatattctttaaaaattggaaggcatgttgacatttacaatcatcacatttcaaactcatttgacatcagtgtaagtttgagttgatgttattttatttcccgttgcacgcacgggcacccaagttgatgttattttatttcccgttgcacgcacgggcacccaattagtaactaaaaaggtgtggtgttgggggacgggaagagcatcttcttgtggagagacgacttgcttccggatggaggttccatcctgaactgtgaactggacgccaaaaacaagggaaggacagtttacacagtgctgcacgaggatgctagaccggcgacatctccaagtctgggacttgatcaccaccgtcaccctgaaccctactcaaccgaatgcatactattggaagcctgctgcggatggagttttctcggtgaaaacggcctattccctcctctgtgccgcgaagatgcggtcagtggtcggaaggcttgtttgacggcggacaacctccagtggtggggttggcatctggcctcgttctgccacctctgtgggaacgatgcggaatcttgcgcccacatcttccacgcctgcgattacacgaagtaggtatgggcgtaggttagaagtcgcttgggcattgcctgtgacacatcctctggtgacatactgagctggtggtgcgaggcacgtaaatcggttcacaagacggatcgaaagccatttgatgcgggagttatcctggtgacgtggttagtttggaaggaacggaatgcacaggtgttcgatggaaaggccacttcagcggtgcatctttgtgctaccatcgctgacaagtgggaaacatggaaagccactggtttgctgtgcgcgatctattacggttagatagccgagagtccctcatgtgcctctagtgtgttcttagggtgttccgctacggcggttagttgtagcctcagccattctcggctcagggtgttctgtaaagattctcttcttcctaatatacatctcggccggttctttgccggcccggtgaaaaaaaggtatggtatcaccttgaacttatcaagatagtttaagcatagttgaattttaaagttaggaattctattgttgcgtccttttcccctcttgtcaaactgaacatgtggatgaccgtaacctcattttatgtttttgccctcccatttgcgcaggttccaagcaagttgtgctatcactgttttctgcaagttctttttttggtgcatgattgtcgagatccaacctggtctgctgggtttgtgcttttttttttttggtgtgcctgataccgcaacttcgcatgggactaaacatcggccttagcatgcatgttaagctcatgaccccctcgcgcggagcttgggcaggagccggcggtagtggcggaggtagggaggtgagcaggagacgtactaggaagaccggcgaacgacggcaacgaggacttcagcctcacccatctcggtctcgctaaaaccgaagatcattgagtatcgatgcaatttgattagtccagcgatgttggtttaggatgtccggcaatgtacattggttttataatgctaaaaaagatttttataatttagtaatcttgaaattcgtagttaataaatattgagttttagggtccgtttatttgtacgaaaaacataagaatttcggaggattttaatcatataaaaaacattcctatgaaatcttacgaaacaaacaatttaattctatcatatccttattataattctatggaatggataatcctatagaaatttcggagaatagttagtgagaggtctaaactcttggaaaaattcccttgaatctctatcatccgattcatatgtttttcaatactttattttacacatatccctaacagaatcctaatgttttttctattcctacattttctcatttctgctattttatgttttacacatatatctatcaaaatcttgtgtttaacatgttcctctatttttttcattcctgctatttaaagggacccttacttggtttggagtcttagttgtggttttaccatgttttaataagtttgaaattctaaattaataaaatttgactctattcagtttagagtctcaattataattttgacatgatttactgaatctaaaattttgtaataattaataatatcaagttgtactcggttggagtctcgattatagaccttttatgatttcataattttgaacttaataattaactagatctgggattgggaggagacggaggggattgggaagaggagacgcagcggcggcgacaatggggaggaggcacggaacgacacgtgctgtctccgcctctctccggatggaattggaaggaaaggtgatttttcctccagtaggacaaggatagggacatggaagggccttttttttaaaaaaaaaacttcttgaaggatcaaggagatgttttgtcaattgacggatcggatggctagtaactaccgaatgaagaatcagacggtccatgtgttcctgatgacatggctcattgtttttttttcactattttagatatttatgaacttgtcataagcttataacccataatggatgggcttgaaatgtagcccatgatgttaaaagtaaatctattatcatcgcactatggcatttaatcaacaagttagatttttttttaacttgaagacttctagaaaatgctttaattagaatagagatatagcagaaagttagacagagatatctacatcagtgaaaaggggatcccaagatcccaccaggatgagccacatcatcaaataaatatgaaccgttggatgcatgatttgaatgaagagaaccgttggatcaaaagagagaaaaataagttaaaaaaaaaaccaaatagtgtcttgggatgttctagtcccttcaagcacattccataaaatgtgtgataacaaatatatgagaatgaaaaatatcttcaaaattatccttaataatcaccaatgagtattcaaagtaattctactgtatcaataataaaagtatccgtgtaaatataaatagctacataatctaatactatcgattacttcactacagattaaaattaaaaaaacatgtgacatggacgatataataaattttgtaaagttgacttaaatcatatgattataagatttacgataaaatagcgtataaatacttctcaactggtgatgacagaattgcaacgcataagaaatgtgactatttacattactattacaattgacgcatttagatattgtaaaaggcaatggtcgcggtaatatatgataaattatttgtttacgatgatattcttaatgacaaatcaagatatataaatccattaatgttatagttacacttttgaaataatatgttaaaagcatattcattattaattataattaagaatttatgtccactaacataaacaatatataaatatatttaatagatggagaggtcatagtcgtcgtgtgaacccacgacttaagatgctagtatagatagatagttcatgaataactcaaccaaaagtaggtcctgcatcgccgttccggtagagaagagaagacaggcaaattagatattttgggcctggacgtttgtcagcatagccagatagtttttaaaggaatttattgactaagtgagtgtatctcaactgtttactgtttagattctggtgtaaaaccaatttatccggattcaagttttaaacttgacacaagtacttgcttttacggttaattattttttcagtgggaaacaataggcgcccgtggtgacgaccgtaatgaccgtggtgacttcattatttcaagatatggatgttcgtaaagatagggtgtagccaagtcttttagaggtgttcgtaaagatagagagtgtgtttgtgcgtttataggggtgaatgtgcacacgttgtttttattgtgttgaaaattaaaaaaagaatagcccatcttttcgcttatacttatgcttatcaatcaaaatttgaattttcaactttaaaattggagttgattttaaggtttttttttatcaaagtttattttcagcttttacttttagattgctaagaacacaaatataaaaggtttatttacaaattattatttgtttgtgaatatgttgtttgtcttatacaattagccaaacgatggggtcgtattggactgactgagctaacattggcgtgcattatttcaggtacttgtaaattaagttgaccagtgaagacaatccactcttatttgtacaacgtgtatctgacattgaacccgagcgtagatgccatccatgatctcggtcaaacttcagctattcggctacagtcgtttagtttctgaaattagggagaagtttagagaaagttggtagtttgaaaaaaaaaattgaaagtttatatgagtaagaatgttttagatgtaatgtgatgtgataaaaagttgagagtttgagaaaaatttagtggagagtattaagggatggtcggttgcaggctgctagtcaggagggaaaaagactgaagtacgtttcgtaacaagtttatttttagcatatttattattataaaataaatttattttt

SEQ ID NO: 81159 - DNA, 636 bp, Oryza sativa
gtcaccggtgagttcgccgcgtcgcccgcatcattttggtgcccttcgttagcgccgtcgtgtcgtcgttcgccggcgagcttgcgccatccggtcgccgccggtggtgacgtcatcaccgacgtcatcgtcgccgtgtcccgtggactggtcgtgcgccgatagatcccggccgttcgttttggatggatcgatctcgatcgttcgttttcgtagccgccgtcgtgcacccggtccaccgtgaaccctagccgatgacgcaataatcccctttcccttttcaaaaataattcattattgcgtcataattcaattaaaatctatataagtgttttaatccgatttaatctttgaaaattcataactaattcatcttagctcggatttagttggttcaagtctctagatttttctaaaattgagatctacatgttaaaaatatccacatgtactgttcatgcttgttaatgtgctgttttggggattttgctcttttctccttagattccgacgttcccagagagtccgatttcgcaggagaagactttgaagagttccaaggccagcaaggcaagccacacagatcccaaacaaccctttgagcatgttgatcccgtttaaagctattgtttctat

SEQ ID NO: 81160 - DNA, 54519 bp, Oryza sativa
ccaagtcctccctctccgctccctcgctgccacttcccgcgcgccgtgttcgcgtgcgcacgcccgcgcggatgccgcccgttgcaagccgcgcgcgcgtgccgagtggccgaccgcccggtcgccgccgccgtcagcctctgtgcgcgtctgtcgcccgtgtcgtcgcgccgctccaaatcgcccgccgtcatcgccgtcgtcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttccccttttcccccaccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgtttgttgttgcgcgtgtcgaaggagtcagcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcgtcgtgtgctcgccgccgtcgccgctcgagctccgtagcacccacacgtcgccagcctcgctaggcgtagctccgtccaatccgacgctagcatcgagttcccgaaaccgcgtagatgctctcaccgccgggaatcgatccctcgtggcctcgccgccgtttccctcttcccccccctccgccggttgtcgccgccgtcaagcttcctccggcaaatccgagccgttggctcgtctcccctcatcacgagcaaccgcccggtgtgctcgcttttgtccgtatcgccgtggttcgctccgccgctcgccgccgccgcccgccgtccattcgcggccgggtcatcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagccctgtccaccggctctctctctcctccctcccgcgcgcgcgcgtcttgggccgctctgggccgccttcttgggccggccggcccgttaagctcggccgagccgccctttctctcgggccgcgccctagccgcccgagggaagtctatattccctccctctccccttttcttttctttttcttttccaaaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcatgcttagaggtcattaatagggctttattttcgccgtttgttgagttgtcccgttttgcgtatagtttcggagcccgaagacccgcagagcgaggatttcgaggatcaagctccagatctcaagcaaggcaagccacctttggacatcttgagcctatattcgaaatctaattatattgcttgcaaaatattatgcattgataggattgcacttaatctgttgttccgtctgcaaggcagattggcagacctacctaacttgttgcatttgatccttccattgttaattgctataccatgtccccttgtaatcatccagttgcgcctcgatattcgtgcaccctgtgccagtatcgacggtcgccttcaaacttaaaatctgagtaacaacttgcgtaaaactggagttttacaaaagacttggaaaacccgacacctgggtcggtgcttgcgaactaaatgaatttccaaaaccgcggaccgggaaacgtaccgggtgtatggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcataaggtaaacctgtgtcggctttggaaatgccttgccatgaaagcttggaggtctcccgacgtggctgatccccacgggctgggtgatccgggttagtaatgtcgtgtgggtaaagtgtaccccctctgcagaggttaacaaactgttcgaacagccatgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgtccgcccctccgccgtcgctgtcgaccgctggaacaccatcgccgtcgtcaagccgaaggtcgtcgccgcttcttcctcgtcgccgttgctgtccgttgatcttccgccgttgttttggtcaccggtgagttcgccgcgtcgcccgcatcgttttggtgctctcctttcgcgccgccgcgccgtcgtttgccggcgggcatgcgtgcccgagtcgtcgccggtgatgacgtcaccgctgacgtcatcgtcgtcgtctcccgtggtccggccgtggaccgatagatctcggccgttcgttttggttggatcgatctcggccgttcgtttccgtgagccgccgccatgcacccggtccaccatgaacccgacccgctgacgcaataatcctcttttccttttcaaaaataattcattattgcgtcataattcaattaaaacctatataaaggatttaatccgatttaatcttcggaaattcataactaaatcatcgtaactcggttttgagtggttcaagttgctaaattcatctaaaatcatgatctacatgtttctttactttatatgtactgtttatgcttgtttttgtactgtttatttggtttttattagtctttttcttcgttttgcgtgttagcttgttgtttccatcgttgcgaaggttcgtgagtgcgtcgggagtgttcagaagattaattgaagaccgattattgcaaggaaagtcacatagatcctaaacacaatcctttgagcatgttgatcctatatttaaattctctctttatttcaactgtgcatttattttcgaatgtcactaggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaataatagttcacgatagtcaatcgtgattggttaattaattacttgccaactaaaacttgataatggtgggttgtgagcatatggttttgagagtcgcgctcatgacaattaaggaccggttcgcgagctactattgtgaaacattaaccgtgccaaccacaagccaacgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtatagccgggtatggttgttcaggatggttgggcctgtgcagcatgggtgtgctgttcagtgttgattaaaatttctaattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtagctcggctgattcctggatgagaattttacgcacaaataagttcaaaaattactagtgaatttccgggcgtgacacacacataaagtactattcatgttctatcgtttaataacaataaaaatactaatcttaaaaaaaaatcaaataagacgaacggtcaaacgttaaacatgaatagtgtaaagctgtatttatttgggatggaggaagtataaattataaggcctatattttttacacagtcttcaacgacatactttgaccattaatttatttcatattatatcatcaacaactataaagttaatattacatgaaagtattttaaaatgcaatcttattattaacatatgtaatacttgttgtagatattgattattagtcaaaagtcaccgattttgattttttttaaataaggacgctttataattcgaaacggatagagtagtaggatattttacatccaattattttattttacagtggggtattatttagttgagtatgtttcttttttctcatacaccttagagaaaacggaggaaaagggaaggctgggctgctccgtgaaaaggaaagatttggttgcttaccagattctctattgtatagctcggctcgttttctaattccagcctctcgtagagtgaggtcgatactcgtagagtaggcagctgcttcaattttatccaactcacatgtaactcttttagtaacttatgaatacaataagtaaattgtaataatgctcggcacaccaacttcacatcatattaaataacttaagcttcctttcacacatgtattccctcctttctaaattgatcatcatataatggaattcaaaatttctcaaattaattattatataaccgcatggacacatatttcatcagaatacaattaatgtagcatggaaaaatatacgcatgctaagttgtgattggcattgtgttttaatcgatgcatacattatgggagaatgtgtgcatgatgtcttaattgatatgatttaaataattattgggtcctgtttagaagattagcccagggctaatgtttagtcatgaattggtaggctaaacattagtctagggtagtatgtttggatccatgggctaattcaaggctaaaaggtggagacagagggagagagagaactgctttttatggtccccacataaaattagccccattagcaccccttggaggggctaatgttttaaggggggctaattcactttagcctcaaattagcccacctgtttggatcattgagggctaattcaggagtaaaaggtgggggctaataattagcccatagaaccaaacagggccttggtcttgtctcttggtgcataatatatagtataataatcaatttgggaaggagagagtagttcactccctctgcactcatcacttttctcgcaaagccaatgctcatcgtccgctctcactttgtctctcctttcctcttctctcctctctcatacagcttaccactgctcagggacggagctacattgaagagtggcggtgcccaggaacctgatcaataattttttttaattttttttaaaattatagttcatctatttttatcatatatgtaccccttcaatctaaactcagacgctcatatcagactaagctcagcctaaaatagagtaaagcaagtgagtgttatttcttcccatttcgttctagctccacccttactgtagctgaaatggtttctcctatggttagtctaggttgtactactgttgcactcgctagtagcagcgctgcagcagcagcaaattcgagttcctttctttgttttttatctttgttttcttccttccttggcataggccggtttagctgagtgcgtcgtgtattaaaactctattttttcaatttattgacatacaatctagcagcagcagcaggcatcgagatgggcgcagcggtgaatgccccctgaaacggaatggaagccgcggacaagacgacgacgaggcatcggagcaagagccgggccgatgttgtgggattcggtcccgccagcgtacgaccaaccccggccgctccgcgcccgcgcgacccgcacgtgagagcaccgcgcccgcgcgcgcaccaccacgcgctggaaatgctcgccgtccgtctctacgctaggcagcctcgcccacacgcacacagccaaagccaagacgcccatccatgtggtgtggcgcagcgagctgaactgctgaagtggtagtggtggtgtggtccatcgatcgatctgtgcagcagcagcataagctgcttggtggtgcgctcccctctgcgcggcggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaagagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttcaccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggttatagagcacttaaacttagttacaaagtacttcctccgtcctaaaatgtagacattttttaggttggcacgggtattaaaaaagtatgtgagaatgattggagaatgtgtatgattagttgaaaagaaaaggaatgtgaatgagaatggttgtgattggttgataggaggaggtaggtggaaaaatagcttcattttgggacaagacactgtgttagaaatagctatattttaggacggatgtagtacttacattgagctacaatgaatcaaaattagattttacaactgtttttgtttctagatttatgatttttgacatattcatcatattctctttttttaacgaatcggcgaaccgccaatttcatggaatacatgagtaaaattgtacaggcacaagacgcaagaataaaaaaaatgtgcaggctcaaggcctttggtcgaaatgcttcgcgcccgccaaggttcatgtttttttatcgcttcctccttaattttggctgttaggctagtcgtcaagagctctttttgctggaaaaccctgcggttccttttgttccaaatctcctaggcgaccagcagtattaatgttcgaaggagccttcggtgcttcgctagtccacgcagtagcctcccatcactcagagcaagtataatagtaggctataagccagctaaatgctaaggtggaggagaaaaaagaggagaaagaggagaagcgggctataaaattacagccggtttggacactctttttatccaccacggagatcagataaagaggcgtgtcggtgatatgggcccgggggtatcaggtttagagggaggaggccgcccctcgatgccacgtggccctcccccgaggggagtcaggcccgaggtggggtggcggccactccttccccaaagactagtcggaggaggctgccccccaatgccacgtggccctccccacaggggagtcaggcccgaggtagggcggtggccactccttcccagaaactggatggaggaggctgccctccaatgccacgtggccctcccgcgaggggggtcgggcccgaggtagggcggcggccactccctgaccgagactagagggagaaggccgccccaggtgccacgtggctcccctcccgaggggggatcgggcccgaggtcgggcggcggtcaccccctcccgtgactaggggtcgggctcccccgaccccctctctaggtcaccacgtatggtgggttaggtgtccgcctccaggggcccacctacccgcatttatggcgtcccgagcggtcgcgccacgccgcatgtaatacggtgtgcagtgcacccaaccggtctgtgaccagtcgaatgactgatgggacccaagatgtcaggcgcaccatcgcgtgtgtcaggcgacgtgtagcccgacatatcccatcaaataatgatggtgagaggttctcatcctcttatcccagccggagtcggtcctcccgctttggtcaaagcaaggctcctgtttcccggtgtaataggagcccagaagtcttcacccattaaatggtgactgacaggggcaccccccgtgtcaggcggcaagatttgacaggacccatcatcaagacgacgtgtgcttggcttcccaagtcaagagacaagacatgcatttaatgcaaagattataatacttatccaccggagctaggttaggttgttgggcccatatggtaaccccttgaggtataaaaggaggtccaggcctagtggtggaggggggacttccgagcgaactggcgtttgggtctcataaccccaagcactggtgttctacattcaatcaatcatgcacaggagtagggtattacgcctcatagcggcccgaacctgtataaacctcttttatctcatcgtcttggaggggcctaaccccctcaagatcacacagctccgctcaccaagccctcgaatctcacccgctgcccccggccgaactcacaaaggggggcctcacggttccctggtggaggagttcattctccgacatctggcgcgccaggtagggggcgcgttcgtgatttttgaggttttttcgagcgccggcgtggtgagtgtcacaccgccgctacgggggaaggcgcagcatcctctggagtgtcgcgccaccccaggcagggggcaaggccccccacatccccaccgggtaagcttggctaccaggtctttgtggcgagtcttcggaatgtccgagggcccccaaagctccagccctacctcaccgagaagtacgatgatggcgccgacccctccaagtccctccagatctgcatggcgatcatagaggcggcgaggggtggcgaccgggtcatggcgaacgtcttccccatggccctcaggggccaagtgcggggttggcccatgaacctgctgccgcctcggttcactcctaggaggactcttgcagttttgagctccgggtgccgtcgaagcccgggaccccctgtgctggctcttctttagcgactggctttggtcctgccggctggctacggtgtccggcctggctcaactgatcgtcctttcaagcttcaagtattttcaatttttcaattcattagcttgaaatcttatatttgtttccccccattctattctcatggccctgcgacgcccgcgtgttgcgcatttgtttgctccctcggtggtaagagcccaacctctctcccatctacatgaacgattcttcgctaagtgtgggggctaagttttctagccttcagttgagccccgagtgccgtcgatgcccgagaccccttgtgctggctcttccgtagcggctggctttggtcccgccggctagctacagtacccggcctggctcaactgtggatggggattgctggctctagagttttcggctctcacactcatgcgaaagtaatcgtccatgtagaaggaaaagagattggaagcaggccaccgaaaggaaagagcaaacagaatgtgtagcgtggggacacaggctcgtgggaacctgacctcgtttgctaagtggtcacaggcttcccaagatggttcggaacccatggtggggggtcctcttcgagctaaaggtttgtgtttgcttcattcatacaagcaattctttgctataagtgtgggggctacgattcctagctctatcctagccctgcgtcgagctctgggtaccgtcgatgcccggggccccctgtgctagctcttccgtagcggctggctttggccccgtcagctggttacgacgctcagcttcacttgatcacaggcgaagattgttggctatagaaagttcagtcctcacactcgcgcgaagataatcgtttgcatagaattattattgcttatatttatctctcgcctatctcttcctcacggtcccacggtacctatgtgtcacgcgccggcttgcctcccttggtaacaaaaagtttgtattcgcttcatccattcaaacgattctttgcttaaagtgcgggggctacgatttctagctctatcctagccctgcgtcgagctctgggtaccgtcgacgcacggggccccctgtgctagctcttccgtagcggctggctttggccccgtcggctggttacgacgctcagcttcacttgatcgcaggcgaagattgttggctatagaaagttcagtcctcacactcgcacgaagataatcgtttgcatagaattattattgcttatatttatctctcgcctatctcttcctcacggtcccgcggtacctatgtgtcgcgcgccggcttgcctcccttggtaacaaaaagtttgtattcgcttcatccattcaaacgattctttgcttaaagtgcgggggctacgattcctagctctatcctagccctgtgtcgagctctgggtaccgtcgacgcctggggccccctatgctagctcttccgtagcagctggctttggccctgccggctggctacggcgcccagcttagcttgatcgcgagtgaagattgctggttagggaaagttcagtcctcacactcgcgaaaataatcgtttgaatagatgaagtagaacatgaacagagattaacaaatggcaggagcaagcgaggtacgcggcgtaaagacacgggcccaagagaatctaacaacgtttgctgaatatatacagaaaataagttcacagcctaaggtacgggctagcgaatcgccctcaggctagggcgaaaaaggcgcatgggtcctagtgccagcaaagaaagaataagagatcgggcccacatgtcatttgactaacagagtggcgtcaaccctgaccacctaggaaaagttttggtcagggctaacgccgggggctactgtcggtgatatgggcccggggtatcaggtttagagggaggaggctgccccccgatgccacgtagccctcccccgaggggagtcaggcccgaggtggggtggcggccactccttccccaaagactagttggaggaggctgccctccgatgccacgtggccctcccccgaggggagtcaggcccgaggtagggcggcgaccactccttcccagagactggatggaggaggctgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatatgatatagtagaacaagtattgatccgaaggttaaagcacccatcggctagaggtccgatgtcatgaaatccacaagattagattaaacaatgaaacctttgttgccatcggctaaatccaacttatatgtatatgcaatccttatgagccgatgcaacgtccagataactcaccggctgaaaccccgatgaatcccttattggcaatcaataagcatgctagagattatggttctaagcacgacttagtagatcaaacttaactaatgcaacactaagtatgaaaagaaacacaatatctagacaatcaagtcgttgactgattttcagggtggtaaatgcctaggctaatctaatatagcaacgcgatttagccgataccggcagaaaccctaaagcgagagacagccgatagagctaaattgatatgctaagactagattaacagagacatgataaataggtaggcaaatatatcatccaaaccagagcaatccaagaggtcgaatatactgatgcagccttgaacgacgccgatgtagatgagacaattgcctggaccgacggaacattggacttatcccttcgccggagatcgaagacgatgcagccctgcgttgggtgccaagttctgccggaacgtaaaaaacaaaagtagaagtaaaaagggtggcgatgcgccgaattatattgatcgtagcgataaactacatagaccccgggtgtacatatttatacccatgggttgatacaagtccttgtcggataagaaagtacatagaccccgagtatacatatttatacccatgggttgatacaagtccttgtcggacaagaaagaaactttcctaaagataaaaggaaaagataaaatccttataggacactaaacacactttcctaaagataaaaggaaactaacaaactattcctaattaatagataacttgccatgccgcattctctttgaactcggtttcttatggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagggtcgggctcccccgaccccctctctaggtcaccacgtacggtgggttaggtgtctgcctccaggtgcccacctacccgcatttatggcatcccaagcggtcgcgccacgccgcatttaatgcggtatgcagtgcactcaaccggtctgtgaccgatcgaatgaatgatgggacccaagatgtcaggcgcaccatcgcgtgtgtcaggcgacgtgcagcccgacatatcccatcaaataatgatggtgagaggttctcatcctcttatcccagccggagtcggtcctcccgctctggtcaatgcaaggctcccgtttcccggtgtaataggagctcagaagtcttcacccattaaatggtgactgacaggggcacccccgtgtcaggcggcaagatttaacaggctccatcatcaagatgacgtgtgcttagcttcccaagtcaagagacaagacatgcatttaatgcaaatattataatacttctccaccggagctaggttaggttgttagacccatgtggtaaccccttgatgtataaaaggaggtccaggcctagtggtggagggggggacttccgagcgaactggcgcttgggtctcgcaaccccaagcactggtgttctacattcaatcaatcatgcacaggagtagggtattacgcttcatagcggcccgaacctgtataaatattttttgtctcatcgtcttggaggggcctaaccccatcaagatcacacagctccgctcaccaagccctcaaatctcacccgctgcctccagccgaactcacaaaggggacctcacggttcactggtggaggagttcattctctgacaaggcgtttttttttcccctcctcctcgccctctctctttattaacgtggccccatgtaaacccggctctttaatccccccgcagcgaaatcaaagcgtcggtacccagtacataatacctccacggtactcgtactcgtactccccaactcatgtggcaaacaaacgtaatcttctcatcccaccgacggatcgatcgatccatctctaccaaatgcgccccgcgcgtacgaacctatcgatcggtgtacgacgtacgcgcattccgcgaataatccacccctgcccctgcccctgccctgcccctgcctgtcacgctacgatatttaacgtggctgttggcctccgtttgacaaccacgcacgctgcgcacgcattcgttcgtgcgttcgttcgttcgttcgcacgcattgatgcgcggtccggatcccgacgccgctggcacgcgcgaggacatgcccccgtgcagctgctgctgacctcgatcgctcgcgcccggttttttctcccccctctttataacccactgaaagccgagtattattccaatgcagcagcagcagcaatcataaaatcgcagagaaaacgagagagagagagagagagaccattcttcttcttccacggcctcgctactctcatgagcaaggatgaggagggtgtggaggaggagcagcagcagcagcagcaacggcccaatgccatcgttgggatcgcaggagtcgccggcgacactgggatggccggccggtgagctgaatccaagataggatatagggaggatcgatatataggcgaagaaatatggaggggagttttggtgatggtgatggtggtggtgggttttcggtcgacggccggcgctgcaatgcggcatacaagggaaagccaggcattttctctgctgttccaagtactacctttcctttagctttcctctccatggaagaaaaaagaaacggttgcattattcatgtgttttctctgttgttaattaactcttgaggttgattaattacttcggtttttttagctaggcaagttaactagtagtagtttctgctacagatggtcaatgaagatcatgctaagacgacagtcacactgtatatctgcattgattccttccttctagattgttatgcattttcagatctctctctctctctctaaccaatacgtagctattggaagaattaatgtatgtccaattcatctcatcatctgtgtttgttgttgttgttgttgttgttcgaatccctgcttttgcacagtcactactactgtttcttttcggtgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctgtctttgctttcttttttgtcattggatttttgaggtgcctttagcgtgcagccttcgctcttgactattgcaccccggtaccacgtaccattgatgttcagttgggagaagttcatgatttggtggtagttgacgaatgctactacaattctcgagtgtaattatatatttgtatcgtactttctattattgcacccttttgatgcaattctttttctttccaagttccaacctaatggtacttgttgattttgattatatattcattctagtgcatgagtatctaggcgcctaggcctggacacaattctgctgtgttcttctgtactgcttgctgaatgttgcctgctctccaaaattttctgaatcctttccattagagtggtttctttaactgcatactcgagtaatacattgtacgaatacgcgtatatattcaatttagttgcattttttttctaataatgaaggattgaaggtatataactacttttggtctctacaccaggattacaatttaatctcaaggctacaccaaaatagcatcacttgatctaatcatagttagggggtaaaaaccatatatcttgctgtgagcctgtgagcatttggagccttatcccacgtggtatattgtaccgtgaacagaatctaactctttggcaatcaacgaattcatgataatgacatgagagaaaaagctccgaattgaaatttgaaagggatgccctagctctagtgtcggtacggtgctttgtacatgcaggggtcattgcccatccttcataaatcatatatttatggctcctttaaaacacagaaataagaaaaaaaacttcatccaataagactgttgttatagaaagtcagaatataaataaaaaggatgaaatggtattaagaggtctagtggacccacaactaaaaagacactctttgggacaaatctaaaacctataaacccctctttttaggacggagggagtataggattgcatgtataaatataaaacatagatgaaaaatgtaggaaaaatatactccctccgtactcgtaaaagaagttgttttggacagcgacacggtctccaaaatacaactttaacttcttgtttctataaaaatatttattgaaaagtgatatatgtatacttttatgaaagtatttttcaagacaaatctattcatataatttttatattttcaaactcaacaacttgagagttattcatgatttatattcctatggtttgatttaaacattgtcctaaatgacttcctttacgagtacggagggagtaagatagattgtttagaacaaatatgaacttagtaaaacacaagaatcataatgtcgttggtcaatttatcctcaaattatggttctttagagctttcattattttatttagcttggacttagctaataaatgaaaacaaaaaaatagggcttggtagatgttcgaattcatatggaatctctagcaaaggaaaatttccctctacctttcctatgcccaaatccttcattccaaacaagcgaatagtgccaaatacaatacaaattgaaatcatccatatttcctacaaaattcctacaatccgaaggagccctcaatgtggcccttaacatgagggttggatctcatgagaacttttctcaggtctatctctctcccaaaatcctatactttttctatggagcatccaacaacaagttacacacaatttctgcattctaaaactcctatggatcaactagctagtatgccacgtcttcctacatttttcctgtttctgtatttttgaattcatacgctccaaaggaaccctaaagaaaacctaatttccttccaaatgaagcatgcaaattcttaaatagtactaccaaattttatatttaggacatgcttttagagccatgtatacaattttaggtctcctttgaatttcagaaatttaatttggacgatttcaatccttgggatttttttctataaggtcattctttttttttcaattttcagatcgtccttttgcacgagagaatatgattgacaaaatcctaaaagtttattttatatacctccattccgtacggaatttttcatatcataaccccaatgcactctctcactctctctgctcttacgaatttttccttactattgaaaataaactaattctaaagaaaatcatgtgctccatatatatagctccaaatattatttatgcgtgttggagtcctatagatcaagttggaaatggcgttctactcgtacatttatccctttcttatgcgtttttaacatacttgtgtttgtttcaaagagcctctatagaccaataagaaacttcttttttactgtgaccgtgaagcttagagcaggtataatagcagactataaaccagctgcaaatatattttaagaagataaatgagatgagagaagagaagcgggctacagatttgtagctagttgtagcacggactccaagacgcagtgtgtatgacagatgggaccaggtattaatagtgtagtatgtaactattgtgtgaatgagctattagattggctatagatgaattggagctagtagttaactatactattaaacttgctcttatgtccaatacgggtgaggatcatctatcataacatcagcatcattacagtcattggtatgtgggtcactacctcctattatcacacatatcagtatatataatgatggtgtcattatgaagcaatataggctgtgtttagttcgtgtgtcaaaatttttttaagtatacagatacacacatgaagtattaaacgtatactaataacaaaacaaattacagattccgtctgtcaactgcgagacgaatttattaagcctaattaatccgtcattagtaaatatttactgtgcatcacattatcaaatcatgacgtaattaggcttaaaagatttataacacgatttatatgcaaactatacaattgttttttatctacatttaatgctccatgcatgtgtctaatgacaaaaatgttaaaagtttaaagaaaaaaattgaaatctaaacacggccataatccaatactcccatggccaatggctgcacgctttggcattggtaggaaaccttcaggcccaaccaaagaggcatttgaccaaaccgtccggaattcagtggcctcgggatccgttctttttcccgagcatgcgtgcggcacagcgaaattagctactcccagcaacaaagatggatcgttactccaacttgatatggtttagctaattagctagctttacacagcatcatactatcatactatactattactactataatcgtcaccattgatttctttaatcaagctatctaatcctatgtgccccctgtgttgttgagctgctggttttgactttgttggcaccgagatatatgtcatgagaattggtgtccgagacttgaatggttggtagctttgacgctagcttttaggatagatactcctatgatatcagtaaaaaaaacacatacacaaaatgaaatattaacagtgtttggatcgttcagatagctagctagcccttgaatacttcggttgtatgcatctcagctgcttcattatttcttaatccatcatgtattattctagtatctcgtggtgttctgtgtcagatgggcctcgttaattatagcttagcactgttgtttcaaaaatctgcggcttgcttcgcgcaacacattgactttctgcctgcatctgtaggcgtaagatctccttggtttgatgatccatgcgtggccatgttaatttgggactgatagggatccgtgcttttgtcagactgtcagtgtgcagcgttgatcatgagttagtacacctaatatgttcatcttcatcgatatctcaaacatcaattaagaataaactgaaatggccatacctctattaagagtctgtatcttatcatgccttgttaatcttgactgtctcataatcagccaaccaccttttatattagcgaccgacggcgaagaagaaaggtgatcaccctaacaactagctagctactcaccattttttgaaaaaaaaaacaaagaaaaaagaagaaagagaagaagatgtacgccattatttcgctccggtcaataacccgtaaaaaagcgtgacaatggaataaaagttaggttttatttttagacttgtacatgctgttgaggatttaaaggcaaagactaaagaagacaataaaaaacacatagaataatttaaatttaaacgttggctatggcttactttattaaaaaaaactaaacttagaagagaaatgtgatcccttctaatacaacaaatctcttcatctatttaaatttatggtagaggagtcacgcctctttaacattgatttttttttttggatagtgtgagtaatgcgctaggtacacgtacaccagtacagttagtacagcaacgtacagtgtgcgtctctggaggcgtatacgtatccggtttgatgagggcatggcccatgctagatcgccttggctttccatatcaaaggacacagggtttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtctgcaagtaaaatccgatcatccagagttccagactgcttgcaaatctggactagaaggagagggcatcattcacagggtgatatggacatatgggacaagggcatgcaggccgaagggaactctcacaatggcacaaggaatgtttcgaaccaactgtgtacaaacattcacaccaaataaaaataaatgagatcacatgaatcaaaatccaagaaaaagagcgtacgtggattgaaccacatacacttttgaatcagaatagtgcatcaacctgcctactcaaaataactccaggtacaggttttattttatattttttttaatcgaacaaaacaatcaggcagacaatgtacatcgcgagagcgggctggttacgatcgctttgctttgatcacaaagcgaggccttccttccgaaatgagattctgctacacctgtgcaccgcgccgcttttcacaggcccatcgaccgttttcacgggcttttcggcgtcaattatcgcggtggtattttgtttggagtcgattgccttttgttcctttctgctctccagaacagattcaagcccctaaaatgtgcacaacacagatatggattggcataaagaaaccgaaattacctgaatggaggacaaacatctgcatattaattgtgtattaccttcactgcctttctttcagactgagccaactctgtgagcttgagtttttcattagcttcctgtggaatggagagcatagaaggatcattacagcacaatgagcagtatgagccaaaagaaaagcgaactatccaagataaggcatccttagaccttgcatgcaatcctgaacctttataaatgatatctactcacctgaaaaaacttggcatttattccatcttttagacctccagctatttggcagaggtaccatacaccagcattagttgcatcctgtcggtaaacacaagaggttaggcaaaaggaaaaaatcagcacgttaaatattgatgggtatgtttagccacctgtttattatcaagcaactcgatcttcccttcctgataatgtcaaaggagaacataaaggtcaggataaccaaagaagtgttctgacacaggttcatgctcaagggttataaactaataaaactcaccaatccagcaaccatctgttggattgctgcaatatcaaatccaatttgagacagatcatctttgacatcattcacctgtgcatagagaacagaatcatgtcttttgcataacattgggaagaacaaaacttttctgctttcgagaagaaaatgaaaaatgctgtaaaatttatctttccatagatgagtacttgcagatttacagtagctatttttaagaaggtatattttaatgcaactaaagaccattcattgatgacaaatatcattatgcttatgcttgcgcttgtatatattcttggcttcatgatgttgttttatggtttatgggcaagatcgatcacttggaatatgctgtcaatgattatagtaaaagccaacaattccaccatatttcaatgcatatcctataatagccatgtcaagtgcttcctggctttatcgagggcacagtttttagcttgaaacaatattggcatgacaaagaaaatcctgatccaccttttcagatgcgactacacaaatcaaactaataagagttatgcacctcaggtagaaacacaatttaataataaagttatcagatgctaattagacttgatgtaatgaaaaaaatgaaacaataattattgctccagagaaaaaaaaaaaggaacttcaaaaatttccatgtgtaaaaagttgaagggctagcagcatcacaaatcaacaaacctcgtttctaataattttggagacctccacttgctcatccattttcccatctaaattttccaggcgctgacttagatgcctttttgttgcctgaaattaattgaatttagaaaacactagtcagcatatgcgaaggaaaactacttcaaatatgtaacgattcagcatgtaaagcatacagctaaagctgaagacacttgatccaattgcttcgacatactctcaacagctttggtcatgttgcgtttggtaacaaacatgacatccgataaggacaatccctgcaggaagatactataatgtaagaaaagtttaacacatacagttcatcattgtactagtaatttagtctacaaacaccattaggacaagacagatttgatggttttacttaaatactagggcctagggatcatgaaaagagtctctcaacccgaaactgtgattcttgatagaatatttggtcacagaatcagagaggtgttattacatgactaagaaagcaatttaatcccccgcccaaaaaaaaaagaatgtggtttattcatgatgtctcaaaatacatacaagggtgccaaatgccaattatatatcaaagttggatacttggatccacatagaaccactgggactgcatggaaatactttacagggagacttaggtagcatagttcttaagacatataactacaagaaacaaggtaaacaagcaaatggggaacatcatattactctcttcattcagttactaatttattgaaggctgtaagtataataaaaggaaaaggatagtaaggagtgtttgtggagaaagaaagcaaggaagaaaaatcagaatataaaagctgatagatcaaagtggcattgtatattcctgattttaccttccaccacatatagcagtaacccattgctccaactgcagctgcaggcagtatgtaggaggataaactgcctgcaaaagggatgcaaatgctagtgaataaacaacacggataagaaaaagatacatgtcacatggggacaagtagctagtgagatatgttcatgaatgttgtgagaaacagctgaatgtaccagcattcctatcccatttgtcattacattgctattattgaccaatcaacatgattcatactgtaatcgctgaagcatttcagcttcatgaattactcaatattgaattagagaatagagattgacactctttaacgagttttagcaaaaatatgactattgaccactttttcaccaaggggtggtagccttgtagaggagctgatacaagccaataattgtctatctaaaccttaagattgacaaataatctaagtaaaaagatgtaacaaaagctttatatggatagactctttgcatgactgctagaagagtgaaactgaaaacagaacgaggagaggatcaaacaagaacaaacctccagagtcggagttgccactcaatatggtaataggccttgatatagtcaaatctctaacttcttgtgctaaatttcgaatctgcagtcaagcgccagcacacaaataataaaaacaacaaactgcagtggtttttactgaaactggcaactttattgaaattgaagtctgcattgtaacttccattcaactgttgattctatgaaaaatatgaaacgatgcatacctgagattgaagaagggcgatgtcataggcactcgaaccttctccttggtttacacctttcataagctcctaaaaacagggaaaaaaccatctacttcaataaacatctgcgattttatgagttactacaaattatagatgaagaacgcatcatcatagccattgggtgattaacttaggcatgacattccaattggtgcatcgaaatgattcgacattgaaattaagcgacaaaaagttatgcccatgtgcacgcccaacgtttgatcggtgaaatgtagctgtaatgcatttgataaattggagtcccacaaacagatatataaatcacaacatcgcttgaaacacacacgggcaacactgacgcgcctatattagcgtattggcaacttacgatcgataacgcgaagcaatcaacagaattagatgcccagaatccaactactctactcaagaaacatcaggcaatccaccgacctgaagctccgccaacacgtcagatagccggccattccgcagcacgatcgagctcgtcaaccctgcagctcgacgccggccaaaaaccaccgcatcaggatcagaacacagcggggcgatccgcatctcgaatcgatgctagaaaatatagtagagcgggaggaggaggaggaggaggaggagggggaggttgcggtgacgagacctgcgccgacgaggatgaggaccttggaggtggcgaaccccgtctgcatcgccatcccctcccgccgctcctgcctccggggctccccccgtctcttcctcgcgtccggcggcggggtcggtggcgaggtcgtcggcgaccgcggggaggagagagagagagagagaggaggggagattggcgaagcttcgggaaggggaaagctgacggcgaaggcggaggaacgtggtgactgacatgtggaccccaccgctctcgggcccacctgtcagtgaccacgtcagaggggtgcgcggacaactgggcgagtggtggggttggacccggcttcgcttctgtcgatggtttggcgagcccgacccgagccggtttacacgtggacggaccggatttacccattggggtatttgaacggggatagcgcatgccacgctgtgctctagaatgccaagtcagtgcacgtaccacggcattactgcgtgaggcctgagcgtggatttttttgttatgtcttgaacctttttatttttaattaaaaaaacaattgaaaaaacttattttaaaaatttgaatcttttagctacgcatactgtcatgccggtctgcctaatgttccatcgttatttggtcacgccggcctaacggatgtgacaatgttatttggcctcgtcaccctgactaacgtgataagataaaactatcacgcccgttgtggtgacgtgtcgatgttatattgccacgttggatggaatggcgtggtcaaaagatccatattttgaagtaagctttggaatggttggatgaaaatttggatattcatgacatgcttttcaaactactaaacggtatgttttgtgtaaaaaaaattttatatgaaagttattctaaaatatcagataaatatattttttaaatttgtaatacttaattaaactcaattaattatacgttaatacaatctcgttttgtataaacacttaagcttcgtcttaatctgtatgagtttcaaaaatcaccttagcaatcaaatgtttgaacacatacacggagtattaaatataaacgaaaaagtttagatcctctagcaaaatttttcgccatgtcacatcaaatatttaaacacatgcacggagtattaaatataaacgaaaaaaactaattacacagattgcgtataaaattgcgagacgaatcttttaagcctaattgctccataatctgacaatgtggtgctacagtaaacatttgctaatgacggattaattaggcttaataaatttgtcttgcagtttacaggctaaatctgtaatttattttattattagtctatgtttaatctataactaatataaatattcgaatttttccggtcgtcacactggtttttcgtcccgcttcgtcgccccccctcccccaaaatcccaatccgaatccaatcaaaccccggaaaaaaataacaatcacaatcggagttcaatcacacaaatcatgatgcatgtacacatatatatccaaaccaaaaccaaaaattagatcaagggggtcaccaccgccgtcgccattgccgtcgcagagacggctggccgccggcggcttccctcctgctagatccggtggaggggagagcgccgccaccgccggtccctcccgttagatccgccggcggtggcggcggagggcgctctccggtggtaggggagagggccgccgccgtcgtcggtggtgggagaggactccgccgccgccgctgctcgcgggagaaggggcgccatcgccgccgctcgcggggcacctctcctcccgctagatccgccgccggtggtgggggagggtgccgccgacgccgctgtggggggtgggcgcgccgccgctgacgccgccactaccgccggatccatcgctgccggatctagggcgggagggaggcgagaggggaggagggagccgccgccaccgccgacggactcacccgccgacgccatcgacaccgccatcgccgctggatctggggcaggagggaggcgagaggggagaagggagccgcagccgccaccggatctgccgcgggagggaggctagagggggtggagggagccgccgcccccaccctcggatctgtcgcggccgccaccaacccgccaccgccgacccgagagggagaggaggaggggcgccgccgtggctttgactgagaggatcacctccccgggagccgccggtggtggggagaacgccaccgcgctgccggtggtgggggaggacgttgccgcgccgccagtggtgggggagacgccatcgccgctcgcggggggagggcgccgcctctgctcgggagggagggcgccgccgcggaccgccgccgctcacggggggaggggtgccgccaccgctcgggggcacggaggggagggcggcgaagtgaaatgggagggaggggagggaaatgggctagggttttggcggctgagagggagggggttttgtttccccgatatcgacgctcggccgtccgatcaaaaccctagaaatcggacggccggtgtcatccgggccgaaatcggcccaagagggatcgagagtgaggccacttttctggctcaagcccaggttgcggcttggggaggggaagtgagcccacgcgtgcgcaaaaggccgtgggccgaccggtaagggccgaaaataagtctattttaggtccctcgggccgaaaaaaagagagaataagttcatgtttagtgctcattttttcagaagcattacaattatagttatttctcacacttactttacttgtaaatttatttaattatacacatatacctacttaaaaatatcaaatatttcagcgaatttgtattttaattaattgcatatttttctgatatgtacgcttcccgttgcaacgcacgggcacttttgctaaaccaaacaacacttttggttaatatacacactccgtaatcacccggtgcaacgtacggacacttttgctagtactttaaatatgtgttcatatatccaatatgacacactaaaaatttacaccctgcatctaaacacagcctcaatcatgaaatattgaattcctatttttcaagaggatatacgcggcatgagcccatggacaggcatttaccgccgctgttccccgcctagccacgtctctgccacgtcaccacggccactccccggggaagacgaccgttcaaacccgccgcgactacccgacggcggcgcccatgccgccgccttctccctcacgccactcccactccggccaccgcctccacctcctcctccccaatccctagcctctctcgcctcgccggcgccggcgtcgccatggcggcagccgccgcccctctccccaccctccccctcctcctcctcctcctcaccttcctctccgccgcctccgcgtcgccgcacatctccgccgtcatctcccagtcgggcctcgacttcgtcaaggacctcctcgtgtcccgcgccgcggaggccatcgtgcccctggaggtgcccgacatcgagaggtccgtgagcatcccggtcatcggcaccgtggacatggtcgcctccggcatcgtcctccacggcgtggcggtcgacgactccaccgtcgccgtcggggacgacgggatcgtggtggccgcgtcgctgtccagcgttaatcttactatggggtggagctactcctatagcgcctgggtcgtcacgatctctgacagcggtaatgcctcgattcaggtatgggtcgcggtattcatgcgttcaattgttgttgtttttttcacagttcgagagatgatgctagattggagggggacttccatgattgacaagttaatgttcaaaattagtggtttagtgtctgaatttgcgcttattggcatgtatggaatgaaacatgtatgtaaagtagaatccagcacgttatgaaattgagtagctttgaagacactttcaaatctagttctttagttggtacatgagtaatttacattgataggcacaatagctggttacttgttgcacggtgcatattggggtgacatgtgggctgcctattaggagcagctggcatttgtgcttaggatttacttcaagatgatcttaactttttctctagatcattttagctcaatggagtttacaattctaagcacctaaatagcagcattgcagcaggcaagcaacatttcaataacatagatatcctatatgctcctcagttaatttgttggaattataagctgcttcttttttaaaaagtaaaaacgtctcagttgtgtttttgaaagtttacaccgaaacaatgtcacctatggcacttacaccttatttacctgtattatttgagtactagacacccttgacatgtatatatacgaaggtacaagatgtattcatgattccttttcgctaaggttgatggaatggatgttgggatttccatggggatgaagaatcaaaatgggtctctcaagctgttcgttacagaatgtggctgtaatatgaagagcttggacatatcactgaacggaggagcatcttggttttatcaggggtacgtgcttcacaattttacatatgcaaaaacttgtcaaattaactgaggttgctctgtaaattgcttgtttggtcgttagatcagagggcgctcatcccttgctcagtccctgaaaatgagataacataggcttttgatatctgctctgtcaacaagccctggttcagtccctgcttcctccagcccttatcctgaaagaggatactttttcttccccactcatcttattaagcctttttctttgccggcttagcttccgtgcccagatagactttgactatactataaaagagagctagatgatctgttatcaagtgagaagaaaggctggtccagaaccaagcgaacaagggcttgtactgtcggaggttccaatggttccattcttgatctgatttctcgctatcttattcggtggcacaatacaaaacaaaatatgactcctataattgcccgatgtgggtagccatgcccattctaattctatttttctgtacatcagcaatatatataggaaacatggtttatatctgtggttagaatatcatgcaattttttttgtcaaaataattgccctatatattcctgaatgctgttgatatttatctgaccccacatggattgatattattcctcttaccttttctaggtttgtagatggtttcagtaatcatatcagatcatcagtagaaaatgcaattacgaagaaaataatggagggtgcatcaaagcttgactcattccttggaagccttccaaagaaaatcgatgttgatagcatcgctgctatgaatgtgacatttgttagtgatccactcttcaagagttcctctgtggagtttgatatcgatggactgttcattccatctgataaaactgcagtttcaagacacatgcattttagaggtgtaaaatatgtaccacctcttggtagctcttcaaaaatgctatggatttcattggatgaagatgttttcaactctgtttcagctctctatttcaaggtatatcagaattcataagaaagtggttgttatcatggttaaaggattaaagccttactgcagatgtgtaaagttgaaggattatctgaacttgcttttgtcaaaagatatatatatatatatatatatatatatatatatatatatatatatatatatatatatatatatatatatatatatatatattacacaaaagaaagatatatattttgttgattgtgtccgtctagagtagctaacttgaacacgtgttcatgtttgaatggaaacaattattccctccgtcccagaatataagcatttttagagttggacatggttactaagaaagtaggtagaagtgaatggtggagggtggagggttgtgattggttaagtagtggtagtaggtgggaaaaatgaatggtggggagttgtgattggttgggaagagaatgttggtggagaagttgttatattttaggacaaatcttgagggctaaaagttgttatattttgggacggagggagtaacaaatatgctaatagctgtaaaaatatatattctaattgatatgatacttggattgttcaggctggttcactacaacgtatggtggataaaattcctgatcagctcttcctgaatactgctagttggaggtttttgattccaaggttatatcagaagtaccccaatgatgatatgctgctgaatatttcagctacttcacctccttccgtgaggattaatgtgggtaggattgatgccgcagttgacttagatgtcacagttaatgttttggattttgatgagatagttccagtggcgtgcatatcagtggtgagatttttctaataatttcctttcctgatttcatttgatttcattgctagttgcttgacttatggaaagtaaacatattgaaatgtaacagtattgcaccatctggcagcacttgtatactgtccgtgttgtctttgaccttcagcatttcatattttctcccactgagaattttagaaatgaaatctatggcacattgagttgtgttcatgttttctttttttgtttcatccgttgatttacaattggacttccattatacataaacatttctacacgaggaaacacgtgcaatttccacctctttgataccgttgtcgcatattgtttccacagtcagttactgtctctggagctgcagtggtttctgggaacaatcttgctggaagagtcgagttagattatttctcattcaccttgaagtggagcaaagttggcaaacttcataccttcatagttcaggtattttggcctgtattatacgatttaatgacattccacagtttgtaatttatgatggtgtaatagaaaagaggtgagcttgggaatctccatcctatatttatggatatgcctaatttccaagagggactctgaggggctaactaagacatgcgttatcctattggaaagaaaaaagtaatttcggttgaaaatgccttcttcataaagttcttttacctagtatagcggaaaggcctaatttctgaatgaagttgttaattgtggagctgcacatgtattttattatcattggtgaacatttgtttcttaacttctgaatgtctaattgattctaatttttgtattggcagagtgtgatgcagatcttgttgaaaaaattgtttgtgccctatgtgaattcatatctcaaaagaggcttcccattgcctatcatcaaggggttctccatcagcgatgcatacatcctcacttcccagtcaagaataattgttagctctgatgttgccttcatcggaggtcatactccctatttaagccaatgaaagcatctggcaagaagtaggcttgttgctcaatcagcaaagcatcagaaatcgccatgtcccatggaacgtgtagtgctacttcctcaacatgttagcattatttcgttctgctgtataatgttcttttgtaaataaccgtaggagttgtacatatgtaaatctaggaaccatagaactgtagaaataggctgctgctatactggagaaatggtgggttggttgtgatgtacccacaattcttccaaatgaactggcaatatacttgtacacgttctgtcaaaaaaaaaaatgtacactccactgtatagtgttcagttctgtaatctatgctgaatttgctgtatttaaccataatctggaaatgtatcatcgttccagtatcaattcctgacttcttgtattggtaagatataaattatcactgcaatctgcctcactgaacctgtaaacacaaactgatctctctttattttcagtgtagctgaatttgacattttacactatcaaaataaataaataaacaaatagaatttggcattttacaggaagctccttgaggccttgagtaatcaggggtcagtgactctcttcctcctcctcctcctccaattggaaaaacaattttaggataagacaggggctaccccgcaaaaatgactctccgttatcctcgagtcgagttccccccaaaacccagaaaaccccacgacgccgtcgccaccgttcgtctccgcctccgcctccgccgccggaaatggcggccacctccctcctctccctcccctcgctccgcctcacccaccgcctcctcgtccccgcgtcgtcgtccgccccagcctcccgctcccagttccaaacgctcgccgcgaagaaggcagccgtcgccacgggcaccggcgagggcggcggcggggggcgtggagcgggcggcgggctgctgtcggtgctcgaccgggcgatggcggacgaggaggagtaccgccgggcgcgcgcgcaggtgcaccgtaagggcgtggaggtggaggggtacgccatcgagggggtctccgtcggcgggcacgagacctgcgtcaccgtgccgtccctcaacgtcgccttcgacatcggccgcgggccgctcttcgccgtgagccaggactacctcttcatcacccacgcccacctcgaccacatcgtgagcgccccgagccctgtcctggtttgattcattcctgtgctgcttgtgcttcgtgaatttcgtgtagaggcaactgcgcctctagctaagcttgggtgcgccatcggtgaagtttcatagaaaagctgatgtaaggggattgattcagtaatttcaagggaattgtcaccggggaaatgcctgcttaatttactatttggactgtggcctttagtaaatgtctgcttagtttatttgttcaacaacatgctatcgtgaattcgtgatggataggatttttatcaccaattcttctgataagttggcctaagttagtctgcgtgtaattcttaaataataaatagtctcatcttgctctatacctgcttttactttggagcggtgtcaagaaaatcatgattgtgccaacatatttctcctttgcatagcaacgggagaattttccaatgtttttccctttaaactgacgaatatgcttcactgtcagtttttccatttgctgctctaacagaatcacaacataaatgcagccatatccacctcagttttgttattttgattgttcagggtggtctcccaatgtacatagcaactcgtggcctctataatttgaagccacccgttgtatttgtaccaccatgtatcaaggatgatgttgaggatctacttcaaatccatcgtagaatgagtcaagtcgaccttaaagtggaattggttgcgcttgatttgggtttgagctcgtttcacctcttctttctgtgtttctctctccttgtttatttctaatgtttctacgattgcattcaggggagacatttgaaatacgtaatgaccttgttgccagaccatttgagactcaccatgctatacccagccaggtataactccctaggtcaatttaagtatagttagcaagccaaaagttctagttctcacctttcttggacaatttagtgcttaataactatttcgccccttgtgcgggttgtgtacattcacagggttatgtcatctactctgttcggagaaagttgaaaaaacagtatgctcacttgaagggtaatcaaataatgaaaatgaagcaatcaggcgctgaggtcagctagcaatctgttctatataagaaatatattctgcactgttactcactgccttcttttctgtcagattacagatactatactatatccagaagttgcctttacaggtgacacaaagtctgattttattcttgacccacgaaatgcagatgccctgagagcaaaagtccttataactgaggtattggctttagattttagtttccttgattattgccctttctcccaagcctgtcaaaagtatttgttccagctgtatgtaatcagtcacatttagagatgtaatcattctcatgggacatgtcaaagtcagcaaaaagggtgtgaagtataatactccctccatcccataatataaggcgcgcacgaatttcaagattcaacctttaaaacatttgaccaacacttaatataatatgaaaatgaattttgtttgttaaagattacatcattagattgagatctaaatttactttcatgtggttataattttgttgctacaaatcttatagtatatgagaaattataagctaaagattagttttggagaccgtgccaacattgaccacaccttatattatgggattgggagagtagtataatacagctatagtcttgaaatatcagagaacagtaaaaggcagtctaagtaaaaccaccctattatattgatttgtcacatcttcagactgtaaaataacaaaagaacttcctttttatttgatcagagggtccatcaaatctgaaacatgacaaaataatttcaaatgtcctccctattgaatgctttggcaccaacattatttgaccttttcacaggcaaccttcctagatgaccaaattgatgttgatcatgctcgggagcatggccacatgcatctctctgaggtaaatgatgatgcacttgtcactttctccctgccatgctatgattctaatgagctttgggacaattctgatagttaaatgagatgtctgtataaagtattactgcattaatgcaaatctggtatgtcgtctacagataatggagcactcccaatggtttagaaacaaagccattgtactgacacatttctcaaatcgatatagtcttgaggtatgtaatcactaacctataaatcattgggaatccagtgtttcctaaaaataatagttgcggattctagactaatctgacccaaatgattattttgtaggatattagacaagctgtttccaaactacagtcaaagttatcttcaaaggttgttgcactgacggaaggcttcaaatctgactatagatagtgtatagaagtaggtcagctgtgcttctcacccttacttgctgagaataacttgagttacttacactaggaattggccattcatgaggaaaaagggacagaattaataggtttgtgctgtttggcttttgtatgtggcatttatatctcctatctttctatattagaaaataaagtttatatagcattataactaaatgattattgtgatggaaaaatctatattatacatgccaaaggtgattcagtaacatacataacattttcttgacactctccagcttccagaataagaaaaggttagctaaaatctctctctttctgctgtttttttattccccccgcccccccttgtactatctctctcatgtacatattatattttaatatatcacagtaggagcctattctgctgtttaaccgtctaaaaaaaagaataagaaaaggtgtaaaaagctgggtattacaatacgttggagaatctgaaggccaaataaactgaaatcatgaaacgcatacatctgcatgaaatccaataagttgtaaaatatcgtacagtttcatccttgaaagcaacaagcaggcatacacttctattactgtgtactgcgtaccatgagtacgttctcttgaaaaatagataagttacgagtttgttctgaagtgtcgtacagtataatccttgagaagcaacaagcacccaagcaggcacacactaatattactgcataacatgagtatcttctttggaatagatcaaccaatgagtttgttctttgaagcttcttttcttgtattcttttttgctaggtacatgagagcagtggcagtgctgctagtatctggttttagcataacggattttccttgcatcaatgtcttgttcacttacatgttcaacagattcgtcatcagtggagcaactttcaggatcttcgcgtgcgggaatgatgaatatgtcagattcatcaggtaatctgaagctaactctcctcatgctgttttggctcctaatagagattctatcgatggagaagctgtcccggatgttaggagaattattttcataagaacaatccgggttaattgggcaaacctttggagagtgcctccgaggtgatggggctccaattgcctccccctgaaagctctgaggagaatacaagatgtcttgaagagtgttttgccttatttctgccttgactgttctggtcttgttatgctgctgctcctcttgaaggcatctgggcttcattctgttgaatagtgctttaacatggcaacagctctgtgagcccatcttttccctctcttctttggtgatgaacgatagtgtcatggcaaatgcgcttatatatgtccatgctccgtattgtgttgggcaagtaaaataatctgttttgcatatactaggttgtgtcaaaccttgttcatgtcaaagtaggacgaattatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactacctcaatacttccattctaacattttctatatttatattaatgataataaatctaaatagatatatatgtctagattcattaatatcaatataaatatagtaaatgctagaatgacttacgttgtaaaacagaaagagtagtatactccagccaactactaactctaaatcatctatagtctatctaataactaatttatactagttaattacaaatatataatacaccatgataattggtcctacatatcatatatatatatatatatacacacatatatatacacatacattttaaagttcgtgctacagcgatgtatatctataacccgtttttcttctctcctctctcttatctccttcacgtatgtttatactgctcttattacctccggtcaccggcacgtacggacgtgacgacgtcgcacgcgcgcgcttataaatgcagccatacatagtgcgatcgtttcgtggccagagagagagagagggggagagagagagagagcagagcttgaactgaccggccggtgcagtacaaataaaaattatacgagcaatcatgtggttgctgccgctgatctgcttcgtcttggccttgctgctcgccgccggcgccagcggtggtggtggtgccgcggctggaggaggaaatggcggcggcggcgagcggcgtggggtatacgtggtgtacttgggcgccgtgccaccgcggacctcgcccaacatcctccagcagacccatctccgcctcatcggcgccgtgctcaaaaggtccatcgtaaaataaattaatttttaactctcttcctgttggtgctaatgtctctcaagttgcactagctagcagtagcatgcatgtcagtcaataagaaggtactcgctcagtttgccgatttgtagcatggcattaaatatattctctccgttttatattagaagatgttttaatttttcaaagttaaatttctttatatattagaagatgttttattttttaaagttaaatttctttacgtttggtcaagtttacggaaaaatgtaacaagttctacgatactgtgttagttccattcaatctaaatactgattttttaaaaaaaaatcacgatagacatacacacgccactacatacgcagcaccgcactcacaccctcacaaatggacccccccctaacatatgctctaagagatagaaaccaacggcacatccttgatctaacaaaaatcctgttaaaaagcacatgcagaccatcgacatatcccttatctcactaaaattctattaaaagtctacatgcatgtgcataatattcgtgggcaccagaatttgaaccctggttagtagaatcatacactcacgactccgctaccacaccactagtgtttttccaaatattgaatatagtacgattgtatagtataaaaactatttatatgtttttcttgatcaaacatatatgatttgacttaaaaaaacaaagcatcttataatgtgaaatagaggtagcagttttctaaaaaaaaactccatataaattaaaataagcagacattgttacgttaatttaaaaacccgtgtacacttctctcactttgctacagtgttgcacttcttgttaatttaacattgtctttctctttaactattttcaatggttgaagattattttaatcttactatcgttatatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcagcagtacaagtacgccttctccggcttcgccgcgcggctgtcagcggcggaggccgccgcgctccgccggaagcccggcgtcgtctccgtcttcgccgaccctgtctaccacctccacaccaccaggtcatgggacttcctccagcagcagacgacggccgccgtcgacgtcaagactggcggctccgcccaccgccgccgccgctcgccccgcgcccgcgccgccgcagcatcagcgtcgacgtcgtcgtccccgacggccgacaccatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttgtgtttaattaagtttataaaaaaatagcaacatttatgatacaaaattagtttcataatttgacgtatattttgatacaatgttggttttacattgaaaatttactacttctactccctctgttttaggttatgactttggtcaaaattaaactactctaattttgactaattttatagaaaaaatagtaatatttttaactcaagacagatatattatgtaaatttattcaattatagatttaacgaaattatactggtattgtaaatattatacttttttctataaagatagtcaaatttagagtagtttgattttgaccaaagtcaaaacattttctaatctgaaacggaagtagtataatttggtcacttaaaaaaattaactaagaaaaaagtcattacaaatgacttgtaatatgaaacggagagtatatatcctgatgtttcccgggcggcgcatgcaggaagctgataggagcaaggtactacgatgtcggcggcgaggcgaagcggcagtcagcacggagcagcgggagctcgccgcgggacgaggccgggcacgggacgcacacctcgtcgacggcggccgggaacgcggtcaccggtgcgtcgtactacggcctcgcggcggggacggccaagggcgggtcggcgtcgtcgagggtggccatgtaccgcgtctgctccggggaggggtgcgccgggtcggccatcctcgccgggttcgacgacgccgtcgccgacggcgtcgacgtcatctccgtctccctcggcgcgtcgccctacttccgcccggacttctccgacgaccccatcgccatcggctcgttccacgccgtggccaagggcatcatggtcgtctgctccgccggcaacgcagggccggacgccgccaccgtcgtgaacgcggcgccgtggatccttaccgtcgcggcgagcacgatcgaccgctacttccaatcggacgtcgtgctcggcggcaacaacaccgctgtcaaggtatatatcacaaaattaaatatatctggacatgttctttttcccagattcgttgtattagaaaaaatctcatctatttctaatatctcatccgtctaaaatccttgtgggagcactctcttgtgatcttaactaccccatttttatggaatctgtagggtggagctataaacttctccaacttgaacaaatcaccaaaatatccattgatcaccggtgaatcagccaagtccagctcagtttctgataccgagtcagcaaggtacgtactacaaggcaagcttagtaacgaaacaaaattaaattaacagaaagtttcagcagaatctgagtaagtagtttcatgcccaaaaatcaaatcataaccacaaaataatttgtagtcactgtgagccggggacgctggatgcgagcaagataaaagggaagatcgtgctgtgtcaccactcgcggaacagcgacacgcccaagacggagaaggtcggggagctcaagagcgccggcgcggttggcgccgtcctcgtcgacgaccttgagaaggccgtcgccaccgcctacatcgacttccctgtcacggagatcacctccaacgccgccgccgacattcacaagtatatctcctccaccaggtactatacgtagtccttcacactatagcgattatatactacctccgttttttaatatatggcatcgttaactttttaacaatcatttaatcattcacctttatttttttttcaaatagaaaaatatttaagttatatttataaaacatttggtaataaatcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacatcctcaagccggacgtggcggcgccgggggtgaacatcctggcgtcatggatcccgacgtcgacgctcccggccggcgaggagaagccgtcgcagttcaacctcgtgtcggggacgtccatggcctgcccgcacgtggccggggcggcggccgccgtcagggcgtggaacccggcgtggagccctgcggcgatccggtcggcgatcatgacgacggcggcccagctgaacaacgacggggcggccgtgacgaccgactcggggtcgccggcgacgccgtacgaccacggcgcgggccaggtgaacccggccgccgcgctggacgccgggctggtgtacgagctcggcgaggaggactacctccagttcctctgcgactacggctacgacgcgtcccagatcaagctggtcgccgcctccctccccggcggcttcagctgcggcgccggcggcaacgccagcgacagcaaggacctcatctccggcctcaactacccgtcgatcgccgtcacggggctcggcaaggccggcggcaccaggacggtgagccgcgtcgtcaccaacgtcggcgcgcagcaggaggcgacctacaccgtcgccgtcgcggcgccggccggcctggacgtgaaggtggtgcccggcaagctggagttcactaagagcgtgaagaagctgggtttccaggtgtccttctccggcaagaacgccgcggcggcggccaaaggggacctgtttgggtcaataacgtggtcggatggaaagcatacagttcgtagcccattcgttgtcaccatctgagagtgagatcacacacatcagtgtgcaagagagagcacttgtgtatttctaatgaaatatgggactgtctagatgacatatgacagaaaaacatctcacaaatcatacaaattctagaccgttggaccattttaagatttctgatttcgtgtgtaatatttctatccctaacccccttcccccctcatcattccagcaccgccgccacctctcgcgagctcgtgcgcgtgcgatgccttcgccgtcccgccccacactccgccagtacccagcctcgtcggctggcaggaaggggtcaacgatgcaggtgagccccccctccccccaccccgaccaacctccttcccctctacctctcttccccaaccgacggcctaagtgctcctgccccgccatctaaaacttgagaagtgaagccacgccacatatttcttttgtcggcaaccacagatttcacaaatggagacttccctattgtttgatcgttgaagtgtctaacgggtctagctgtgtttcagagcttatttggtggctccacaaactagatttttttataacgaaaataagagtaaattttagaaaattatagatactttggtcaaattaccttaaaactacagatttaataataaaattatcacaaaactatagattttcggtttaaatccttagcaccaatgttacgtttgggttataaatattcaagttttgcgatcaaattgacattaaacatgtagttttgtgataagtttgttactaaatttgtagttttgcaatattccaacttaaatatgtagttatgtgataaatttagggttaaatatgtagttttgtgatacatcatgttaaatttgtagttttctgataatttggctaaagtaattgtagttttatgagatttactctaaaaataatttacatatccgacttagtatagcataagttataagtttgtatagaacttaaaaatttcgactaacatggcgaggctgagtcagcgtgtgacatgtcacccccacatgtcaaggacctgtcttattggtttccccgctcttccccatctttccagggcggccacacgccgaggagaagggcagcggtcagtggttgggggccgacgaccgacgggaaaggagttgtgcacgcggcggcaccgagctcgagcggccgcctcatctcctctcttcgcttacgactgtgaccacgccctaccccaataactcccctacactgctcaaatagccaccttgtgaggacgccaagaggctcaagataaagattgagacgacgacaatagcaatgcgcacgcatgagagagaagagatggaggagctagaggagaggaggcaactggttctccgttgctctcctagactatcagttgtgcattaggagagattgaaaagaagatgatggagaagacgggacaaagagaatgttttccatcctcggtctatgttggcaatacgatgaaagtggcaaaacatggtaatataactctaaacgtgatatatagagattaaccactttggcaaatagctatataaacatttgataattttggggtaaaaaaaactttcaaatataactatagtgtaaatgagatgtaattatattttttaactatttataatgtaacttatacgtaactcgcatataactaattaaaaccaaccatatttccagatggctagagatggaactttgcaacttgctggtcgagggtttgattcccttttgttttctcctggaacgaatgtcgccggtcataaaattgaaagttttggaagataaaaactgatttgtttttttcctttttgttttggaagataaatccgacggaaacaaaattaaaagttttgaaagataaaggttgtcattggttggccaattgcaaatgatacgccaaacaacattttaacgataaaaaataatttatgattaaaacttttaccaatgtattcttaatgactttaacaccaacgttagaaaaaaaagtaagataacaacatcaaaattaacttgaaaaataatttttagttatgacattagcatatacaactttgtctaaaaaataaatcctaactacgaatctgaataaatgcgtgtcaaggttcgtagttaggattgagttttttatgagacggaaggctagaaggggtacgttttagggggaaaagacgtggcccaaacactttggaggtttttttagcaactacagaggaagcctatgcagatgtgtgggcaatttatttattgttcataaaaagaatactaaaagaaatcatatcttgctatattcattataagagccctagattaatatataatgtttaaagaaaaaaatatttaaatagatcaaagatatgcactaaatgaaaatggctatcatattctaacagaaatcactttgtcttagttatatgtaaacacataagtgtttttttattaggtagatttaaacccagtcacattttgttaagaaagcagctgggttaccaggcgttcatgataggccagatcgttgctatgatggttcatacatgttcatgaacttaatgtttttctcgcttattgaatgtagttttgtgtgctgacttttttctcacaaatgagttgtttgttcataagtataattttcaacgtttgcatgttctctgtaaaattatatgtttaacactcatactaaatccttatattgtttgttgcgcgcatccacttaattgtagggcttgttcattttgctaccattttcaaccttaccttttgttttttgcaaaattacccaaaaagtggctacatttagttgttgtcaaattttagtaagtacatatgaaattttgccaaaatttggcaaccttgccaaaattttgataaccttatctaaatttagcaatgctaaaacttggtaaagttaaaaatgatagcaaagtgaataagccttagtacaaactcttagtacaaactaagagtgaaaggtcaaaaggtataggtttcttcactgtcccaacatcattggtgtttactcatcttggtgtattattgttagatgcatgccttttaaattgtggggtagtgaaatgcttgaaagttgaaacgtgaaagcgtcactcatacgcatgcatactgctattctggcgatttaccagttactagaatatcctgcatagttaatcaataaaaaccattgttttatgtggaatcctatatgcttatatagttcatccccactaagtgtaattaatgttatttctctcttctatcattaagtcacgtcactccaattatttttagccattggatgatagatctatggttcaaattgtcttctttcttctctcttttcgggaatacgcaaggagcgcatttttttcattaagagaaataaaagttatttacaatgataaaaggaaaacaagcaggggaccaatacaggatactatgaaaaactataggaatatctcgcgctaaatttggctaccacgacctcgtaaaggccaaacagcggggatcccgtgattagccgacttccaaagcatggcctcctctgccattgctttcgccacttcggtccaagacctttgttgttgattgaagattcggttgttctgttccttccaaattatccaagtcaccagtgtcacgacttcacgatagtgtcacgaccagtgtctcttctttcttctctcataacaccaagtaatctcaattatttttaggcctcaaaattcataagtaccattttgttttatttttaatattcatatttcatcttatttgtacatattgtgcaacttaatttcccgcaacaacgtgacagagtatttatctagttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgtaattagtgtatgtttaatactccaaattagtgtccaaatatccgatgtgacatggacttggaacaagtcgctggaaatagcaaaactgaacatcttctgtatcaacctgaaattacgcagtatttgtacttcagtactgctagaggcaagatcaacaaagaaagccatgggagttgtggaagcggcagcggcagaggcagcaacattgatgctacagagctgcttgtagttgtagggttgtattacatcacgaggtcatgactcatgtcaaatgaataattgggatcaggataaagatccaatgcagtcataacagagactgcaactttgccagtagaaactcttttccatccttggatcaagacaataacgactgaaaccgacgctacagtgtagttttaaacattatctgctacagttctagctacagcctacaggagaaaccttggtactgtcttttgtgaacagtattcaggaagatttcttttttttttttttttgagttgattcaggaaggtttcggatatcactttctatagccactgcaggtgatcccaattcatctaacacatctcacctcatcttcaaatcaaacacatgctaaacaactttaagtggtaaagttgtatgtagtttgtacacatgtagtaagatcaccgtgggaagctcgacgatagcaaaaaatcccgctccatgttgtatagcttgctagtagtgtcggtattgctcagttgaggtggtagacagtgcagctcagctgaaagcccttgcaaaatgtcaccgcctaacagcctttccagccttatctccacttgcctcattgttggcctctcttcccccttcaatcttaggcatgccgatgctagcgccgcgacttctttcacattttccatgccctccgaaattacctgagggtctaatatctcgtagatgttgtcctgtaccattagcaaattaaaaagtgcaattaggctgacattatctgatgattcaaaaacagtaggcttcttccttgtgagcatctccacgagtatgacaccaaaactgtacacatcactcttatcggtcaatctacttgtttgatagtattcaggatcaagatatccaaatgtgccttggatcactgttgtcacaccaccttgatcaaccggaatgcctcgagaggctccaaagtccgaaacttttgctgttaagcgaccatcaagcaatatgttagcagacttaacatccctatgaattattgatactgaagcggatgaatgtaagtaggctaaagcgcttgcagcttcaagagcaatcctcaatctatttttccatgacaacaatgtagggccttcaacatggagatggtcggaaagagtgccgttcgatatgaactcgtagaccagtagtggaacctgtgtttcaaggcaacatccgaataaccgcacaacattccgatggttgatctgcgaaagaatgacaacttcgtttatgaaatcatcgatctccttacgaaccgtaatattcgatttcttgatggcaacgacacgtctgtctggcaaggtgcctttgtagacagtgccatggccgccgctgccgagctttctcatctcgtcgaatcgatttgttgccttttcgagctcttccaaggtaaacaccatcctttcagcaatcaccttatcaacaagttgcagcagcagtaaaccccggttctgcttgaagaatacggctctcagtttcttggccctccgtgccttgatcatgttcgtcattgccatgcctatcacgaacacggatggaattcctatgccgatggttcctcctatcgccacaaggagagctgccagcagaagatacggtcaaatttctgaaccctgtttgtgcaaggatttgcagagaagattgcaaggataaatttaagttatgaaatgaagagaaatttctatgtactcgttggttcacatcctccttcgttcatagcatcaccgtgcgtcccacccggacacatgcacgaaaacgatcctggcttgtttgtgcattcaccgtagcagggatattcttctggcagagcgcactcgtcgatatctgaaagggagaatttagaaaaattttgtaccattctgttctaaattccactaatcatttgaactatggttggtaagccatagaaaaatatactaaacgaacaaaaataatttataaataaaactattaatagcggtttaaaattttaacggcaaaagattgactataataagaaaactaaaatcaactttaaaattaggttttaaattttagccgcggctcataatctagcaagcaaacgatgagaggctatacttatgcaacttcaagtgtaaatgactaatccgttaaacacacttataagctaaaatattaggaaatgatttaatatcaaactaaatagaagggtgaggcatcgaacccagaacagctagcccaccaccttgtgaagctaatcagaagaccctcagttgtttctccacttacatggttacacccttatactccctccatccctaaatgtttgacgccgttgactttttgaaatatgtttgatcgttcgtcttattcaaaaaaattaagcaattattaattttttcctaccatttgactcattgttaaatatacttttatgtatatatatagttttacatatttcacaaaagtttttaaataagatgaacggttaaacatgttttaaaaagtcaacggcatcaaacatttagggaagtagggagtaacaaattaccttgacatccatttgcaacgtacggattgccttggtacccgttgtcgcactggcacgagtagccgccaagcgaggtgctggtagagttgcggcagtagctgttgctgctgctacaggccgtgtcgtcgggcccatgcggcggacaccccgacttcccgatcgcccagtcgagcacggccagcgccaccggcatgccgccgccgcccggtcgcatcgtcgctgctgctgatccgagcttactcgcgttcccgccgaaccactcgttgtccgcgacgaacacgagagccgaatccgattggttagacgacgaggcggaggaggtcggcggcggcggcggcggcccggtgcttgtgccgaacggcgacagccgaacgccgtacgacgtgaggcctaggtagatggaagcctggcagcagccaacgcccgcgcacgagtaatccgcgagctcgccgtcggccgctgctggccaggtggcgccggcgccgccgcagatggtggtgcacgcggcggcgatgtcgtcgccgtccaggaggacggcctgcaggttgcaccccacgacgacgagccggttccgccgctccctgaggcggaacgcgccggcgaggccgcggccccacgcgccctcgcctttggcggcgtcgtaccggacggcgctgctgacgatcaccgtggagtttaggagggatatctcgagcacctcagcggcgtcggcgtcgcgcaggaagagcttcggtgggtggtaggagcggttgcaggtgacggcgaagccggcgaggtggcagccggcgccgacgccgaacgggtaggggatgaccatgctgccgcacgagctcgggcagcccggcagcgatacggttagcgcggttgttgccgccattgttgcagcttggagaaacagtgcagccataacaaggataacaggagagggcgccatggagctgatcgattcagtggctcgatcagcagaagaaatactgaagaatggctcacccaagacgaagagtatatacgtccacgggttttgcttgacctgactgaaggagtgaagccacgccacagattttcttttgttcggcaaccacagatttttcatagatggagatattgatatccgatcagtcactcagtcatcgtgctagatcagtacacgccgcgttttctgaccgtgctgtttaatttgtgactttactagtaacagtatatggggactggattctaatagtacatggggagtgtctagatagttactcccttcatttcaaattgatcatcatataatgtttgtgcaccaagactaaggattatttaaactacattagtcaacacaccatacaaaatatacacacattctcccatgatgcatatagtatcgactaaaacacaagcatacaccacattatacgatgttatattaattgtattatgatgaaatccatatgtccacatggttatataatgatcattttgaaaaaaaaatgattttccttatgtgatgttcaatttgggaaggatcaaagggagtataatgttgtgatgatgatgatgatgatattggagtagtagactactacccccgtttcataatgtaagactttctagtattgcccacatacatatagatgttaatgaatctaaacacatacatatgtctagattcattaacatataaatgaatgtagacaatgctagaaagtcttatattatgaaatggaggaagtatttactgttacatgctagtttgttctagctcatccttgttctttgaaaaacaaatcacgaagttgtgcaagaaaaaaaactcaaaggcttaatcagtgctaaaatctgcgtgaattgttatgattttttgaagagatcctggcttcgtcactagtaagtagttacagatcagataaagatgatgatttagcccaaaaggtgttactgatcacactacttgtactttccgcaagtcatgcactcgatcaaatcggcaaaacttaacaactatatcaaattatcaaccagaagctacgggaccacctatatatttgtcgacaaattttcttctaaaaatttaacatatataattatagtacaatcgtagtgtaattacactgtaacttatatgtaattacactgtaacttgcatgtaactacagtgtaatttgtatataagtttcatgtaattttgaatcattaaatctattacaagatttgttttggtgaggaagaaaaaaaatcacagcatacagtataattacactacgattatactgtaattatatctgttaaatttttgggagaaaatttgtcgataaatatataacaaaatcgttttggaaggcccgtctcttccttcccgccgattccattccattccacccgcgaattctaggcaccgggccagtgcccagtgggcccctcgattccaggcccaatctgacccgtcggatccacagtcgaacgcatctggaccgcccgtctccgcggtgggcccagcccacaacgggagggaggagaggagagaggaggcgactcgctcgcccgcatccgcatgacgcgcacgggaagcggccgaggcgagcgaacgcgagacgatcgagtcggaggcgaagaggaagaggagcgatcgatcgatcaagcgcgagggggagtgggagcggcggcgggggaaatggtcgcggcggaggcggcggcggcgccggctccaccgcatgacgccgtcgcggcggtggcggtggggatggtgggg

SEQ ID NO: 81161 - DNA, 508 bp, Oryza sativa
attgtgagctatcattaagccatcattaaataatagtgaagcattagttatcccaattgtgtgctaatgtttctaagcatggctaagcaattatgtctaacatctagctgaaccaatatataaagctcaactagtcaaattataataacacaaggtatcaaggaatagagtaatcaatgcaaacaggccataacaaaggaataagttcacaccacccggtgacattaaaaaataaatgcacagttgaaacaaatagagaatttaaatataggatcaacatgctcaaaggaattgtgtttaggatctgtgtgacttgccttgtaataacgggtcttcaattaatcttcttgaacacttccggcgcactcgcgaaccttcgaaacgacggaaacgacaagctaacacgcaaaacgaggaaaaagactaataaaaactaaataaacaatacatataaagtaaacaaacatgagacttgaacagcctcattctgacttcatatgaatttatt

SEQ ID NO: 81162 - DNA, 583 bp, Oryza sativa
aagctccggctccactcccacaggcagctcaactggggtataagccaaacgtcttctccttcgcaacttgttttcaactgaggtttgattgattatagcaaggtgagcatatgacatactcagcaagccacacagcaaatatgcaagtgcacaaggataccaaagaatggcataatatagggttcatttgcaaaagaagcatttagcaaatagtaaaaattgtaaaacagtagagtaattaatcatcaatattaatcaactctgaacagcacacccatgctgcacaggcccaaccatcctgaacaaccatacccggctgcacagatttatctccaaaccaggaatgtaccattccaaaccaggagctaaattaattaccatcaattaccacattattattaatgagtagtgtgggactaatcacgaaagacattgttcgacccgcccataaccgcgggcacggctattcgaattgttttactctggccagaggtgtaccattgtacccacaagacacaacccaccagcatgttaccgtgcccggccagacacgtcaccatgttgagtgattgtgacaagaccc

SEQ ID NO: 81163 - DNA, 1290 bp, Oryza sativa
cgcgcatctaacggcggcgacgggaggcggccgtgacgacgcaagcggcggcgtgaggcggctgttcgccggccggcgacggcggcggtttgggtggcgcggcggcggcactacggggcacgagagagctcgggagatgggtcaaacgaaagagggcgactaggggatgctatttataggcttggattgaagagatcggactccaaccgagaggatttgagccggaaaaaccgagggttagttggagagataaactcgaaaacgaatccaatttcgcgtcgaattcaaagggataaagtcggatttttgggggaagagatagaggaggataagaggaatatttcccctcaactaattttgcaaacggagcacgggatgcggcggatttggtggaggaagcggcgggtgcacaggtacaggacggctggctcgggctctgtccaagcttgaagacgacattgtagcagggagacgaattagacttttcgtcttgggctggctgaaaacaaagcaaagaaagaaagaggaggagctcggctgggccgacttgggctgcacagcacgcgcgcgagggagagacatgttgggctgaaattagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaaaaaaattataatcagaccatttaatgattaatttaatatgtggataattactgaaatgttctttgtagggttaaaattaggaattgagttccgaaaaatccgagaatattccagagagtataattaaccatggagaatttaataaaaattaaatccatccatgctttatatttaggaaattttatttcccacatttaacttcactttataaattaatgaccatttaatataaattctaataataatttattaaatattttttaaatcctaaaacgaaaatcaggatgtgacaacacctttgtttttacgacatttggggcaagaaagcacttcattgtttttcacaacatcttccatgtactcaacacgacctaaagcatcttttagtttcatcttattcaaattacatgttgagcaatccaaaacaacatgaggttgttttaactttttagcagaaatcatgttaaacatcaaactagcatgaaaggcaatttgatatttttgcaacaactttttagttaaaaacaactcatccaaagtgcgtgtgtgc

SEQ ID NO: 81164 - DNA, 6205 bp, Oryza sativa
tatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacagtgcattagtgagtccgaaagacataactatgcatttgaacaacccgtaccaagtgatgaatgctgtctttggaatatcctcttcacggatcctcaactggtgatagcctgatcgcaggtctatcttagagaacaccgtagctcctttaaactgatcaaacagatcatcaatccttggcaaagggtacttgttcttaatagtgacctcattgagtgcgtggtagtcaacgcacatcctcttggttttgtctttattctccacaaagataaccggagcaccccaaggcgacgtgctcgggcagatgcatcccttttgtaactgttcatcaacttgcttcttgacatccgccaactcgttggctcccattctatacggcctcttgtagatcggtgcagttctaggtaccaagtcaattcggaactcaatatccctttttggtggaatggttgtcaggacatctggaaaaacctctggatactcgctgacgataggaatatcctccaacttcttagtggttttctccactgctacttcttgttcttcaccagtagactggttcagactgatcccttgcttctgcggtacttgagggaaggtccacgagatcaccttttccctaacaaattaaggttaataatacatgcgatcgactaaatcataaaaagtatttgatctcctcaacaactagatcatcttcatccgacatcgacatgccatacgcctattccacttgctcgacgataggtatggtgtccattacctaaaattggcaaacaaatacacagttttagaatccaattgatctctatctagaaacaaacaaaattaactctacactagagaaaaactgcacatatttatactatcagcacaagggcatcagtgaatctcacaaaagaaaagaggagaagtgtagacaggttctacagttgattatgaactataatctatcttgatgtgaccatggctactatggatatgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccacaatcacagaagcaaggtgctgcgtcacctgtattgggccaatgggcttgtaactttgtctgggacccttggggcccatgtggggtgcaccccaatctggtggagcacgacccttggaccctcttggtcatcctcccacctctataaatagttaggtaccccttcagggtttcttgggttttgatagattaaagtttagccattgctacttgcttgcagcgcgcgtgttggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcaagaggaactcagggttcatcaggtggtatcagagttttcgttgctcggtgagttttatctacccataaccagaaaattgccatacaaaaaaaattgtatcctgtacctagccatattgtgccattgcattgtttttatcagtttttgctttgttgagttttgtgttgcattgtcgagtcgtgttgctggtcttagcgtttagttcgtttagagtttcgagttctggtcacgtttcgtaccactgtcatcacccccgccgtgtctttgttgtcgtcgggacctaggaaaacggaatcatcttgttgtcggggtttcgtttttctagttttcagaagtttttgtcggtcggtcttggagttgctgagttgcatcaagggtttgtcgtctgtattcggccgtgcttgtttctcttgcgcgaggaagaggagagaaagaaaagataacagatctgtttttggaggaagttttgcagactagatcaatcaggttggttagtttccatctaaggccaaactttccaaactctccccacgcgtgaagaccggttggcgccatctccttttgtcgcccactttagctgagtccgactccctccctctcacgtcggtttcgcctgttccgagttgtgtcaaacaccttggtgaatttttgtttggtgtcagtttcgagatccgtttcgaaaaacggaatcagtataaattcagcattccatttttgtataatttttaattttggtttggacttttacagttgagtccttgtaattttcatatttacatttgagtcccagtaatcttgcattgaggtccttgagttgtttttgcagaaaaaaaaataaaataaaaaaaagaaagtaaggaaaaggcaggaaggtgcataaaaagaaaaaagaaaagaaaagccgcaccaaaaaaaaggagagaaaaaaaagaagaagaaagaaggaagaagaaagaaagaaaaaaaatcagttgtatttttgagctgaacatgatctatcagagtgtgcctaagttaaaaaaatcagttgtatctttgagctgaacatgatctatcagagtgcgcctaagttgtttctagtgctatcctgtggtatcgcttgtgtctaggctcacgtctctagtacgttctagcctaggaccagcatggtacttgactttgaaccattattcaactttgcattctctgatttgagcatttgctatccctttgctacatatttaagcctacccagagctccacagatctgattgcagccgtacaacaagtgtttgccaaggcatcgatacatccaacctctattggggtgcttggttaagtcggtgtacatcaccattccgcttgctttggtaagaacttgtaagagcttggttaaaagcttgagtgtgtgtgatatttgagctgccactacctagtagttgataggagcatgcatatttttgtgtgtttcttgtttgctactaaccatggcaggattgcgtaagggaatacgagaacatcgacttctacaccttcgacgagatatgacgacttctccaaatgatacatatgaggtacatgactataattttgaacaagttgcatctaagttacccttctatgatgggaagtatgattctgttgcatacattgattgggagctagcagtagacaatgaatttgatatatatgatttttctgatgctcaaatgattaaggctgctagtaataaatttacctcttctgcattattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctgaaaaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgttgttccttgtgataaagaagagttgtgtgataatgtttcacttatatccatgccacaactgttctactatttctttgtgtgctgattataagtatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttctggataaaatatgcaagctagagagacatgttactgctaatcatattgtctcgagtttgtcttgttttgattgcaagaaacaggttgttttcagtggactgcgcgaagagcaccatatggaaaaaccgaggacggttttccgtgaagaagggaggatgatgtgaccatggctactatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatcttggaattctatctcgtttggccgcaatcacagaagcaaggtgatgcgtcacctgtattgggccaatgggcttgtaactttgtttgggaccctggcccatgtggggcccatgtgaggtgcgccccaatctggtggagcacgacccttggaccctcttggtcgtcctcccacctctataaatagttaggtaccccttcagggtttcttgggttttgatagattaaagtttagccattgctacttgcttgtagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcatacggttgtagtcggatcgtcaacgtttctcccaaatcgtagttatcacaactcaccgaaagatcgggccaacaacagccttgagtgtcgagaggaactcagggttcatcatatctagatgtttgtaagcctgcacagacaagtgataatggaaattacaagatgcaattttcctttgggggaaaaaaaggaatcaacggatttctttgtaaggttggaaattcagtatcacctcttctccggctggttgttggctgctcgacgccttctttctgcatactttgcagctagttccttgtccttctgttttcatccaagatgc

SEQ ID NO: 81165 - DNA, 554 bp, Oryza sativa
aggcggataggcctaaggtactcagcccaccctatgctaataactcgatggttcactatgaggtacccaggtcccgtataccctacagtagccccggggactaagcttggtactagttttctgtatcatcaaaaccgtcaaagaagaacaaaacgtgatgagtactcaaagcctgaatgccgccgagctatatatcatgaccgagtaacctccacttgaactgaggaattgaatcatcaaagaggtatttcagactttatcgaaaaaacttctagggctggcccattgaagcgccttcttactctataaatagcgacctagacggaacgaatctcacccaaatcccaatttgagcaacagtagtcgtgcctcttcatcttcttcacctcacccatttttcttcttgattccaactagggttttttaaacctaaaccaaacaacttatccacccaaaatctgaaactttccaaccttccggattcgaatccccgaacttctcctcctcaaaatgtcgggttcattgggtgaatccgtgttctaccagatcgcaat

SEQ ID NO: 81166 - DNA, 21163 bp, Oryza sativa
gtcttacactgaagttgtggccaagttgcagcctgcagcagtgtcttttccttctaaaagtccaaatgctcctttcaccggcctaaccaggaaattgcagacttgactcgtcacttggggttcatcaagcttgactcttgacaacttgtctcgtactttcctgtgctaatttaactgcataaaccatgtagagttgaatcagtttttgatagtatccactggtagcaacacaaagtcttcgggtcaatactagagatataaccaagttgagtcccccagcatcctcacctgctgttccgattcacatcccggcagattgtacactaattttagagaagaggcattgctgcccagctttatactgaaagcataacagattgtacactaatagactatgccaatcggagaagctgtgctgtccgcgttcatgcaggcgcttttcgagaaagcggtggccgctgcttccagcgagctgaaattccctcaaaacatagctgtggagctgcagaatctatcaagcagtctgtcgacaattctggctcacgttgaagatgcagaggagcggcagctgaaagatcaggcggcaagaagctggctttccaggctgaaggacgtcgcctatgagatggatgacctgcttgatgagcatgctgctgaagtcctccgatccaaacttgcaggcccatccaactatcaccatctgaaggttagaatctgcttctgctgcatttggttgaaaaatgggttatttaacagagatttagtaaaacaaataatgcggattgaggggaagatcgataggcttattaaagacagacatattgtcgatccgatcatgaggtttaacagggaagagataagagagaggcccaagaccagttcgttaattgacgactcgagtgtgtatggtagagaagaagataaagaggtcattgtaaacatgttactcaccacgaataactcaaaccatgtcaacctttctattcttcccatagtgggtatgggaggagtagggaagccaactttaacacagctcgtctacaatgatgtgagagtaaagaagcatttccagttaagaatgtggctgtgtgtttctgaaaactttgatgaggccaaacttaccaaggaaacgatagaatcagttgcgagcggattatcatccgccacaacaaacatgaacttgcttcaagaagacctctcaaacaagctgaaaggcaaaaggtttcttctagtattggatgatgtatggaatgaggatcctgatagatgggatagataccgatgtgctctagttgctggtgcaaaaggaagtaaaattatggtgactactcgaaatgaaaatgttgggaaattagtgggcgggttgactccttactatctaaaacagttatcatacaatgattgctggcatttattcagaagctatgcatttgcagatggtgactccagtgcacacccaaatttggaaatgatcggcaaggaaattgtccataagttgaaaggcctaccattagctgcaagagctttaggtagcttattatgtgctaaggacaacgaggatgactggaaaaatatcctagaaagtgaaatatgggaattgccatcagacaagaataatatcttaccagctctgagactgagttacaatcatcttccacccatattgaagcgatgctttgcattctgctcggtctttcacaaagactatgtgtttgagaaagacatattggtccagatctggatggcagttgggtacatccagcctcaagggcggagaaggatggaagagattgggaataactattttgatgaattactgagcagatccttcttccaaaaacacaaggatggatacgtgatgcatgatgccatgcatgacctagcgcagtctgtctccattgacgaatgcatgagactggataatcttccaaacaatagcaccacagaaagaaatgccaggcacctatcattctcttgtgacaataaaagtcaaactacatttgaagcttttcgtggatttaatagagcacggagccttctactgctgaatggatataaatcaaagacaagctctatccccagtgatctgttcctcaatttaaggtacctccatgtccttgatttgaaccgacaagaaattacagaattgccagaatctgttggaaaattaaagatgctccgatacttgaacctatcaggcactgttgtaagaaagctgccttcatcaattggtaagctctattgcttgcaaacacttaagttacgaaactgcctcgcataatcttgtaaatctcctatccctcgaagcaagaactgaactgatcactggcatagccagaatagggaaattgacttgccttcaaaagttggaggaatttgttgtccataaggacaaaggatacaaggttagtgaattgaaggctatgaataagatcggaggacatatctgcattaaaaatctagagagcgtgtctagtgcggaagaagcagatgaagcattgctaagtgagaaggcacacatcagcattctagaccttatatggtccagtagcagggattttacttcagaagaagcaaaccaggacatagaaacactcacatccctcgaaccacatgatgaactcaaggagctgacagtcaaggcatttgcaggattcgaatttccacattggataggctctcacatttgcaaactatccatctgtctgactgtacaaattgttcaattctgccagcacttggacagctgcctctactcaaggttataatcattgggggttttcctaccattattaaaattggagatgagttttcaggtagtagtgaagttaaggggtttccgtcactgaaagaacttgtatttgaagacacgcctaatctcgaaaggtggacttccacacaagatggtgagtttcttccattccttagagaacttcaagtgcttgactgtcccaaagtaacagaattgccacttctcccatcaacactagtggaactgaaaatttctgaggcaggcttttctgtacttcctgaagttcatgctccaagatttctaccatcattgacacgcctacagattcacaaatgccccaatctcacatccttgcagcaaggattgcttagtcagcaattatcagccctccagcaactaaccatcactaactgtccagaactaattcaccccccaactgaaggattacgaactttaactgctcttcagagtcttcacatttatgattgtccaaggctggcaacagcagaacatcgtggcttactacctcgcatgattgaagatctacgcatcacctcatgctccaacataatcaatcctcttcttgatgaacttaatgagctctttgctctcaagaatcttgtcattgcggattgcgttagccttaatacttttccagaaaagttaccggctaccctcaaaaaattggagatcttcaattgcagtaatctggcctccttgcctgcttgtttacaagaagcctcttgtctaaaaactatgactatcttaaattgtgttagcataaaatgcttgccagcacatggacttccactgtccttagaagaattatacatcaaagagtgcccatttctggcagagaggtgtcaagaaaacagtggagaagattggcctaaaatatctcatatagccatcatagagattgacgatgatagtgccatgccagataggagcataaggagaagattatgctaaaagcttcttagcaactcaacaaaaagggtatgaattaattgccttctctagtttcttttgtctaaatataatagataaggctggctgtgaacatcatactcaaacctattctctgcaggtgcaattggtatatattcagtttattatctccagtgcaaagttctattttaacataattactaacatttatcagatacagaagtaatacactcgaaatgtaaaaactatggtaaacaactgtagcgatagagtacagttaagattgagtgatttccaccaaacagaaaacaacagaaaagaataaaagaaataacgggacaaagaatttcagtactaacaatgtaactaaaaggaaccaggaaggagagcatgtatatctcttttatgatagaagaattttggagcatgacatatgtaaacagttttttgtccacaagaaatgaaattcagattgtcatggtcaacacttatatcttcatattacaaactaaaaatttgaagcagtttcatcggttctgataggaagaagtttgacgagcatgcaaaaatgaatgcataataacagttcatttggtcagttgtgttatgcagaacagttaatatcattgccttttaggtggaaacatctacaccccccgtcccccccaaaagaaaaccctcttctgggcctatgtccatattcaaacccatggagtgggtgttttttgggacagagggagtataaattaaaaatgctatattacaatcaccatttgatgagaaaactatagtcaaatggtatgcgttactcatctgttcgcctttatgttggaccattttggtttggtgccaattcttgccctaccaattctttggtagttttgaatagtgcatgttagcattttggattggagccaaattttgccaaatcaatagagtggagccaaatctatactataaaaaaaattttgccgggtcggccaaaggttggccgaccaatttcattaagattggggagaaaaacaaaggaatgttacagcgacattacaatgtcgcgctagtccgggagagatcccagacacagcgtgaacaaacgaaggagaaagagacaatacaacaacgattactcgctgaattgggagaagatcccagctaccctccacaccacgatttcttcttttatattctcggctacttactataaaaaatttggtagtgccaaaatatgcccaaggtttggtactaccaatattttggtagggtttcaaaccaaacaagcccgttattttcagaactgccatctagattcctcatgcatggcaatgtcagcgtttcaagagaatctcatattctacctgcatcaggatgtgctatgttaatgtgacagagaaggacgaccagacaatcaatcaatacttcaaagaatcaagtcaagtttgaattgattctttctctttagatggtctgggacactgagtcttttgttacagatttcccaaaattgaactgaagaaatcaatgaagactgaattcttgcttctatttatgtctatcaagccatattcgaaggtccaaaattgaccagttaccactccagaagaatgtataataatcttcttatcaaagtttggttatcacctaatatagttcaactaggcatatgcttatccattcaaaagggaaagaaaactaagcatggtccaatgttcacctttacgtttccttttcctgaccaactgtattacacagcctatcccataatatttctctaggtctgttatgattggggcatttcaaaattaagtaattttccaaaataaaactatgaacatcagtacaacgataccatatatgtatagcacaatatacggtgatcaaatctcagaggcgctttctctgacctaattagaaaaacccgactagtaaaaatccacgaacttacagccaaaaaaaacgaaggacgcgttgtagattcgctccacacacacactcgctatatctctcctcccccttccacgtctccggttcgcggagatacgaaccggcggtagccccgcgccgcggcggcggcgccgccgccgccgaagccgccgcaagccgagaatttcccccggagaagtagaatgatgaggcccaaatttagattgatactgtagattcgatctctatcgggcctggatgcacggcccaccaaatctaccatatgggctgggtatgggccttgaacgaatgctgcccggaacaaattttatttgttcatttcagtgtaaaaatacttatggccccagcacagcctgacaattcgaatttccgtgttgggtttggaatttggagagggacttgattttttttctgcgaaaacaacatggactacttgaattacctttcattctttgcaatagactgttgttatttgcacatatgtttactgacctcatatacttgatcagtttgaacaatggcatctttctatttccatagcctctgattctagtgacaatcaaagggcaaactaggtcaaaaggtatctgatggctacaccttcaatgcattggttcatgattcattcacctgttacaaatatactcattttgacacacactacgccgtcttgcccaaaatggtgaagctgcaagaaaaagccgtttaaaaaagaaggttatgttcatgaacctaacctgttgcgtggagatccctttaacctttccatttgctcatatgctattccaaacatgttcacaagaattgcactggaactcaaaaattatttatccttttgtcactcaggcatttccaacagcttgagaatagcaggctgaaaattactcaattggagaaggaacttcagccaaattgttcaaaatcagccgtttggtcaacacaagagtgaagtgtcagggtcagggagctgacggtaaagcattttcaggattctactttcccaagtgattaagcacactttctcacttgcaaaatattcacctgtctgactgtacaagttgttcgattctaccagcactagccactaaagtttttcgaagattgggggcttttcctgccattacaaaatcaaccaagagttttcagacagcgatgatgttaaggggtgtccgtcactgcaggaacttatgataatctcaaaagatgggtcttctgttcaagatggccagttgcttccatccatcacaatccaattacaccattgtgttcgttgcaattaaatcttcacaacaagatcttacatgattatattacgataaaaatatttatatttgtaaattacttttattatatactaagttacttttataatatatataagttacttttagatttgactaaattacttctatacattcataatgctctaagttggttatttttattattgttcttagttaattctatattttgtggactttataaatcttctctacactttacttgcgaattcactctacatagtttcttatttcagctcactcacaatataattatttctactacagagagttactcctccgtttcataatgtaagtcattttagtattgcccacatttatatagatattaatgaatctagatatagttctaaattaaagttactttctttttttataagttacttctataatatatgtaaattacttttaagctttactgaatttacttttatatatataagaagtaacttagtgaaatctagaagtaatttagacatatcataaaagtaatttgtgatttttcatcaaaatataatcatgtgagatcttgttgtaaagatttaattgttacgaacacaacggtgtaattggattataaatcggatgagtaatttaagagaaacttctctaagaagaaaaaaatatatagatattgagtgtactagtagcttttttttggatagaatggtgtctctctttagcactatccagctagtactctcggtgtagttacgtcctttaaaaacatgctactctctcaacccaaaatataactctacctttaaacttttgtacaaagttcaaatttcagtgaaaggcaaattaattaattgatgcatgtaagaacaaatttatgaggttacaaaactactttttagaagcccatagtagttcacaatacatattcataccgggaatcctaatgcacgcatgcgcgatggcggaggcggagcaagtagcacagacgagcgcagcctacgtcaccctcaccaagccgctaatctctagcacttagcgctaatcccttttttatgggtaaactattttttaaaaaaataaataattgatataaaatttttaaatatgaattgaaagttgaactgaaagttttcaatttttatttgaacactttcaaattttgagctaaaaatttttaaaactgaatttaaattttaaaattttagttgaaagtttcaagatttaaaatatatatttcagttgaaagttttcaaaaataagttggaagtgagttgaaagttttcaaatatgagtttaaagctttaaattttgaactgaaagttttaaaagttgaattcaaagttttcaaatataagttgaaagtttaaataattggtagagtaaattttaaagtggaagttttatattagaattaaaaaggggaaaaacacaataatagtttgtttgaaaaaagtgttaacgttaataacacggcctaattacgaaaaaaatagaactaataacttgatgtatgcgaaaggaaaaaaaaggccctagcactgcactgcatgtggagtccgaaaataacatgagtggcgccacctggcatcactctctggaacgccatgttagcgtaaatcggcgtgacgagctgtaactaaatcaaaattcacaaaacactataatcttaatggtttctgtcgttatcgatacgtgaccaacaaaatgcccgtgcagtgcggtggataatagcgaggtggatgaagtttaacctcaatgattcatcgaagcacctaagtatgatcataagtatcggtgacatgcacagttatcttaaagatatatttgtgtttggacaactagtccactctaattgtgcggggtgtggatgattatgctaatgaatggtctcgatgatcgtagcattggagaaatggatggccgaacgacgcacctctgcctagaaggcgatgatgaaattttaggagaccattaattattttgaattacatttttatgaaaatcttataatctcttttcacaattgatgattgttacaacagttcattgatataatcacaatgtaatgctctgtaccgactaaaccaaaatagtgccagccggacctaaccattctctttttattttctagaaaacctttacgagtaaaagtcattagcacataattaattaagttttaattattataaacttaaaatatacatttatttggtattttaaattaacttttatatagaaagtttcacgccagtttccgcgtttcttaaaaaataccggtcgatttatttcctagtaaaacacatatccggtttccatgtttttttaaaaaaaaataccggtcggtcactatccttcctgcgtacagtacaaaataatcttattttttgaacggaaaaattcgtcaagtgttgttgttcctttgcctaaacgggcttgcagctgataattatagttacatcgcattaccactcaagaacgcaccagtggtctagtggtagaatagtaccctgccacggtacagacccgggttcgattcccggctggtgcaatttttattttttccctcattgttctttgtttgctgcaagttctcagctcatgatgtttttcattccaatttataggtggcttgtttaaattgcaaagcattgcaagcctgctcatttagtaagctgattattaatcctgaatcacgccaagtcgataaatacgcaacaagagcagagcttacattgcttcagacttttagctccatgttatgtcggattcacgtttagtgtatatattccctccgttttaaaatgtttgacaccgttgactttttagcacgtgtttgaccgttcgttgaataaaatttaagtaattatttattcttttcatatcatttaatttattgttaaatatactttcatgtacacatatagttttacatatatcacaattttttttattcttttcatatcatttgatttattgttaaatatactttcatgtacatatatagttttacatatatcaaaaaaaaatttgaataagactttttagcacgtgtttgaccgttcgttgaataaaatttaagtaattatttattcttttcatatcatttgatttattgttaaatatactttcatgtacacatatagttttacatatatcacaaatttttttattcttttcatatcatttgatttattgttaaatatactttcatgtacacatatagttttacatatatcacaaatttttttgaataagacgaacggtcaaacacgtgctaaaaagtcaacggtgttaaacattttgaaacggagggagtatatccttcatgtatccattcctataatcccatggtacatagcctctccatccatcgggatggttgtggcggtgaacggggttggcgcgacggatctatcggcaatgggatgtcccgtgctagggagggtgatggcggcgatggggggagacacagtggcgtggtagccttactgcccgtcgggttctcttaggttgaggggcgtcggtgctacggtgtttatgtgtgccgacagtggtttagatggtagttatagaagtttggctgtgacaaaagggggcatgtgtaggcacaatcgtgaaatccttactacaacgacatatcgacactacttttgagcgttgagaaccctatattgacgttgttaaggcgtttccctccatcccttgcgggactctctaagtgaaaaccatatccaaaatcccttggatacatggcatagacgctttttggcgttatgtcatcctgaaggcgtttcctaagagatcttgttattgcctcaatttgaccaatgctcttgtgatgggtctctgactctctgtgcatgacaagtggatctttttttctttctccttcattctccctctacgaccattttgttctggtgatgtccgggagatcacaagcgattagttgtttggagttcagcgtgggtgggggggggtcgtcgtggctcctctgtaggtctagcgatgatctgtcacacttagcaacaatcaaattggtgttagttccttcttcaacattgcattgacggtgtttggcacagttattggagtgcttgtttcaaggttcatttaatctcttttacctaaaaaaagggttactttaatcttcacgtttcaaattatccaaacaattcttcaatattcatcatttggctcaatctagtccttggaacttaaaaaatggcatgtggacatgtcacgtcatcctcacatgatccccattattgtcattttcttgttttcttttctttaaaaaatctttatttttcactatggtatatataatggtataatggtcatttaattgttgaccttgcatgtgaggatggtatgacatgcacacttgatttttttatggggacaagtactatattaagctaaaagataaatttaattagagatttgtttaaataatttaagactaaaatgatcttggagtcaaactttaagataagattttatccctcattctaaaataaattaacatattatagaaatagatatatcttagtagtataaatttagatagatattttatttaaatttataatattaaaatatgtcatatcatatactagattaacttattttaagatgaaagaaatacctccgaaggctagtcttatattaatttttctccgtataagatagacgatcctaactcatacagtcgtactacaaccgtatcatactttctgcgttttaaaatatcgttacctaaatttcaattggacactttctagaagccaaaaaatatttgtatccgtgtcaccctctagaggagcagcggaaggttcgcagcccgttcgtgtcgtgtgcacgctgttcgtatccgtatcatatgagctcaagattttatttattttttaaggaacattttatttatttatttaaggtgcagataccaaccgtcgtttgagttcttcaaaactcctgttgcattcagcagaccagataaatttttcttccttcttcaagagctgtgtcattggcttagcaattttagagaagttctcaatgaatcggcggtaatagcccgcaagtcctaagaaactccgaatctgagagactgtcctcggtggggtccacttggtaactgactccacatttgctggatccacagccactccttgagcacttacgacatgaccaagaaactgaactttcttaagccagaagtcacacttgctgaacttggcatatagctggtgctcctttaacttttcaagtaccagccgaagatgctgctcatgttcttcctcggacttggagtagataagtacgtcatcggtgaaaactacgacaaacttgtccagaaattcaataaacaccttgttcatcaaattcatgaagaaggcaggtgcatgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggcccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccgacaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctccccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgtcgccgcccactccctcccccttgagccactgcccgtggggcccgcttgccagccgccccctctcccccccttagtgccgctgatcagtggggcccgcctgtcggcgccaccccctcccctcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagtagtcttatagcatgttttgcttgtgtgctttgtttgtcgcgtaggtttcggccgttttgtcgatccacggtttctcgaagacgttgctgaggtctcgtcagtgcgagagcaaggcaagtcatgaaatacgtttgatcatattgtacccaatttacaaatatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatgattaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgagcagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgacctgtttgatcagttgaaaggagttactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacagcgaagatggttggagctaattaaagattatgatatgggaatacattatcatcccggcaaggctaatgtggttgcggatgccttgagcaggaagagctactgcaatgttgcatgggtagagcaactatgtggtgaggttcaacgcgatttggaacatctgaaccttggtatagttgagcacggattcgtggctgccctagaggcacagcccacgctggtggagcaggttcgcatagctcaggcaagtgatcctgaaatagcagagctcaaaaagaacatgagggttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgccaggacgtcatcggggcatgattctatttgggtagtcgttgaccgactcaccaaagtggctcacttcattccggtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctctcagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaaatcccaggaaaatcctttcttttctttttctttttcctgtttcctcctttttcctcttcttgggccgtcggcccagtccacccgtcgcccgcgctcggcctccccttgtgggccggcccgttccccttt

SEQ ID NO: 81167 - DNA, 538 bp, Oryza sativa
gtatattagaagtataggaataggttttctttctcttttcttcccacttggcttagataatatattaagagaatgagtagctaatgcttgtgtgtcactctacccttggattattttaacccttgcttagaatatgattatcacaagtaatatataaattattagtcaagttctctctacatgatcttatcacgggataaaataaatacgatacccttggaatactctcgggtgaaatgctacaatggtatatccgtgcgcctgcagatgaactctgtaaccataatataccagaagtatttctacgccattgttggaaattatatttctagtaatgttgtaagaaataccaacaaacatttctagcgccgttgccggggaatattcataatagagattacctgaactaatactttatatttacctctatataaccattttcctttgcaggctaaccttaattgttttcacttttttgtgaaaacagggtagtgcatgactggtttcaacttgccggaaaacttcaaagaaaatccag

SEQ ID NO: 81168 - DNA, 16463 bp, Oryza sativa
ccccccccaaaaccaaacggaggcgagctcgccgccgttcaccgccgccgccgctgccatggacgtcgcgtcgctgctcccgttcgcgctggcgctggtggcgatcccgatctcgctggcgctgctggaccggctgcggctggggcggatcccgccggggccgcggccgtggccgatggtggggaacctgtggcagatcaagccggtgcggtgccgcggcttcctggagtgggcggagaggtacggcccgatcgtgtcggtgtggttcggctcgtcgctgaacgtggtggtgtcgacgtcggagctcgccaaggaggtgctcaaggagaacgaccagctgctcgccgaccggccgcgcaaccgctccacgcagcgcttcagccgcaacgggatggacctgatctgggcggactacggcccgcactacatcaaggtgcgcaagctctgcaacctcgagctcttcacccccaagcgcctcgaggccctccgccccatccgcgaggacgaggtcaccgccatggtcgagtccgtccaccgcgccgtcacccagccaggtaaagcttcaagaattttagtgttctttgtgtaattttgagcaaggagagggtgcttggtgcaaacgtggttggtatgagtttggtggttgtggcgtccttgtgtttggtgacgaattgttatgtcgtgttgactctcatgtgtcagctaaattgtgctgccttagatcagcgattgccgattggtactactagttgttttgcaggcttattggtgctcaatttgcatcgctccttgagggaaatggccaaggcgtggtctgccatttcgtaggcttcgctacgatatgctgtgcggatttggtagtggatcctagaggaaatgctagctattggtttgatctggtgggataataaactaataagaggagttgaactgcctcgagtgagtgggtgcatttctctgagatggatcacatggtgagcacgttgttagagagccaagctaagattttacttgctgaattgaaaatgtaggtaccatgaaactaggtagtgatcatactctgcccagctgtactgctgtagtgtgctgactgctgagagaccttggccctggggattattggttatgagctatggttcatgtcaagcagatatcgtaattggtatagttatagtaaagtgggcttcgtatgacttccagtatacacggggttggtaatcacatgctattttaagcttaagtgaagacagtttggtgctttctgcattattgttcattaaggcacttcacacctctctagtggacaagaattacgctattccctttttggtatataagtttgctctgttgttggcatgctattttagctcctcacatgataagtactctacttgctgtaatgtgacaccttgctagttgaaacaatactatgctgtttaagcttcttactggtatgccaagcattctcttgtgatgttatgttgtaccagtttgacagtcaaaaaaaacatgtttggcaacaaccttgtttgaactggttggaagtcttttttttttcttctaagatgtttgtacattttgatagcattggagtttttacagactaaaattaatgagctgctattatgtactttgcccatctgtctcaactgtgctgacagttgatacagcttatcagcgactcttttcaacttatttctgactttgcaaccaattttatgttccatttgtgttgctgtttcaatgtagtcctcaacattgacctagccttctctctattttccaatttagtttacaagaattaagccaggctgtttagaaaaatgaatgaatttagctttatttatactctgttggaaaaaaattttggcctacaaatgcatcctatgaatacctggtgtcaaactgtcaattgcaaatcgatccactagctgatttgtttacatgtgtacataagttagcaaagcttttttttttgttggcctaaagccatgatgggttacctcaagaaaaaagaaaaagaagtatattgtgcacgacatacaataatggaacaattacctagcacggtaagagtctatttgcattggaatgaagtttttaactaacagtcattttatcgatgtgctgttttcaggtagtgaacataaaccaatcgtagtgaggaatcaccttgctatggtggccttcaacaatataacaaggctagctttcggcaagaggttcatgaatgcaaatggtgacattgatgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatgggtatgttggatgttcctttcatacttatcagtatctatcctttttgtcatccaatttcagatatgataccctactggactattaatatcaatgctctcccaattacttttacattatttgcacacatgttaaatatcatctctcaaagtcatggagaattttttccactctagtcagatttggtacatagtttgtgtggcatgtcactatcttagggttggtgaagtatggtggtatttggaaaagtttctgtttactttctagttggaagttaggttgtgttttatggtttcaatcatctacctactaaaaatgcgagaaagttggaaaggttagaccacttagctagtggcaactaccaaaagctttcaatggatgcctctgcatgcatttccctatcttgcatcgcacatggataatttgcatatcaagtttgttcagactaggaaatgaataccataataatggaagataaaaaacaaaatcccgataattgtcatgtgcctgaattttctgtcctgctaactccattacatttgtgagttcttaccatccctgttatgttccttgtgttcaggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtgatcgaacagtttgctttgctgcctgctgctgctggttatacagacagactggagttctgctttcaaagtttcagctattgctcatgatgttgttgttgtaaaatttgaggtgttaattgccttgtgaatgaacgaatcaatcaatctcgtaaagttatcgagagcagatcgacttttgtaatttgtacaatatgactatgtacttaaggtgttttgttcagatagaattttgtaatatgattaacacgacaagcgatgtattttgaggtgtcattaatgaataataataatgtaatgtaatctgcaatttttctttttttttctttctgttctgtttctgttgagaaacaaagaattaagataattatgatgatgataacatgacgtgggggcgaccttatcttgaggcacgtccaaaaacgtctgcggttgttacacctaaacccagataaagcaaagagcccaaaacgagcgaaggacacgagacgcgctcccagccgtcggatccatccggagcccccgaaaacggacggtggatggagacgccagccccctcacgtcacgccacccccccccccccccaccaaactaacgtggggcccacaccatctccgcttcgggggtgtgatggtgtggatggatagaaccaacggctgacgtgtacccgaacgcgcaacgcgggggagtccaagctaacgtgggccccacacccccctttcccctcctcctctctcttcagatccgcgcgctgaggtcactgtagaacacggcggtggacccggtccacgggattaagccggtgtagtgtagacccgtctgggtggggcccacaacattggtggatcggtctatgcaccgggtccacggaacgggtctcgtgtagaggctctctctctctctctctctgggtgggggttgggtttgcttcgctcgcctcgctttgcccgattcggccggggtcagggtcactggccgagcaaattagggtggaaaattttttatttatttatttccgcaaagaaaaaaaagttaaatatccagtaacggaaaccctaatccccaaatcacaaatcgattcgattcgctatttaatgtggtgtggttttcttctccgattcgatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcggtatggttcatatatgcgcggattttttttttcagattagaaattgttgttcaggtgtagatcctgcatgcgtgtatatagattctgcgatcgtgattggtatgtttatttttttcacttttgcctgagatgtgtttgttgcatgcacgcttgttttcggtggttaggttttgctaacaatttgatgcaatgaaattatggtgcatgtcttgcattttatctcccttgttaggcttcgcccatccacatattaggaattattttttgttgtaatttgccggttattttctatgtttgtttgcgagcatgatatatatttttattttgttttaacggtatctttagtgagataagtaatgaaattgcggttttgtgtgggtgtgattctgtatgaaactggcttattcgatacacatatccagaattctggagcctgattggtaattatgatgtgaggtagccagtgagtatttggggattcctaaatccagtactcgtacatttgtcatgtatgaggatgcctgatgtgagaaattttggtttaatttgctgcttatttgcataatttgtaataatagactctgttccatgtggtcccacctccaactgtgatcattaaataaggttatgctcctgagcttcatgggaaaaattagttgcccatatgcattaacattttactaaataatacattatcatgatttgttcaataatacgtcagtctaatcatcactattaatagtaaagaaacgtcaatgtgtgttttacagttctaatgctagtacggaccaccaatcatgtacctcttgatccgaattagatgcttagatccatatatttgatgtaatgtgcatttttccttgcatggatgttccctcattttgttaaagacacatggagtccttaaatagaataaaagtgcactatttatccttttggcctctgcactgtagcaaaatggtatcatgtagaattctactacttgctgcgggtctgctgtacaacaagttgtagctaaatccttatatgcttaaagccatgcattctgaggagatgctttcttaattaacctttgctcttacaaggacatgcagaatcatttctttatatatgttagggctaatgcttataatctcatttaacatgcccttaaggttgacatggtcggagctctttagtatatgttagttgtaattataaaaattgcatgaatcagattcttttattgttaccagtgctctttcagacaatattcttattttgtttgatgtctgtcatgtgttgcagcctcggattaagaaaatcatgcaagcagatgaagatgttggcaagattgctttagctgtacctgttctagtgtgtgagttttccactctgtttaatcttccttttattttattatatagctatttaactctcagtaacttattagtattcggtttagaggctcataattattttcgctacaaactgcactcctttctgccactaagagttaagtagcttatattttagaggccaaaacatatgagccttggagtctatgtaacaggaaatcatgttctgaatgataatcgatcttttcggtttctagattacaaatcatactgcctgcaaagcattattgattgtattagggaagacatagatcaaagctggcaattattgttgattaagggggaggggggcaggcttactaccaaagtatgttaggtcttactttgggctgttgtaatattgaaatcaagtgcatttgtacatgtactgtagacttactccctgtgtcattcacaccatccttaatcatgtaagcccattctccttcaaatttcacattgcatgtcaggtgcactatcaccaccacatctttattttggattcatctctagcgacctagtctacatctctgccatattagaatcaaccgatcctgtatgagcctgcatggccatgttttctttattcccctgatatccacctcgcttttttttttttgcgtgagtcatggtggcagaagttggggagcaatggggttggcattgttggttggataggaagagcagtcagatatgatgggggttgaatttggtgagggtgaggggaactagagaagggagattttggagaagagtgtaggagcgggagaaccggtgtccacatggtgcagcactaaagaacattgaatcaagtggatatattacagacaatttggctttatggcacggtatggattaagtaaaaacatttggatgtgagcccatatttagctttcctggaggaagataaaaaggtaaatgagtgaatgtaaaaaaggataaaatagctccatgcaaaataatatcattgcaaggtatagatttaatttatttgtttgcacttgggtgctttcttttctcttctgctagcatgcttctttgttttcttcgattgatatatctctaacgttggcataagattggcaccatccatagctaagcatattctgcactttgacacgttggcaagcatattttccgtttccatctgatttgatttaacttattatgatttgttttattaatgtatgatgtgatctttcaggctttcactttacatatatttcattattgtccattgttgcagcaaaagcattggaattatttctgcaagacttgtgtaataggacatatgacattacagtgcaaagaggggtcaagactctgagttcttcccatttgtaagttttgttgacctttccatgttttttttttctgagtcaatggagctataggtggaatctaacgactctttattaggatgcctgagaacctttttttccttgtcattaggtttttgttaatcataggttgttctttcaagctatctactcgtcatgctcttttgcaagtttctgagttgtgtgctgttgtcataatctgttcctgtaccttgatcctagaatgcatttttaagcatgtgttgttgtcagatcatgaaatccagtattttgcctcctttttttcaggaaacagtgcatacatagttataatgtttacgatttcttgagggatgtcgtcagtaaagttccagacatgggtacatctgatgctggtgttgatgataaacttggcaaaaggaggtaaaaaccttttcatttaatagtgtctgatgttcaaatcaatttttattcagcaagctttaatgagtgctgaaattcatcaggaaaactgctgaagatgacagtgaagaggaatcaaagcggacaagaaatgttagtttctccattatctttacctttatgtggatgttgcacatttcacaatttctgtcccttttgcattcttagtattagtatttgtatcagcacttgaaagaattctttactccagtcattccgttcatacataattaaaacgttcacctttgattttcatctcatttgctaataaggttgtatgcatgcaggaggcagcaagccagacaagcactggtagagggcgtgggaggggtcggggaagaggccgacgtggtgggcgtgtgtctgagagggagattatttccgcttacgaaaaatttgaggagaaccatgagtttcctccaggtcaatttagcaagccttctcagctgaaggtagatgtttcagttgatggtacagatgcaattgaaacaaaggaggctaccccattaagcaacgcaagagcttctctaaggaacattgacttaaacatagagcttactgactatgatgatgagggttcagctccactggaggtccagcctccagctccggcagcaggtgtggttacaacctcttcaggaccacttgtttcggaggtgaacgaagaggcgaagaccaaagactttctaggatggcaattgcctgagctgaccaagatggccatggaccctgttcagtttgccttgtcttcaaaccataggttagaggaggatgaggattatgacaacgaagaatgataacttgccccttttaggttaagaagctgatagatagacatgacttttgtctattgtacatccttgtagcccagcttaactctgtagctgatcttgtataatatgtgtacctgctgaagctgcagtagtttaggatgttacagaggtttatcgatcgatagctagcaactatgttgacagacagattcatcagttgtacatcctatctgatctccagtttatgatagtttgcaatgttcctgtctgtttgtccattgctgtattccctgtgcctactttctcagggtgctgaattttactgaaacagtgagctgcagggctgttgcagccaagactgtttccttctcccaaaggagagtgatacaggtatgatgaaattgtgaaaagtgaaagtgaaaacttattacaatttacaagcaaagcttggccatggccaagaacacaaggagactgcgaaaatgttgtgtattgcactaggaaatacagaagtgatatgtctattatgacccggcaaagcagcaggttttattcatcatattacaccttccagcaagaccagtaacatgttctagtagcagataattggatcactggatggctctgctttaagccgatgattcagcagccggacgatgatctatgtacctgaaattatcagcacctaaattatcagcctcctgccaatgatgacgaaccatttgcaattcgcaaagcacaaagcgcggcgattcattcaagaaacgatcaacgaaagagaggtttgaatttgatgttttacgtttaggcggtggcgtcgtcgaggggcttgaaatcctggagctgcttgaagttctcccacgccctctcccacaccttggcctcgtacagcttattggcgccgccgggttccttcacctcgacggtgaggtagtgcatgaacccgcccaccacctgctgcctcaccttcaccaccctctccaactccaacatcgcgttctgcaattagcttagggggtgcttaggttaagggtgtaaaattttagcatatcacatcaagtattatgtaaggtatcgcatgaggtgttcgggcactaaaaaaaactaattataaaatacgtcagtaaaccagaatttattaagcctaattaatcagtcattagtagatatttacggtcacatggacgaatcatgaagcaattagacttaaaagattcgtctcataaattaatcgcaatctatataattaattattcttttagcctatatttaatactttatatttaatactttattgtaaaatttttacgtggaaactaaacatgcccttattgtattttatatttttaccacaatccacacggcgatccacgcaattaacaaggggaaaaaagaaaggggggcgggtgttcttaaatcttacggccttgctgttgtgctcggcgacggcgaaccgggcgagctcgacggtggtgaggtcgttctcgcgcccggccggcgcgtcgtggatgccgcccaccttcacgccgcgtggctgctgcgcctcctcggccatcgccggcgagccgcgaccggtggagaagaagagggtaacgggaacggcggcgagacgaggacaacgacgacgaccagcagcagcagatgtagtgaacaccgattccgcgaagagagatgatgcccgcatagattgaagcggacgacgggggaagcgggcgatttttatagcgaagcgggaggatttcttttcttttcttcttcgcgttgatttgctcgtgtcgtttcggcgacgatgcgattgcgatcagcgatcgcgacagccacgggaggcaagtgtgatgcgtttctatgcttagcatggaaggcagcgatgaagacgaagtaatgacgcggggcgctatcggtacgtggaagacgggaaggagagtcccgcttcctctatgggcctgcggccctgcgccaatacgcccataaaccattattgctaaaaaaaaagtctacttgcctccctcaaatctgattcatatcctttgatcacaaatgggtataacaacccatccaacggttaaaatgggtataaaatgacgactaggcaaaggtgatattggctgacatggcagtccagtcatcacatttttcctcctccctcccccctcctctctcctccatatttcctctcggttatgacatctcagtagggcagtggcagggaagcagcagggtgacgactggacagcgagcttcggcggtgaacatggccaagttagcatgtcaaaatgcattccaagaggaggggaacttgttgatagaggtagagtaggagtggctggtagtgttggccatgacggctaatcatagcggcgtggaggaagaacaagatggggggaaaaccttctggagcgtggcagtgcatggcgacagttcaaacgacatcaacggtcgccctatcccctccttcacaaatgtggggtggccgccggcgagctgcagttccatcgacccgtcatcgtcgtcgcttctagatctcgcctttattagttgtggaggagggatcatggagtatacatgggtcggtgtggtacgcccctctcctctatgtgctcgtaccccctggccgtcgagccacttcctcgcaacagtggcggccttggcgacaggcaccccaatgcctccatgccgagagcttgggggtgaggccctgcaggctggttcacatgacagcggtgaagattcgtccatcgccagcgaccggagggccttaaggaggcaatagtaggggcgtgtcgttgctgctctgcctcaaggccacgctagttgcccactcgttgagctctcggcatctaccacatggccaccaccgatggaggctactatcccttgcctccaccggcggaggtctgctcgtcgtcatgcgtgctcatgtggggaaaggagaggggcaaaaatgaagagtaaggtaataggatagaagaaggaagagagcatgctgacatgtgggttctacgtgctgattcagctggttgaactaagtcaatgagtcacgttagcgaaaaccacctttaaaacaaactagtgagttattttgtatcttttttaatagttcggaggttaaagatttctctggcattgtggttgagggatataaataagatatacctatatttagggagtcaaagtggacttattctttaccgctataatctatatgcgggacattcagcccactaagaatctattaggccacgccctacggcttcgagcccgcgagcgagcgcttaggccaaattccaacgccgattcgtggacccaaacacgggccccagtgaccaccaacaacaaacccacaagaagcaacgcacgcatggcgtcatctctcgtgctgcggttggactttcacccatccatcaagcgagtcaaggagccaagtggatgcccacgacgacgtcgtcacgtcggtgtctcctcctcctcctcctccatccggcgcgcgcgacgctgtccctacttggctaggagagtatacaacccaacaactcgcccggcggccactcacccccactcaccaaccactcccggcgtcgcgttgagaggcggacgacgacgacgacgactgcgtgcgtacttcgtagccatcgcccatcgcgcggggaagtcgcgatcacgcgcgcccggccactgcaccactactgctactaccgggtctcgacctggccatcccaccgaaccattgtcttctactagtattcaattcttttttctctctcacgcggtcacgcgctcgtgagccgtcacagcttgcttggttttgtgcaggtgcagcctcttcagctttgggttgcagagttgggcacggtagtgtacgtggtgtagctggatggatgggagaagggaatcgttttgagtcggtattatagcgtgacacgcacttccgtggactggactttgtttccgtttcacctttgggggagaaactctcttccttgtagccattggattctgaagagctacggattacggaaggataagatttggaagctaggctgtgttctccagtacactgtacttttctaactcccacagtctctttttccaagtacgcgtttttcaaactgtcgtgtattttttgcagaaacaaagttggtttcaaaaatcatattaattttgttaaagatttttcattgttcatgcagtgaccaagcggtgctgtaacccttaaaaccagtaaggtaatcctaaacggttccatgttagctcaaaatcataggtcacaccattggttcaccgcttttcattttaaaaaagaaaactcaacataaccggtatggcaaaccttgaatggttacattggggatggaaaaacagaacatttatggcatcatgtaatacaaataacggaccgacacaagccacgcaaaacgaaataggctgtgtttagttcagcgcaaagtttggatttttgttgaaattgaagatgatgtgactgaaaagttgtgtgtgcatgacaggttgatgtgatgaaaaatgactgaagtttggatctaaactttagatctaagcacagctatagagagagaatatcagcatcatatgaaagaatcggaacgatcatcatatagctcttaaaaaaattcacaggagaggtagctagtccctctctagacactgtagaaatcttaacatttgctggatgggcaggtgcaggtgtggcaatggcaataccgctctgccccggaaaccatcatgtcagtgtcaaaagtgtcagctaggctggctctcccggaaacgcgtcaaagtgcagcacttttgccccggatggcccgggagaaaccccacaaaaaccgccccgactccaagcaagggatcgatcatccgccgaaccgctaccaaaacgagtcggtgcctgcatcccccccccccccccccccggggggataatttgtcttttctctcggcggctatcttagcaatagcttggcaattatcaacggggttagtacaaaattaagctgcattatagaagctaacaattaattttgtttatcgatcagagtgttgttgatcattgatgcaggtctcatttcggtcgttctcctgacaaagaaagagttgtccttgctgcttatacttgcttagtgcttgatcgcatgaaagagagttttattagagaggtagatgaaaccaagctgtagaccagaaagttggttggcacttcattggtttgacacttgacagagttaggcctaacagtgcagtagagtacatgggaatatttttctttttttgctccaattattgatagagcagtgtgtcaataacattgaagtaatcaagtggcctaatacaaccaaggctttgcgtttctgaacctttgacatgttctacagttaatcacagcagaattgacacttaaatatataactatagatccaccgactgactgaccgattcgttgtgcatcgactgctgcttcctgagagttctcaaaactgatgttattttgacttcgtcacgaattactatgcataagtaagtatttgtaagattgaccttgcagttgcaggtggtgaaagaatcgtagattcgtagtgttgaaatcttcagacatggtagcagtacttgttcagtcttcctcaacgtcgaactttttggaactctacaacataagattctcctgaaaaatacgaataaaaccataccaaaagcgctttatttatcgacccataatggttttcacattacttgatgttcatatgaatgtaaaaatattagtactcctatgcgttactcaactcagttttagccctgcgtaattaacctacatgtcttttttttaagaacaaacctaacatgtcagttcctcttatctctcccgttacatagaaatggaaaaacgattacttgcctaccactctacttttcttccttaagactgtcccatttattttcgaagggcttctgatttcacagcataatgctatgatatatatagcttaacagaaattggcatatgcggaaaatgccgtaatgttaagagagaggagtcatttttaagctgaagtgatgcttgcaaacgttcttatattaagttcttaaccaaaacacgaaactgcgtggttttacaaagtgcatgtttaattatcagcattgactacattggcaaattaactgtatctaattaatactactatctaatattatggttgaagcacaaaaataacaatgtttttaacaaactcagggatgaggcaaaacgaactgcttttttaagaagcatttttctttggaaataggcatgtgcatatataacacagtatgccatcaaacaaaaatggtaagatatattcaaattgactatgtggtatttttcttgagggcttgaccaacaaccgaattctgctggtttaaccaaagtaggaaattattttgtaccacttggattgttgccaatttttctgatgatctgttgggaacaatttggcaccaccaacccagcttgtctgcatgctgcggcctaagcatgcttattggttagtacttagcacatatttatttataacctattatgagctgttcatgtgcaacagtacatgcaaaagtcatcctgcatgtacaatgccaagtttacaacgcagataaatattgctattcctgtgagaattaaagtgcttcatgtaaatttactacaacaatcatatacaaaatcctattattaaaacgaagttcttaattaagatccattcagccttctcaaagacttgcatacaaatctttcccaaaaaaaaaactaccatatgcaggcaataccttttgcaattaatattctttcttcaaatgataagagcacccgcaatggtaaagtaaggtgctatctgttttatacatctcagcaatagactagattaatagtaaatcacttcaatggtatgtctacatgggtatctatagctctctaattcattgcatcgtttttctctatagactatctccaggttagtagatagttttgctccatctcttcatttaatctcttccaagtagaaaaatatgttgacatggatctcttgtagagaacctatagataaccattgtgggtgccctaatatacacgccatattgcacaaaaatatagtatggctttacccttaaaaaaagtataacttctttactccttactccttttaacgtttctggtgatggtgatgatgagtctgcctgatatttggacctcacaaagtggatcgatcccacatagctagtaaaatcaaaatccttcatataaatcactgcaaataacagttcgtatctcgatatactcctagataacagctcaatttgctagcacaacaagaagttaaaagagattcataaaaaaaaatacaaaaaagaaagaacaaaagacaagtcaaagcgtcccgtcaagcccaaattaaataaaaaaaatccccaaccaaagccagtcgattttccacgtggccaacgcgaccagtccaagctccccctccttcacctaaacccc

SEQ ID NO: 81169 - DNA, 2117 bp, Oryza sativa
aaagtgcaacataaaattgagctagataaaatttcattaaatactttgcttatttttctgtttactggatttttctgggaattatttgagcaagggaattatttttaatcaacgaaacatcatttcatgaattattttaattgaaaaggttttaaatcttcccctaagccgttgggctgattccagcccatctccctcctttgggtgcacggctgtgcagctcagtcaggccagccgagctttccccttctgtttctttctttgctttattttcagtcggcccaatactgaaagtctactttgcatacctgtgcactgttcttcttcaacctctggcagccgacctgagaccgaattggctcggttttccccctccaaatccggcctttcctttcatgcaatttctaaaactagttgaggggatttgtttcccttatcctcttttatcccttcccccaaaaatccgattttatccctttgaattagatgcgaatttggattcgttttcgaatttctctccaaactaaccatcggattttccggctcaaatcctctcgtttggagtccgatctccctcacccaagcctatataaagcatcccctagtcgtcctctttcgtttgcctcaagtccaagccgcagccgtcgcctatagtgcagccaccgcgcaaaccctagcgccgtcgccgccgtagccgcttcagccgctttgcgccaccgctgtggtcgtcgccgccgccttccgtcgccaccgtcggattcgccaggtgaaggagaatcctgtccgccccttcgccgctgctacatctcgctggagcgtcgccgccgtcgtcaagccgagccgtgctgccgtcggagttcgtcgttggtcgtcgttcatcgtagttctttgcaccggtgagtttgcgtcgttgtcttcttcttgtaggtgccttcggtttagccgccagagctctctatcgtcggcggagtcgtggtccagtgccatggctgcgatgatgtcatcctgacatcataaatcctttatttaaatcgtaataattttctgtattagatgaaaatctgattaaacttcataaattcataactaaatcatcgtaactcggattgaagtggttcaagttgctatattcatctaaaattgatatctatatgttaaaaatatccacatgtactgtttatacttgtttttgtactgttttgttgattttgttcatttgctttagtttccgacgttccggaggagaacgtttacattgaagaaggtttagaagcgtttgaggaagctcaaggtaagtcactcagatcccaaacaactctttgagcatgttgatcccgtttaaagctaatgttttatttcaacttatgcattattttccaatgtcatcgagtggtgagcctttcccaattaattagtggccgaagatgactttattttcatatgggttataaattgattagcttgaaccttatatattggtttggttcagctaaatgctttatatatataattgcttagtcatgcttagaaacattagctcattaatgagatgaatcaccttacattatacttatggttgtatttaatggtagctcacgatggttaatcgtgttatcataattacttgatattaaaaccggattaaaggtgagctgtgagcacatggttttgatggtcgtgctcatgacaattaaggaccggttcgtaagctattgttgtgaaatattaaccgtgccaaccagaagccagcgtgggcaacggctttaccttttgtatagcatagttcattatggggtgccagactgcgaagcggtgaaaagtccgtggggtcgctggggagtccatgcctctggttgtagagggggtgattatggtccaggtatggtgcactgtggtgagttgtgttgtgcgaggggtattgtcacagttcctttccgatgtaccgtggtagtattgaggcgcatggtgacatgtcgtggagctgtgtcttgagggtacagtggtatatctctggctagagtaaaactattcgaatacccgtgcccgcggttatgggcgggtctaacaatgtttttcgtgattagtctcacactactcattaatgataatactgtgat

SEQ ID NO: 81170 - DNA, 667 bp, Oryza sativa
ttgttttaggtttggttgtgtgtgtctcgcatgtgattacatcagtggtgggatgtaagtgcatgcgttggtttgttttcgagtgttaggtagttggtgagtttagtggtgtgagagtcttcagtttgtaataatgaaactcacttaagatcaataaaagttaaattaattctctgtcctaagtagttttccccggtttctcttcttgtgctctgtccatgccagatggtgctcactcgcagcaacgggaatggccccaacaacaacaacaataacaataacaacaacaatggagagaatcccacacttgcccaagtcctggctcaacaggcacagcttatgaacatgatgatgcagcaacttcagaaccagcagaaccagggaaataaccatgcaccttcccagaacaagttagccgaatttcttcgtgtgaggccgcccattttctccagtaccactaatcctgttgaagctggtgattggctgcatgtcatagagaagaagttggatttgcttcaatgcactgatcaggagaaggtcttatttgcatcacaccagttgcatgggcctggctctgaatggggggatcactttctcctgaattcgactactgctgaacctataacttggcttgaaattaccgctgctttccggaagaagcatatac

SEQ ID NO: 81171 - DNA, 45318 bp, Oryza sativa
tgtagcgcgcgtgtcggctagcccgtccgtctgcttgttcttcggaaccccaacttatcatttgtattaaattcctatttgcaataccagattgcttttatcttgttctggcttgtttctacgatttgcttgcaggaatagggttgatatgcaccggcaagatcaacaacccgcggagaggtgtatcgatcgctaaggcgcaacacaacgtctcatacggttgtagtcggatcgtcaacgtttctcccaaatcgtagttatcacaactcaccgaaagatcgggccaacaacagccttgagtgtcgagaggaactcagggttcatcatatctagatgtttgtaagcctgcacagacaagtgataatggaaattacaagatgcaattttcctttgggggaaaaaaaggaatcaacggatttctttgtaaggttggaaattcagtatcacctcttctccggctggttgttggctgctcgacgccttctttctgcatactttgcagctagttccttgtccttctgttttcatccaagatgctaaaagttacaaaactttccaaacagataaatgtatttgcagctaaaatcagaacgataacaggaaatgacctggcttattttgttgaaaaaaggaacacaatttgtgatagagacatttgtgattagaacactaattattttgcaaataatttccgagataactagatacaaattgcaacgagcaatgcgtgaggaaggacatattagctacttcatgaatgaccaatacaacagctaaccgcttagtggaaactgaatgattattcggctacgcatgcttgaaaattagactgaagaaacaagcatatttgtccgtgctaacagtaaccagcagttctgcgttcagtgcctctatagtgcagctgtgagtactttgctaatgccgcacaatgactagcagttcaagatcaaattattagttgctagctgtttcgtgagtaaccaatcagcacctttcaccaattgataactgaaacagtaattagccaattctaatgtagaaaaatgggaataacagtataaaccaatccgattgccaatgtccaaaacaaaatcagattccccagtcaccgatgctcattttaattcaaggaaaaaccgacactttatgggagaaagttagggataatatatatatatatatatatatatatatatatatatatatatatatatatatatatataggacactcatatggggcaccatggtgcccgggcaccatggtttcaaatgcacaaaatcactcaaatttttcaaaattttcaaattatgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttactttcaactagttagtaaagtagttaatattaatacctaaataattaaaaaagttttatgctcatttgaattgggtatatactcaatttcaacaatggtgcccaggcaccatggagcaccaaacaaatttactatatatatatatatatatatatatatatatatatatatatatatacaccttctttacagtcttgattgccaatgtatcccccattagcattcatagtgttcatgtgatcgatgtacctctcccagtcaaagctaccaggatgggaatacagactattgcactcttcatcagtccagtctgcgaatccgttaggggcgaaagggacatccattggtcttaccgcattagccttgtctgcccttatcgcggtctccttgaatatttcatagcagcgagccttctcctcctcggtgctgtacgaacggttgtgctccttcatccagtcctgaaacctggccttcatggttgcctcatcgaccttcacatcctgctgcttcacagcttcttcccagtcactcacctccttagcagatgcttcctcgtcgtaaggaggcattcccccatgagtgtttgaaagttgacatgatcgagataactagcccactgaactgtgccatctttgtccacaaaccctgccttgatggctgcttccttactcaggtaagggtaaggttccttgacagcccccctgtcacatacatcctctatcccataatataagtcggttaaacttagtacggtctttaaaacaaatctttggattctaatttcttatatatagtataatgtttgtagcaatataaaagtaaactataaccatatgaaattaaattcaaatatcaatccaatgtattattttcagcaaataaaattcataatagttaatcaaatgttttaaaagttgaatcttaaaacgcatgtgtgccttatattatattatgggatttaggcagtaaccccttcctgccttcctcctgcagctggagatgtacatcaacaggtaggtggtggtgggcatggttaggtcacctggatcagagctaactaacgaagagaaatctaaaggcttttgttttgtttttttttcttttttgtcaattcatacctcctgacttgtctgtgctctcgttgaaatacaggattgtggccaatccagccaacgcaatcgtggctacaactccataagcgccaccatcaccaacggcgagatccctctgtatcatacagagatgagaacacatgagctgcgagtgcacacaagaaataaaattttcgatctgagaaccgggtgaaacggacggagatttcaccagggcgcggagagagcgtgctgacctccccgccgtagcctgagtgaagatccccagcgaggactccgcctccgcctgcgcctgcgcgcgtggcgagaatctcctacaggtgagaagggaaccgagggcacggagagacatggtcgccacaggagagctccttcttcctcctcctcctcgatttactcttcgctctccgccgccgccgctcgcctcgtcgcctcgattcgactgtagggtgtgagacggacttcgcttccgatggacggggcttgtatggccgaacagaactggaatccgttatcttaatgagtttgaattgcgtccatgaaccgtgatatataggctgtttttatactgggataaagttttggcgtgtcacattaaatatacggacacatatttaaagtattaaacatagactaataacaaaataaatcacagaatctgcttgtaaactacgagacgaattttattaagcctaattaatccgtcattagcaaatgtttactgtagcaccacattgtcagatcatggagcaattaggcttaaaagattcgtcttgcaatttacacgcaatctgtataattagttatttttttcgtttatttaatactctatgcatatgtccaaatattcgatgtgacatggtgaaaaattttgccagatgatctaaacaaggctatagtataacacggacacccaacttataataagttgccaagcagagcttctagaaagtatatagttctaggttttagctgacatgacaagtcaatatgaaactcaacatgaaccacacatatcagctttctcctctaatcttctctcccattccagctttcttcctcctctttccccctcgctctctttctagtcttcaagggagcggaccagcgggataagggggaggggcaggggagctcgatcctcttctcgcagacgaagaagatagggttcttggtgagacaggtgtaatatggaacgaaacctctggttgagagaacggtacgagtacctacgagtaccgacatacagctgatagcggaatgtgcaagccgcagcacctggggtttgccaaccatggcccccaacaccatggccacagcgtccgctccatcctcacctcgctttttcttttttcaaatttaagttaactctagaatcctagaaagttttaaattttgagttaaaagtttcaaaatttgtgttggaagttttaaaattaaattgaaagcttcaaattaaatataccttttgaagctgaatagatatttctctattagaaatactcatggttggaagttttcaaaatcaagctaaacatttttaaatttccaatagaaactaagtaacaaattagaaattaaatctactatatgacttgattaaacccaaaaaaaaagaaaggtgacttcatgcatgcaggatacgatatcgctaattagcaatcaggcacgcccaccacctcccgcctgatcactatccgtacggtaagaaatacgcgtccatacgtataaaatatactccctccgtcccaaaaaaaaaaaagcaaaccctaagtttccgtgccaacgtttgactgtccgtcttatatgaaatttttttataattagtatgttcattgttgttagatgataaaatatgattaatactttatgtgtgacttatctttttaatttttttcataattttttcaaataagacggacggtcaaacgttagacacggaaaccagggtttgtcttgttttttggaacggagggagtatatataaacattttacgtacatgtataaagtttgtacgactatatatttaaaaaattatatgtcaaaaatgtatacttgtacgaataaatttataatacataaaaattgtaaagatgtgtaaagtttatacataaatgaaaacttggtatataattttgtgtacttatgtatgtataactatgtatatgtacatataaactttgcatttatccaagtataaatacaaagtatataaatacgtgtacatgactgaggaaccgatcccgcgggtgcagctctagttgtcccccctccggaacttgcctctatagtaaaaaaactcgcgctacttgcattgatattaacgagttgttgcttcctcctcgagagagctcaacggcgacgaagcagcgcgacgcgacgcgacgccctgcggtggcgtggcaacaccgcaacaatggcgccgccgccgccgtcgccgccgtgccggccgcgagtcaagcccgagcgcgcccttctgtgcttctccctcctcctcctcctgaccgccaccacggcgaacgccagcatcaccgactgcccaactacaagcagcaccaactccagccatgtcgacgacggtgccttcggggccaacctccgcgctctcctctcctccctttccgcagccgcggcggcatcgtcgtcggggttcgccgagaacgcgaccggcgcggcgccggacacggcgtacggcctcgcgcagtgccgcggcggcatcgtcggcggcggcaatggcaccagctgccgctcctgcctcgacgactcggtgcgggacgcggccaaggcgtgccccggcgagaaatccgccgtgatcatctccgactactgcctcgtccggtactccaacgcgagcttcgccggcgccgccgacgagcggacggtgaagctctggtggaacacggacaacgcgacgcagccggagaggttcaagtcgctgctggggacgctgatgggcaacctcaccgacgcggcggcgcgcgcgtcgtcgccgctgatgttcgcggccggcgagaccgacctcccgcccttcaccaagatctacggcatggcgcagtgcacccgcgacctcgccgccggcgactgctaccgctgcctcgtcggcgccgtcaacaacatcccgaaatgctgcgacgggaagcagggcgggcaggtcatcacgaggagctgctccatccggttcgaggtgtacccgttcttcgacgcccaggccgccaaggcggccatgtcgcctgcgccggcgccggcgccggtgacgacgcccaccggggtcaatggtaagtcaagtcaaaggtctctcccgtgcgcgtttgcacttgcgtcgctttctccacgcgtttgcttgtataggtcgcgaaaagaaaaaagtttagttgtcatattggatatttgatcagatattggaaggagttttcggacacgaatgaaaaaactaatttcacctggaaaccgcgagagcacacgtgggttactatattacttatgactaattatggactaattaggattaaaagatttgtctcgtgatttccccccaactgtgcaattaatttttttaatctatatttaatgcttcatgtatatatctaaagattcgatgtaatgtttttggaaaaaatttatgggaactaaaccaggccttaaccaggccttagtagctggttgcaacttgcaactttctgactctaaattccgaacacttgttctcttcttcaaccgtgttttctccttcaaccttgtcgagtggacagaacaaagtggtttgcacccatagattctgatagtacaatgacttttgtgctctgaatttgtgttttgaccatggtaaaacatgtttatgcaggaagtaatcacacagtcagtaagtctgtgattgtcccagttactgtgggagttgccgtgttactagtggtaatactgctgctaattgccctttgtctgtgcaagaggaacagaaaaccacataagcatatgatgattggaagcgtcggtaagtcctcaaggcttgaaacaactgcattagcattatagcacatctgaagaatatttaagggcttaactcgtcagtttttcctatgaacagatcttggagatgaagacgaaatgagaggctcagaatctctcttgtatgatttgagtactctaagagcagcaactgccaacttctcagaagaaaataagctcggagaaggtggatttggcccagtctacaaagtaagttaagtctgcaacctgacaatcaagttcagttctaattagcctgtaaaagtagctcacagattcatacttgcagttatgcaagcaatgtgatctacattacttgaacttaccgattctgatgctgttgagttcagggtacactgcaaaatggtcaagagattgcagtgaagagattgtcagcaacttcccatcaagggcaattggagatgaagaatgaggtagtcttggttgcaaagcttcagcacaagaatctggtcaggctgctaggatgctgcatcgaagaacgggagaaaatcctagtttatgagttcctctgtaacaaaagcctcgacactatccttttcggtacttcattcagataatctaagcctatttaattttatatatccttgtttagtaagctaatcaacagaatttacatggacaattcagacacttcaagacagcaagaccttaactgggagcaaagattcaagatcattgaagggatcggaagagggcttctttatcttcatgaagattcaaggctcaagatcatccaccgtgatctcaaagctagcaacatcttgttagatgtagacatgaaccccaagatatcagacttcggccttgccaagttatttaacatggaagcgagcgtagcaaacactagcaggattgctggaacctagtaagtgcttcagatattagagtcctctcttgaaaaagtatatctatactaaatgagcactcgaaggaaactcccacgttaacttatgaaagatttgaccattaattagataattgtattatcatgaccatatatcatattaagagtttctgtaaaataaaacaggtggttttaaatcagtgagctcattttagtttttctaaaatatagtaatattttaagaattcggaattgataaatatgaaattgtacccatattgaattctcaatttagtatgtcattgatttaattttaagattcgaaaataataactaagaagttgtaagttgttaatggcatatggtctcttttttcaacttgaatgtcactccctccgtttcatataataagtcgtttggttttttttttctagtcaaagtttttaaaatttgatcaaatttataaaaaaatatatattattattttcaacacaaagcgatcatattattagatttaatgaaactaatttgatattttagatgttgctaaatttttctacaaacttgattaaatttaataaaatttaactatgaaaaaggtcaaacgacttgtaatattgtaatatgtaatatgaaactgatagagtattacattactatcatttggaaatttgagctgagagcattagatatacctcttgttcagcggatacatggcgccggagtacgcgctgcacggcatcttctcggccaaatccgacgtcttcagctacggcgtgctcctcctcgagatcgtcaccggccgccgcaacacctgcctccatgactccgaggatctcctggcatttgtaatccccgcgcaaatcctatctaaagtttaatcacaaacattgcaatctgcaattcgaaagacttttgcatggatatacaaccgtctgagactgattctgctcgccggcgtgcaggtctggaggcactggagccgcggcggcgccggggagctgctcgacggctgccccgccgccggccgccggccgcaggagcttctgcggtgcatccacgtggggctcctctgcgtgcaggaggacccgcagctccgccccggcatggcggcagtcgtcgtcatgctcaacagccgctcggtcacgctgccggcgccctcggcgccggcgttcgtctccgcgagccgtgggatcggcggaagcccgccgccggcggcggcggcgggagatgcgccggcgaggagcacggatcacgaggttcctacggctgctcgatagccgtcgatcaacggcgcttctgtctctgaactagagccccggtgacatcggagattcggaggactgacggctgggcccggcttatgtttctgctctgaatttgaaaatttgttgctcgttttgcattcaaaatttctctcggatttaatgcatttctgtatgccgttcagtgttggagtagttaagtggatatgaaaatgtaatgacggctttgtaatttaaatttttcgacgagcttagcaattcaagtggtttatgtagtacaaatcaactcaactcagtcagaaaaagtagaaatcaaatcccttcccaaattcaaagcacaaatcggctggtattcgtggtagtagacctagtcaaacggcccaaacctcgtcaaatccaggcccaaaagattggcccatgtgttttttacattgaaaacaaatgaaaattgtgccggccaggttggaccagatggcctaaggtctagatagggtgggccgaaacggtctcccgcatcttaaaatttgtgtgaacggacgatttggcatcaaaactgggagtcttaattcagattgcatcaaaataatttattccaaaatttaataatattaaagttttcgtaaattaacaacattgtaaagttttgataggacgaacgatattaccagacaataatatggttcaaaatagtaggggtgggcattcagtatgaccgaaaatttcggtcttgatcttcggtatttcggtgtttgaaaagtgaatactgaatctcaacgcgaaaatatcaggaccgataaattcggtctcggtcttgaccgaaattcaacaacattttcatatatgcaaagaaataatgaaaattttcaacacaaaaatcacaaaaaaaatttgtaaacacgtatgagtaaagactcttattaggttgcatgcctataagaagtagagatgtgaaaattagagtttaatcctattgaacttagtggattgtaggttgcatctagatttttttttttgttaaatcggtcttttcagataaccgaggagactaaccgaattaacctaacaaaattcgatctttcacttcctaggaccgaattaatgaccgattttctctgtctcggtattttcggttcggttttttctgtccacccctacaaaatagcatcaatctaatcccaaaacctaaacacaccagccaatgacacacctgccccacccaacatataagcagcagtaccgaacgaaagctaaagaagtccacaccgcgtcaatcgccccaacaaactcgtaaaataaccaatcaattcaacagcttcctggaatctgaagaacaaaagttgtagaagagcacacagcgattctgacgaggaccaaggtcgatctctagaaaatctgtgctcttctgcgcgctagctagtgtagtgctgtgcaattgcatatgggcgggatggcgcaggctacagatgagtcgccacctggcaattttcctcttctttctctgattatctcgtacgttggaccgatcgacgagtggttccagccttccagaaatcaagcacggcgacaactaatatagctgtcgaggaatcggtcctgtattattcacttcggtttttaatctagacgctctgatggattgattaactgcgtacgtggttcaaactctactgttgatttgcaccataagagacgtgtgctttagagtactactctttggtttccttcaagtcacgaccagttcgttatctttgcccgatcattttgcctttctgctcggttattcgtaacgcgtcgacataagtatatctgattcgtaactgtctccatctttcgttacatgtaaacgaaaagaaaactgatagcctatcatgcgcgccaagctatggcttacctaagccaacgcacgcagccaccccctaccaaacagaagcttctctctccctggcaccacaactaaaagcaggtacaatagcagactataaaccagctataaacatatttcgatgagataaaagagaagagagagtagcaacgagctatagatttgtagccagctgcagcacggactccaagatacatgtgtgtatgacaggtgagaccatatattaattatgtagtatatgtttatagctaactattgtacaaattagctattaagttggctatagatgatttggagccggcagttggctatactattaaacttgctctaagagcaggtacaataacatgctataattaagttagctaaaagcatatgttaataagataagagaagcggactatagatttatagtcagctgcaagcctatagcacggactttaagacgctgtacgtgtaattaataatgatgtagttaacgattgtataaattaactattagattgactgtagatgatttacggctagtagttgattaaacttgctctaaacaacgggagaagccttctagatcatcgtgttgaaaaaaaatggcaacagccaacgcccaacggaaccgcccaagcccacacgtcgcgtttacctctccagcacggtcactggcatgtgggcccatgagaaagtgggacccacatgtcaatctgtgtccgccccactaccgcctctacaaaagcagagcgcgcgcggcggcggcagcggcagcagcagcagcaaatcgatcgttgtcgtgtctcgcgagatggaggcgctcgccggcgggaggccgctgtcgggacgggcgcggcaggtcggccggagcagggaggaggagctgctcggcctcctctccgacttctccggcgacagcggcgagttcggccgcgagctgtcgttcagtgacctcgtcgtagtcgaggacacggcgaacaaccccagcccgagaggaggcgatggtggtggtgacagggcagctccgacggcggcggcggcggagaacggccaggcgaggccgtcgtcgtcgtccgagcaggaggaggcggcggaggcggcgtcgaggcggcagcagcagcagcaggcggcggcggcggcgagggagaggaggctgcggagacggcggagcgacagcaggggaagctgcgggggcagcggcgacggcgtgctgctcaacttctacgtgccgggcctgctcaccaggagcatgacgacgccgcggcccgccgcccgaggcacgcttcccggcgccgccgcggccgcggccgcgccggcgacggcggctgccggcaaagctaggtgagtggctgtacactgtacacggcggaatttccggcatggatgcagacatgcagggatacgtagctatacatatacggtgaagtattaattatcttggaaagcaaattttgcatcattggtggttggtatcatataggagtatacatgtcaattaacagagtcaatcatgcagtctgatgaccctagcaacaggagtcaaattaactcttaatcatcttgaaatctttctccaattatgagattataatcatcatgtagtagctgtagattttgctagtgaggccaattattccacatttactacaactgcattagatccaactcttttcttctttctttttgatctgcattagatccaactctacttatattgtaagacgattacattctttgtggaaactacatgtgtcatctagtcaccgtgttctttccaaattccagcacagatcagtcatagcccctatagaaaatccagtgcatgggttgtaccattctttttaagtgaaacagcactaaaaggagtaatcagtgcatgctcctttttttttctttgtcagcatcaatttcttttacaattccaagcaacactacagtccttttagaccacatgaccctaaacatcctttttgacttagccagcttactgagtcaaaaatatcgatcaattcgtcaccaggaaatcaatgaaacatgggtcaggggatgacaatctgaccaaagcatccacaggatttatttgactaaaatgtgttaatttttttctagcataaataaattactatcttagtatttcagatgctggactgacaggcaatatcactgtagtaattaatggttggccagtagagtagcatgcatgatataacaaccaccttaaaattctgaatttttagacgatggaagcaacttctgagcctgaaatctgaattttatctgaactttcaggatggatgcgcctctggccgtcggatgctggccggcgttgtggggcggcggcggccgccgcgaccgccgcaagccggcgaaaccggccgccgggagacgggacaccagagtggtgacagtatgagccaagcataatcgatctactccttctattactactagcagagcagctagctttgcttaatggctttagacttcagttgagatgttcctttcctctttgtaaatattcctctactcgtttttttgtagaccgtgacactgggtgggtcggttcgtgtggacagtgagtgaagtttattggaaatttgggatgatcgtgacgtgtcaactgcaggggtagtacggttttgtgcctggattcacggcttcttcttacccgttttccatcagcgtattgcacaagtgatgacagtacatagttgagagaaaaacgtggcaaggcctctgcatctaccttgagcatttccaaaaatgctaacatttaaatctaaaaatgttagtattagggtcatataaaaattgggcaaataaattaccccgccctctaacaacgtctctaaatttggttttttaaacggcacatcattcgtgtggagggcacaacactaagaacatgggattgagattccgtgacttagtcattccctaatatccgtgttttttttctctgacttaagtcgtataattttgagtcactgacatatggattctctttgttgtggactcacttgccaatgaccttagagcatgagacagtgtcggtttctcgtgcgtacgctcactattgggggcatccatccctacctcaaatctggcttaatgatttggttaaattgaaaatacaaataatttgggatattttttcgccaacacagaaaatttgggactggatttaggcatttgttggagaggtgattttggccttaattcacaacaattataaaactgcgaaagatgcttagacctccctgggaaatgctctcatagaaaaaaagaagagttttaataagatcgttagaaaacagaagcagcttttctctcgagttcaatgcgtgatgttgtcgtgtgaaaaccgaaaaccgaatgtgagtgtgggagtgagtgagtcaccgaggaaacgggtccctgcgagtgggactgagttaaagctggcacgacacgacaccacacgacaccagcgatcgctgtagcgtgcgccgcattccgccggttttgcagggacagccacgtccaaattcgaagctgaaatcagggaagaataaagttgtataggagaggcgcacacgggccaatttcggcggcaccacgcgccctcacaaatttggcaggcagcccatcgaatcggcatgggccatggccctcccgttcccggtgccccgcggcgcgcattgggccgtgacttccaccgcgcacgttttggtgggcttcactggtgaaatggcccgcgttgaacagccccgcgcccccgcgccgtacaatgcagcatttctgaggaagaagttaaccttggcaacggtattttctctctcccccaaaataggtgaagttttaaacttttacatatgtattagtaaaatagatataattaaataggaaaatgatatgactggtcaagaaaatgaagtagaataagaatttgaatgatataagattgtaattggttgagaagaaaatgcatacgacgaaaagctcagattcacatttggacatagctggcactgtggtaacacattcacacggtaatcacagagatagagctggtacacatatgtactgctcctaattaagtaattactaccaggctaacactgtctttcagtagcaaacaaagcttaaacacagtactacagtacttgccatggatgaccccgccgccgaacacttgcccgtaataccagtccccaacggctagtttcaaccgttcactccgcccgcgtccgatcccagccgttgaatccacgccgcgccatcccggccgtcgatcctctcgaccgttggaggcgtcgccctccgctccggataaagctcgagccccccaccgcgccgctcctcccacgccaacgcatctccgcgtctctcctctccgatccaagcaaatcaagcaagaacaagaaattttagagagagagttggaagagcgaagagagaagaggaggaggagaggacggccgcctgcttcggtccgggagggagttcgccggagttcttggcgttcttggagcccggaggaggaggaggaggagcaacaggaggccgtacgcatggcgacgaggcaccagcgcgcggctgccgctccgcagccggcgaacagaggtgagcggcggtggctttgttctgtgttcttgatttgggttctttggggggacttgcctgaacttggggttctttggggttccaagctacggatttttctgtttgatgttccgaatctgtacgattcaagcggaaaattttgagttcttggtagtcgagtcttgcttggtgagagttccaggtctgttcgaatcctttttcaagaacggatttatgttgcgagggccaactgattccagtttccatcctttcttgcccgattcatgcaccaagaacggatttttgatgctgcccttcctgtgtttgattaggttttcttgatctgcttgtttcgatttatccccgtgtaaacgcaacccctgttgctaatcttcttctccggcgaatgggcaggtgctgcagtcgcagcggggaagcagaaggccgccgccaccgccgccgccggccgacctggtgcgagaaaccggcaagccctcggcgatatcggcaacgtcctgaacgcccatgtggtcgacgggtaaggagcagcacgacatcatcgtcgccaaccttccccgattcgttcttcctctcgtttccttctctgaaaacctcgtgttcttcttgcaacagcaagatccagctgccggaggggatcaatcgcccaatcaccaggagcttcggcgcccagcttctaaagaaagctcaggagaacgccgttgcggcgaacaaggtacggagtgagacacaccccccttctgtttctcgtgttcttcttgcgaattcagagcggttgatttgatccctgatttttgattttggtcgcagattgtcgtgcagaatccggccaggaaggagccagctccgaagccggcaaagaaggtcgtaccccgtccggagaacgccgccaaggccagcaccggcgccggcgtcaacgagaacaagaagccgtcggagtcggagggcgccggcagcagcagcggcggttcagccctcaagtactccaggaagaaggtcgtgaacacgcttacatctgtgcttactgctcgttccaaggtgagtgatcgatcgaacacctgtgcttgcctgcttatttctgcataattgcactgtagctgaatctgaattcgatgttgttaatggcagcacgcgtgtggcattactgagaagccaaaagaagtcgtcgaggacatcgacaagctcgacggcgacaaccagctcgccgtggtggagtacatcgaggacatctacaacttctacaggacagcccaggtaaacctcagattcttccatcttcgtttcagtgaagctttcctcttcagatttgttcagaaactgacagtgttgttcttgcacagctggagcgccggccgacagactacatgagcagccaggtcgaggtgaaccccaagatgagggccatcctggcagactggatcatcgatgtgcactacaaattcgagctgatgccggagaccctctacctcaccatgtacgtcatcgaccggtacctctcgctgcagcccgtgctgcgcagggagctgcagctcgtcggcgtcgcggccatgctcatcgcctccaagtacgaggagatgtgggcgccggaggtaacgcagattcgattgattcaacaagacgaacaagaatcccaatctctgcttcacacttgtgatgtaactgaacaaaactctgcttcgctgcggtgaacggattttttcaggttcaggacctcatccacgtctgtgacaacgcctactcgcggcagcatatcctcgccatggagaagaacatcttgaacaggctgcagtggaacatcaccgttcccacaccttacgtcttcttgctccggttcatcaaggccgccggaggcgacaaggaggtaaaaaaaacaagaagaagaaacaaagaacttgatttcatttctggtgtgccatggaaattgtaactgtattctgatcagagacattgtgtcttttttcagctggagaacatggtgttcttcttctctgagatggcgctgaaggagtacggcatggcgtcgctgtgcccgtcgctggtggccgcgtcggcggtgtacgcggctcaatgtacgctgaagaggagtcccctctggacgagcacgctcaagcaccacaccggtttcaccgaatcacagctcaggtattttttcaactttctgaatttccattttccctgaaacctgaactttctgaacttccgtttttcctgaacctgaagtttctgaacttttcaatgatctgtaaactaacattagttctgattgttgggatgaattgattgattgcagggagtgtgcgaaggtccttgtcaacgctcatgctgccgctcctgagagcaagctgaagacggcatacaggaagtacgcatccgagcagcttgggcgtgtctctctgcgccctccggcagtttgcctagcctaggattagtactgttctggattcggtttagactgtgatggaatgtcgttcttgacagtatttaagattctttcgtgggtttagctaattggatcaagacaacttgagagcgattgttgttgggttttttgcggggttactctgaactctcgagtatactcatgtattcagtactgtgatacaccttggtgtaactactcttcataaattcttttcataagtatgaattgaatgaaaagtattctttttccataattcttttatgtctgccaatttacttgcaaaaagatgtgtgctcaagtataattctgcaatgaaatcaaacttttgaggctactgaaaccaaatgattttataattcttaactctgcaaataagcaaatgtgctgactatggaaggtaagttatatattggttccttttctgaacttgcacagccataaaagtttccaaatcaccatttgaatatctttttttttctcctgtaaatgaactagaagaaactttgctctggaagagaaatctagtactaccagtagcattcaggctgtgtttagatccaaagtttggatccaaacttcaaacttcagttcttttccatcacatcgacttgttatacacacaacttttcagtcacatcatcttcaatttcaaccaaaatccaaactttgcgctgaactaaacacagcctcagtttcaaatagagaacaaactaaaagcttatttcaaataagtggtttcaggcaaacaagtttcagttcttgaactctgaaatgtagttgatcagagacgtcacgtctctgtaggaagaaccaccctcttgaaccgcggcgcgagaggcctctcgcatcagcgaagctctcctcctcatctccttcgcctcttccgccgccgccgcatcggaatccatcaccatcagcctcctcaccgccgcggcgatctcctccctcccgacgacgccgctgcagccgccgccgtccccgttctccctgaggccgtacccgatcctccactcgtcggcgacgagccgggcgacgatcggctggtcgaacgctatggggagcgtcagcatcggcacgccggcgtgcaccgcctccagcgtcgagttcatgccggagtgggtgaagaagccgccgacggaagggtggcacagcaccttcagctggtccgtccacggcaccaccatgccgccgccgccgcggaggatgtctcgcgcgccggagtcgccgcggagcacccacaagaacgtgaccttgctgtcggcgaggccggcggcgatctcgtcgagctgcggccgtgacaccgagaggaagctcccgagggagacgtacagcaccgagcccaccggctgcgcgtccagccacgccatgtatggctcttcttcctcgtcgccggcgtggtgttcgtcagcttggagcgccatgtatgggatgcaagggccagccgagaacgccgggtaagggaggtctcgccggagagcgtccatggcgttgctctcgagctcgtagaaggaggtgaagatgacgcactgtgcttttctggcatgggagtaggcttcgaggatgaggtctaccatgttcttgttcgtgtgtgtgggctcaagatcgctaaacctgatcgatttcagcccaggaatgtagtttccgacctcatcgccatctgcatcggatcgagcaacaaattttcatttgcaacgaaatttacgatctttcatgatgttcagagcttcgtaccggcgatgtcggtggccgtgggcaggcggtcgaagtgatagtgcacggagaacatggtggcgctgagcggcgagaggacgcacaccggcaggcccctccggttgccgacgccgaccgcccacggcagcacgaacgtgtcggccacgatggcggcgggcggcggcggcgccgcgccgagagcgaggcggtcgaggaggcgctcgaacggcgcctccatcctggtgtacacggcccgcacgaacccgagcatgtcgccggcgcggccgtgctcggagggcacgacgttggggatggcctcgaggcggacgccgccctccgccgccgcggccgccgcgccgccgagcaggccgagccactcctcggtgacgacgacggtggcggtgacgccgtcgcgcgcggcgaggatgcggcacaggttcagcatcgcgttgacgtggccgcgccccgggtacggcaccgccacgacgtggcacggcggcggcggctcggccgaagaccccattgcacgcacggcgcggcggcggcggcgaacaagctcggagctgcacaaggttcacgaagtcaaagcgagaagcgaggttctgaacagtgagacatgatccgccatgggagtccgtgacctcggcacccgccgccgcctcgagaatcgtgatgattccaacgctggaatcacgtgtagtaggccaacaaattctggccaacctggagcccaaggccttacttagcctaatgggccggcactgtgggctttcgactggaccataagctttgcgggcattgtgggctttgcttcccaagcttcaacttcagaagagcagtgtttgaagggtttgtacttaaaatgtgtgagttgagtttggacttaaaattttatgaattgatatttatatatattgtacgaatgttgtcaatttattttataatttttaatagctatttatatggttttttaagacatatgagaggacatccctaagggtttaaaagagtttcttgtgtttgaacggtcttcttttttttttctagttaaagagagttttattaatgactgaataatggattatgttcctgatttaagaagtataggattcttgaaggagaacaaagtctccactccgcataaaacctagtactcattgtcagttgagttaaaacatgtgctaccctatttgtttctcttcttatctcgtgcatttgcatctgttagaataggtgttgaatatactagtcctatttggttacagttggacttggaattgtaataggtgttagggggtggagttagagtcgaattctgtaacccggcatctctcttaaatagagaggggggcaccacaatataaccatagcgactacaatgtagcgtagacacgcagggagaggatgtcggcgtggccatggactcgtagcagctaggagctatattggttggggaggagcgcccataatcagagccccggggatgtaggcttcggctgaacctcgttaacaaatatcgtgtgttcctgtgtcgtcatctggcatgtcttgggtgatcaatgattgaagcgatcgggaaggttagtcgttgttccgctatatcgactaacttttataacaagtggtatcagagctgaaggtttcagtattggatcaagaagacatgtggaggaggaaacacgaggcagggatcgcgcatcgacaggagatcgtcagccgtggcgatgagatcgatggcgacaatgaggacattgcggaggcgatgacctcgctcgcgatcagaccggcgatggcggaacgtgaccggaagacggggccgggcgtggccgaaggcgacaggagagattggaggggtagcgccatgtacggcgtgcccgacgcccgcggcgaatgcggatccgcggcggcagggaggccactgatggaagggcgaaactggcgagcgtggcgcggcgcggcggacgtgtagggccgatgacgacggggtcgtggacggtgaacacgagggctgcgactgcggtgcgtgcggaggcacggacagtgcgtatggagtatgtactatacacatgcacaaaatacacgtgttggcttacagacgaacaggaagccatgggcttaatgatgcagacgatgacgcagcaaggaagacgataaaattgagttcaatgcagaagaagacgcagatcaaacttgactcggagaagatgtggattcggagtcgacatcgtaaaggactctgtttggtaggcgtggatcggagttaggagcaaactcatgtatcgaaatcggcagagcggatcgtggactcgtggtgcttttggcttcagttcgtgtaagaaaacagggcaattacttggctgcatgcaatggggattagtagtgcaagtttgggcatggactatggtcatgtggatcattaattgcataaacatatcactactattacaaggtcacgtgaaaagcaccagcaggcatgccgttctcacgtgggcttggtggcgcacgagaggaggttgtgcagtggagttgcaagctacatcaagcagggcacggagatcaaaacaactaaacggacttgatcaggaaaattgatggatcaatgcggtggacgagatggcaggagtcaacttgttgcgtacggcatggacagatcaaattgacctggagtttgggacttggtgattggtgcaaggctgtgattcagcggagcggttcatgggcacaagacaacaaacatggtgtagatatatggtgatcaaggcaatgcaatgagtatacttgtcgagacaaggtgcgtaagatgtgcatgtatgacggttaaactgggccggcagggtggtcagaccgatggactggttagactgcgaagcttggacggttagatcgagtacaacggatagtgattcgttgtagaaacttgtgaatggattcagaataagggcaagaagtttctacagtctggatagtttgcaagtgcaaaaggcgagtagactggtggcaacaggctagtcaggtcgcatatcgaattatctggcgggaacatgatatatctgggattcgacgaggagttgagatatatggagttaagccaggactgaagaaaaggacccgggcaacagcgggtcaaatatcgttgatgggatcagcgatactgtttggcagtacaggctatatctaggatatgcgggtcggtatgatggggatatatggaaatctgcgtcactgaagaggaagagcgaaggctatcgtggtaattcttcgggtgatttaaagcaacagtgattttctcaaattatcaggaattcagtctacggatgcgggaaagcgtgaatgatggatttattagttcagttcataagacgacaaggaagaaagggttcagttcttcatgtctggtgagtttggtttatctatttggtgatgacaagggttatttatccatggattagatcaaatcaaatttaagacgaagatggaagtgaatagctaagaaggaattcaatttcgcttcgcaagacgactgagatgataggtgagaaggtggagcactgttgcaggtggattcaagaggaagaaattacagggatatcggagtctcttgaagacggtgggtctggcgtagactcgtcgggcggctttgcggtgaagctgcaaagaagacaacccaagtctggaggacaggtggatcggcatggtgattctactacttctaggtggcgtatatttgtcaaggtggagtttgttaggataggtgtcgaatatactagtcctatttggttacagttagacttggaattgtaataggtgttagggggtggagttagagtcgaactctgtaaaccggcatctctcttaaatagaggggggcaccacaatgtaaccatggcgactacaatatagcgtagacacgcagggagaggatggcggcgtggccatggacggctaggagctatattggttggggaggagcgcccataatcagagccccggggatgtaggcttcggctgaacctcgttaacaaatatcgtgtgttcctgtgtcttcatctggcatgtcttgggtgatcaatgattgaagcgatcgggaaggttagtcgtcgttccgctatatcgactaacttttataacagcatctttttaagacattgtatgacacctttgatttttgcaatcgtcatcgaccaagacatctcaatgaaactttatggtttaagattctccaacaatattagcatatgaatctattcaatacctacccaaagaccgaagtccttctaaacatgctagtgcttcagcttgagcagtgaaaccacaaaggtgcagggttttatgcgcagccaacagcaccagtcccctacaatctttgattctactaaattcactacataaattattaacgttcgccttaatttgacaatatgccctaaattctaaaacactgtcgcttctctatttttctatattattttcttattgtaaataatttgctattgagatgtcaatgtgtcatcggtgtattgtacattgcgcctatagattcatgttatgtgactatcccctcaaatggaggtccagttcagcctcatatacctttgaagtaatatctatatggtaaaaatccgccgaaaggttatgtaccttacgagtatacccatattcatggtaaaaaaatccgccgaaaggccgctgccttcaaaggatcgatggtgaaggttgcgtgcattgagatttgagaatacctgaatctctctggtgaatgtccacgaggcaccggttataatgggacacataagtatactttcttacctgtaatataaaaaaagaactagcatatcatgagcatcattttgaagtctttttgaagacaatgaaacaatgtttacagttttgctctctactctacaaatagtgagcatcttttctccccatttcccttgcttcaggaccaatatgataaatccaaccatcacggaatatgtgctcatgtaacaaaccgcaagatcgatcgcagagacctgattgacgtgctggagcgatttccgaccatgcactgcacgattaaacaaaacgtaattaggcctgaaaagtggcaattaactcgcctgtcaacgcatcattctccatttctccccaccaaaaaccggaatcagagagtgagagagccagtcactcgccactgccgtttgtgcgctcccatctgcatccggatgccactgctcgctggtctgtctgtccataaatataaatattttaacggtttaattttgtttagaaacacagtgcaaatgtatgcacattcacccctatgaatgtatgcacacgtcctaccttatgagcacctccgaaacattggatcggcatatctatgagcatctccgaaagattgggttggtatattttgagattgacgaagtcagctgtcaatgagtatgtcgcctaccactgaaaaaaataattatctataaatacgagtacacggtcaaatatagaatttaaaccgagtgaactggttccatcataatgaacctaaccagttaagctgcgctcacttagctaaacagtttaaaatttgtttacaaatataagtgcttagagagtgttatgtatctcgtcgattgtctcctattcaaagttttttatactctcttcaggctgataatacttatcattttagacaaaactaaggtcaaactttagaatctttgattataaatcatttttaaatatttgtctttcaaatatggtgagtacatgtatagtttagtcttaaaagtactttaattaaatcatatatttgttaccacttttatatatattataatagaaaataatggtcaaaattgtttttttagagaccgtgctctttttcaaaacgataaatattatcaacccggagagaggattttacttccaatcacctcctaccctaaccattcttctttttgtaatgagcgtcgacatcagagtttttctaattacttgttaaaagatttaaaatatttatatttatgaactgaaagagtcgacgagtagtctagtctgatcactatgttacctcctcctttagactttttaccccattcttcaggtagttaaatcgaaaggtccgattttctcttgattcgactaacgtagaccagcatggaaatgcctgttctgaaaggaatctctccccccttttgcgtcacctgatgatctgtgcttgcgtgcattcatgatgcatgtcaaccagtgatttgctgcttatacttcctccgtcccagtaaacgtgtcgttccacggttccagtaaagtcccaaaaaacttgcgtgcattcaaaagtactccctccgtcctaaaataagtgcagttttacactattcacgttcaacgtttgatcgttcgtcttatttaaaaaaattttatgattagtatttttattgctattagatgataaaacatgagtaatactttatgtgtgactaaatatttttaaatttttcataaatttttcaaataagacggacggtcaaacgttggacacggatatccacagctacacttattttgggacagaggtagtatttgctgtccaacgtgttgtgtgttgtgacatgacatgacatgacatgacatgatcaaccctctcgttgaggtgaatctgtcagtattacttatcctacctgaatgctatcagagagaagctaattgccctaagctttgtttgctgatacttgttctgtttctgacgaacaatagagaacattcactttttgaactttgataattcatcttcttttatatatactgaatctagaaacactaaataacattatgttattaaaaattattgtgctctaaatataagcatcaaactattttcacgttagtctaataatttaaaaacgatcgggatcaaagtggtcgctatttagaaacggatggagtagtaattaagtttgaaaaaaatgctgtactatcatgtactactacactagtaggattttgcaggttatttgctccttggctagctactgtttgtatgtcgtggtgtttgtactatgagcttaagagtgctaaaaaataaaaaaaaactcttttttttgaaacctaaaaataaaaaaacttcagttaccaagtgatactgacatactgtaagcatggatgaggacaagtacagcttcagttcaggctatgtccagattacagaagatacgaacgacgtgagtgcgtggatgacacagacagcaaaagccaaaaagagatgcttaactccataccaattatgtcgtatttattaatagaagcacctttcacatgatttgtataagagtatttactcctatatgaggtgatcatttattccgtttcaagaactagttgaatgtttatgttctgatacaaataaataaaatgtgcttacaactaattaatgtgattgtgtcaaagattagcatatacaaatataggtgcaccaactttaacattccttaatgcgtacacccaatttttgggcttttcaggagaaaataagcttctaaaacagtcaagtgcactaaaaagaagtaaaaaaatatcttttgtttgtttgagttaagaagctgaattgggctttggtttgaatatatatgcatagaactatcagatcatccatatgttctctgtctagtctcatcgaaggagtgaataatccgtttgaactttggggtagtatagctttccgccatggactccacacaaaagaaattcctttcttctgctgtgtttggagatgtagctgtccgaagccgctgaagaatattgcattattcttttggaaagtgatgtagtgaccacttgctggttctcatctcaaagaaacaatacttgcataaaacagaggagaccatgactcaaaagtttgcctcatatattggcttgtctagtctaggccatgaacaccatgcctgcctaacaattcaactttgttgtttaaatagcagttatattgggaaaaaaaacacatgttataacacgcgagaggagggatatattagctcaccaccatataaataacctataagtggtttgcaagtcatcataaaactttgaactttagagcttgcttatttgagacacggttatacaattttaaattttagagaataattttagcattaatataaggttttttttgtcctttttaattgtcatttggcattggctttagaccgccaaaaaaaggcacaaaagttttacactaaaattgcttcatccgtcaaccgagagagatgtgagagttgaagggatagcagggagaactcaccaatgactacgacaatgacttcctatgtgagcctctagatgtcgttggcatatgaactctggcaaagcatgtatcaccaggttaggttttcagggttggtcgatagaggggcaacaagggtggcttttgagtaaactctgaggtggctgaggaccaacgttagatggtggagatacgaggacgagcgatggcactgaaattgtagagatggaagagagcagtgaatgaggttggaaggaggggcaaagaatgcaatgtggttaggaggaatgcggcaatagttgctaagcagcgaggagagaatcgaagtgttgcgatggatggttacagagagtgagaagagttgactagtgttagggttatatgggatgtatgaatagagtaaatcttggcatttaaaaaagtgacttgcatctaaaatatctttagggtaagtgatcaatgtttttctttaccgcagcttgtttttagttggcttaatcatgtatctttgatttataaactgcacccaaaaaataccttccaaaacaacttttatggtgtgtttgaaactaatatatgttatcaacttctactcacttgtttttcacgcgtacactttaggaattgtttaacagtgtgttttttaaaagaaattcataggatagttgatttaaaaaatagctaatatttaattaatatgttaatgagctaatccgttttcgggaccgagcgcaccctaatctccacagagtgacagaggtgcaccgcaaccagtaagtatgagagcatcagcatgcaatttcaagctccagcaaagctgccgtcacggcgtgattctccgtgtctgctgctctgctccacgtattaacgcattgcaaggcacagagaaccctctacctcatttaaaaatctgaattgtgcttctccttttccccttttttttttttagaaaaagataggtccggatttctactcggaatccactaaaatggccattgagcaggagcgcaaacattttcggaatatacgaatccagcgttgcactggcccacccaaagtggggaccaccttactcacacaaatttctttcacagagaatcaccgaaatgcccctgcccataaaccctataaattgactgataagcaacggccatttcagctcagatcagctcaattcagagtgtgtgcctctcgatctagatctctgagttcttgccatctttaatttgaaaccgaaatcatcagctgcaatcttcgagattaattaggaagctaagatcgccatggcttcctgctgcggcggtttcatggagaaggccaagccctacttcgccatgatctgccttcagttcggctacgccggcatgaacgtgatcaccaaggtctcactcaaccatggcatgagccactacgtactcgtcgtgtaccgccacgccttcgccaccatctccattgctcccttcgcgctgatcctcgagaggtatacaatccgttgttttaacgtgtactcgtatgtacccttattgtcggtttaagcttctggatgaactggtcggtgcacggacttgattgttattgtacattgatcatatgatgtgtaacggaagctgacgtgtcgctacaaattaatggcattatgacaggaaggtgaggcccaagatgacgtggtcgatcttcttccaaatcttcatcctggcgctactcgggttagtgagacttgtctacttacagcgtaattacactataattatactataattatattttaaagatttttaataaaagaaatcttatacgcaaactccattgcgtatgatcttgcagcgcttttaataaaaaaaatctaatgaaggattgattatgtttagtgagacttagtctagttataatgtagttacactacaatttgtaataagaaaatcttgcagcttatgttttaaaagatagtctcatatgcaaactctaatggaggattgattatgtttctgccaaagaaaaggaaatatttgccaatgaaaatttgcaaaggaaaaaaggaagcatagcttgtctctggaatgacacattggattcacctgttcttggtttgttggtgcagaccggtgatcgaccagaacttctactacgccggcctgaagttcaccggcccgaccttcgcctgcgccatgagcaacatcctgccggccatgaccttcgtcatggctgtcatcttcaggttcgttctccaccacgtacgatctctctcaatgcatccatggcgatcgagagctagatgtgagctggtttgacgttaatgcatggtgttcgacaggatggagaagctggagctgaagaaggtgaggtgccaggccaagatcgccgggacgctggtgacggtggccggcgcgatgctgatgacgctgtacaagggcccgctcatggagatggcgtggagccggcacgccggcgccggcgtggcggaggcccccgccgccgccgccgccgccatctccggcagggactggttcctcggctcgatgttcgtcatcgtcgcgacgctcgcgtgggcgtccctcttcatcctccagacgcacaccatcaagcagtactcggcgcagctgtcgctcaccaccctcatctgcctcgtcggcacgctccaggccgtcgtcgtcaccttcgccatggagcggcgccgcccctccgtctgggccatcggcttcgacatgaacctcctcgccgccgcctacgccgtcagtaccatcctctcccatctccggcgccggcgatcgctagcacgcactctgacgttcttggtttcttggacacatgcagggcatcgtgacgtcgagcatcgcgtactacgtgcagggcttggtgatccagaggacggggccggtgttcgcgtcggcgttcagcccgctgatgatgatcatcgtcgccgtcatgggctccttcatcctctccgagcagatctacctcggcggcgtcgtcggcgccgcgctcatcgtcgtcggcctctactccgtgctctggggcaagcacaaggagacccaggagaagcaggctgacaccaagctatcactgcccacttccaaaggcgccgccgccgctgcggaggcggaggagatcaccggcgccggagaagacgacggcgacggcgacgatgacgcggagcgcagcaagaaccaccgctcgagtggtggcgtgaggtcatcatcggactccaatggacatggagctagtgcggtttgatggacacctaactccccaataatttggttgcggccgtcgacgcgtcgacgcgacggcgaccgtcgccatcgccatgcgtgcgtcgacgtcgatctctccgctttaagatatccgaactgttcgtctacggcgcgtgcactacgacgacgatggcactaagggctcgttaaatttggaaatggaggtttttgtttggtaggaaatttttgatgaacttttactgtgttaatttccctgcaaaatgtaagcgtttgtcacctcgtcagatgttcagaatggtggcatgcatatctctgcttttttttttatcatgtttgatcaaagctgctacgctattttgtactggtttcatcctctgtccatcagagagagtgtattgtgttttgtaaattttaaactcttcttttctcgttactccacgtttacaaatagtacatatcgttttgaacatcaacacagtcatactaacttcaactttttaccaatgtttaacaatttgtcttattcaaatttttttgcaaatacaaaagtatttatttcatacttaaagaatatttgatgataaatcaaatcataataaaataaatgataattatattaaatttttaataagacgaatggttaaacacatctaaaaagtcaatgcgtcatatattgaaaaaccaagggagtatttaactttggcgctatagctccaactattgtgtctacatcagtttggtggttttgctgtagacaactggataagactgaattcctaaatgctaatcattatcaaacaaaataaggcagagttgagtacatcagttaaatatataagtgcactgcaaagcatccatacttgccagttgccacaaaagattcaccaattgaaagatcctttgagcatctccacatcactgttaattaccatactgtttgcaaaattgcatgtgtggcgtcagccaggaatatgtctgatggacttagattcagattccactgagaattatagtgccaaatttgttgctttctggtaactggagcgatcactttacagcttgaatgctagagcaattaaccagagaaccatgacagtactagttgtgaggtgagatgaagggtagtaaaaaggacagaacatgcttaccacaattcttgattatcttattgtcagataatttgacagatatatagcatgaatttgatattatctaaaaagatgtagcatgaattgacttgtccatcaatggactagaacaaactgattgagtgattgaagtgaactactccctccgtttcacaatgtaaaactttctagcattatatgtctagatttattaacatctaaatgaacgtggacaatgctagaaagtcttacattgtgaaacggagaaagtactgaagaaagaccatatatataatgttgttcatggataactcataacttgactatttgcctctaaaagtctcaaagctaagcatgtataaaattgtggtttagaatattggccttatcttgaagcaagaagaaagtacatataacttcattccgttatcctattgctaacaacactagtgtgtatatatactgtttttagctacagatgcattattagttctctttctggtgagccatgccacattgccactagctctttgctgctgacatcctgatatgaatgtataataaagtgatacggtgcactaaatttacaggccttccgcccttccgtattggatgacactgagcaaatagcaaaaccttgtactagtcatactactttcagtgcaaaaccaagaatggatatcaaactctatcatgagagggagttgcatagcaactcttatcatgagaaggagatcataactcataagcactattaggaattgcattttttttccttccaaatttcaggtctctgacggtgggtatggccgaaattttttaatatgtttcaagttagcaaaagattgttcagattcagtgaaaatcactttaaaactcgcaatttttttcattttaaatttcctaattttttatccttcttttttcaattccaaaatgtagacccctgcttgccacatgaccgatcaaagcacctgcagggaaaccactaaccaacttttcagaatcatgagtttttttttttcatacgcaattagtggtttccttgcaggcgcacatagcaaagctacgcaatatgcactactagtttgtcaatgacgaaagctttttttcaccaaagtcctgagaaaaattccttttgcacgatggatctacacggttacatctgctacaacctgctgcagcaacaggtagacgcattccttcacagattatcactgcattgagctgcaagcttatcagaaaaacgatgagaagaacatcgctttcgcaacgaggcacgcatgcgtgtgacatctgaataacaatgatctctcccattatagaattataccaatcaaatgaaaatctttttcttgaaaagaattagcctgaaaattctttatgcagtgtatcacaatttggtgagaattgctagctcaacgacggcaagttgctgcttattcaggtatccctactcagatagcaccgagacaatgcacatttagcttggcacaagtaagcccagctttgcctctctttttttctgcctaaaaaatataaaaattgtgactgtgagagttggggtttgcaactttaaattggcaattgacgtcttgcagattcagttgaaatgggagagaaaacttaggccaatggcagtgagagttcatgcaggtgagttagatccatggatggagcataacagttagcacggaatcttcaaaggggttgtgatgtcactcaggggtttgatttgggtttggcagataagatgaggtgtcgattctgggatgtagtaaaagccagagttcgatctgtttattgttctgcatgagatgagcatctctaaactctgggaggaagaacaagtgttaggtattgtgatacatattttatcttggtttccattagcagatttttcaaactactaaatggtgtggtttgtgtaaaagctttctatatgaaaattattttaaaatagcaaataaatttattttttaagtttataataatcaaaaattaattaattattctctaattgttttttcatttcatgtgtgttaacttaatattcatttttgtcaacttcaaacgggataaccgttgtggaactggattggttctctttacataacaaaatatcgtttcttccgtttccatatatcccacttcgaatcaggattaattttttctccattgctgggccgacatgggcctgcttcgtttgagagatgggccgtgcgacgatagaagcaaaggacctctcgtcctctccgagccgtgtgtaataagttcatctcaagtcccttaattttacaccgagtccgattttcgttcttagaaccccaaaaccagatacaaccggccctcgaactgtcaaaaccggtgaaaacgaggtccctagcggttttgaagacggttttggctgatgtggcgtctacgtggctggtttgactaggtctccgtcccatgtggtattgatgtggcgatgacgtggcaattatatcttggaaaaataataaaaatcatgggcccacatgtcagccacaaaaaaaatctaaaaatggtggggcccacatgtcatctggttgtcgccgtcgagcttgtcgatgtcctcgacgacttcttttggcttctcagtaatgccacacgagtgctgccattaataacatcaaattcagattcagctacaatgcgattatgctgaaataagcaggcaagcataggtgttcgatcgatcactcaccttggaacgagcagtaagcccagatgtaagcgtgttcacgaccttcttcctggagtacttgtgggctgaaccgccgccgctgccgctgctgccggtgccctccgacttcgaaggcttcttgttctcgttgacgccggcgccggtgctggccttggcggtattatcgggacgaggtacgacctggccgacttcggagctggttccttcctgaccgggttctgcacgacaatctgcgagcaaaatcaaaattggggatcaaaccaaacgctctgaattcgcaagaagaatgaggaacagaaggggtgtctcacccgtaccttgttcaccccaacggcgttctcctgagctttctttagaagctgggcgccgaagctcctggtgatggggcgattgatcccctccggcagctacatcttgctgttgcaagaagaatacgaggtttcagagagggaaacgggaggaagaacgaatcgggaaaggttggctatgatgatgtcatctactatatgattgtgtgcgtgagatcgttgtcttctactccggatcagcgaataggccactagttattcaatacgttatcagcacgagattgctcatacgctaatcccggtaagtgttctagtagatcaattgatttcagtactaatcagattgatatgttatctgtgtactgctcgtcgccggccaacacgaccgcccgctcatgcgcacctgcacgccgcgctcgacgcgtggctgatggtcgccggttacgacgccgcactggagcatgcacggcagcaggacgcatccagccgcgcgtgcccgaggcaaccagccaggcggctctaccacacgcagtacgcaaccctgcggctaggatccaggagcaaaggatcaagcagacaagcatacatgcacatgaatgtacagattggtttatgaaccaatctagtacgtgcacgtattgatcttcaccaagcctataacaacatgggtgtgcaacgacgtgtcgacagtgctgggctatacacagctacaccagcacgcaactcgtcgacgccgcgtcgccgatacgctatgcggacgtgcataagcggatcggctacctttacatcggataaacgagataagtatcggtttcatctattctaatactttgcagtagcgagagtaatatgctagatcatgcctctagtcgttttattttctcgcatgaatagatgtatttgtctggccttagcggcgactcttctcttgttatatcgctgaccacgaagtttggcaccacgcgcccgaacgcgcttaccgtgcacaccagaaggtgcacatacataatccgttgaattgaatgatggagtgctgtcccgaacgacgacacctcacactcggtaacacacgacaccacctagaagttgtcgtctatctggctaacatagtcgtcgatctatgaatatattaacacactcgtcatcaccgatcttatggatcagcgtgcttgggacaatgttggttgtgacttgtatgttaataatccgttatattgctatctatatgaagtagatggtaacaaatctgagtcatcagcacctgcatgcgccgccacctgcacgtagcgacacccagacgccaccacatgacgtcttcccctttgtcaatggttgccgaatcaatccagagaccttccctcgtcgatccgccatctgaaacaccgactcgacggcctttcgaggccatccgcaacgcaattgacggccgtcgcccgtagcgatgccgaggagcttacgcccgcctccccttgccgccgatacgcacggcatgcctcccacgctaccgcacgcggccgggacgagggtcgaagccgccgtgagtgcccgccgccgatagccgtccgccatgccggcatgtatgccgagccgagtttcgtcgacacgtaacatggagctatgattgtcggacgctggtcacggcctgatgccaaagaatgccggtgtcggtgctactagatgttgcaccgccgctccgcctctgaccatggcaacttgccatagtcgtccatctctaccgagggctcactagcacgtttgcaattggttccatccgtcgtctccattgaagaatatcaattagatcatacctcacccacttcttgtaggagaaggtcgtagtagctcattgggcaacatatgagatgggctggccagattttcaagctagccagtataaggaggtgggccaagtagaaattggcctattaaaaggagtcgggcacgaaccgtgattttggtccgaaaacggcattttatttcaaaagtccttggtttccaaggcattatgcagaactcggaaattatacggataagtcctatgggacattagaaactacggggaatatacattcgccatttatactttgaaccttcatgaattgggtttacgccaaatagagaagaactaaggatttataccttagtcccgtatttctaagtatttgctttaactatttagttagtttcttgaataacataatcaatcctagaaacattgtttttaggcaaaagagcttccatgaacttgtgaaacccttgttttagcaccccttttggaagcatcatattttatggtttatttcctggcaattgtttgttttggggtaattgattgttctgtgggttagtagttctgtaaattacacatacctttgaatagcaaaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtgtaattgtcgccacatttgtagaaggcacaattatatattctccgtatagaataaatgtatacactcatcatgaagaaagtatattattgacttagagatatttcttagtgtatgactatcatagaagataagttacaactaatttatattaattgtgtccaagtagatacaatgtcatcgaatttgtgaatatatagacgagaagtctatatgccaatatgccctacacaaaattatctatcaaaagactatgtacctatgcagtgtctatagttaatttgattgataatgttatgtccattttccacgtataaatgaatttacaaatgaagtattgtttttatgaatgtatgcacatcaattttggcctatatgcaacatgtttagttgttagaattaatacacaagaagttgtattactgtcaacatgtgcatttgcacgcacatatatgacttatactattaatatattcatgaagaacatgcatactcaaaatttgtggaaggaaaggaatttggtgtatttgaatttgatgttcaactcagggggagatgaatagtaatgacagtaatcttgcattcgttcttttgagatcgtattttacaatacatgagttacattacagattagattaagttcaatatgaagaacatggttaagctcatgtagagcttctttatcttttgctttaggcatagaagcttctgcattagattactgaatatttttttatataggtcatctcaccttacctatattgccttttttttacctgtagtaattctttaaccttttgtagaataaaattgtaaattatatgtctaacattgaatgtaaatatttgtcttgcctattatttgaagtatttttggcgaatgtattcttattatccactaagcctcaatcaaccatgtaggttggtagttctaagtgcattgacgccatattggcatacatgtagagctgttcacttatgcacatgaacaattagaatatttatgtttaagcattgaagcttaaatatatccacctgcaaccacattatttctttttagaaaagttgtaccatgaagtcacaacaaatatgtgggtttcacgacaactttttagtaaattttcttatgattggcgtgaaaagggggaggaatatgtgtattttgcaaattaatttcagaatatttataataaagaagcataagaaattgtggatatgtggcaggcaaattggtgtgttataggtcaaatgctagaagcaaaagatagcccaaactattagcgaatcatatttgggataattatgaattattgtcacacaacgaagtgtgttatttattggccattgaaaattgcatattcatcaaggaagtatgaaattgcatatagctatttaaaagctattggtttacttgtagtaaacaatatcctaaaaataattaatgaccttttggattcgaatgattctgaatgatcaaatgacaccacatttactttggcgtaatgaataaaagttagacatgtcacccaatttatttattggcatattcaagaagaataaatattctcgtagaataatgtttgggtgatttgaaaagttccatgatggttaaactatgttcatagattaatgttttagtgctatagttatgttcttgaagacatcatgaagttatataatactaacacatccatcttatgatcatatctatgttgcataaatataaacatgaagtttattgatccaacttaattcaagaattgaatatagtatgagtaattggatcaagtcttgggcaaataaaaaaaagttagaaaatagagtaattttgtcgactagtggatatttgtttgggattcattgtcgcagaataataaccctctatgaattggataacctacagtattagggatgtgcaatttttcatgccattgcattaatttttatgttagctcactgcatataatatctttaccccctttattttgtataagtgtgtgttcaatgaatgaacattttcctcatatatcaccaccataacatacatatatgggcctccacatgaagttggggatacaaatggaccgaattccattaatccagtgcctatgataggggatttttgtgatatgctattagataaagatcgaatatcggcatcagggggagaaaagcccatgtgttaaagatgccttatattttcaagaagaaaaagatctttataagtaagaataacgcacaagccaaactaaactagaaggtttagtttattctcctgtaagccagaagcgggagcttgccagataattatgaattaaaggagtaatcagaagttatgtttacttgtagtaaactttctgctaacagcggtataccccgggttttgaatagtatatccacaaatgcagagtgacatgttagtcaatgttctaaaatctacggggacgcctgcggattctaagatctaacgactattgtcaatgtacccattaataactccttacaactattgtagagtaatcaccatgaaggtgaattgcctcatgaagaggttcatcatgaagatgaaaacccagaattaaagtgcgcacatctatctaattctgggatgcggaacaaccatatatcttatgtttgggaaatgactaagatatggtttataatgaattaacctcacggaatgagtatgtggagaaaagaatagttatcgacaacatcgcctctatgattgctaatatttctctaatgagaatccggatccggaaccaaagtccatggcagagttgcatagtagcactcatattggttctattgaagaaagcaatgaggttgaaccatagtcgctaaataagtctatgtgaacatggaagttcatacttaataggaaatgaagtggtgaaaagcgacggttcatatggtcatggaaaagactgatattctcctactatgaatgtattaaattccgctatatatatcgctggcaaaaggtatgaattaataaatgatatgcagtttatgggttatgaaaatccatatgaagttttcactagaaagaaaacaatttcgcaacatatatgtaaatctcatactaattagtgtcatgaagcacactatattctcaagaagagaattgcaagactcgtagaagagtttatgatgactcatgaagagtttttctcctagaagtgagaatatttctcatagcagagaaaatgacttccggaagaataagttgatctctgtaggactatgctaatgtatgaattgccggttaatctccatataacaccaataactcgtactcccatgaagtggacagacccgtttaaacgaatgaattggtccactagcatgcaagtggatcggtagttttctacatactatgaaggtgtaagaatttatatatcatgaagatatactttttgatggtatttggcaatcttattaattcccctaatgccaaaatatagaccagtttatgtcactctaagtggtttaagctaattgttgaagattagtgaaacaatcaaactggtaatgattgataaatccactaagagaaagttgcataatatttaacctcttgtattgagctaattattttatacataccgcatatgtgtaacgttgcaacttattttcccatagtcctccgtaaggataaaactttgtttgtattgcacatttgactaagtggttatacatattgctcctatacgttgatttatttctcatgttcatagtaaaacttatgaaataagtaaatgaaagattaaacattgtggtaattttattatcattgttttacacattaataaaaatatggttatgacattggaacatgaaagtttcaacggatgtcttattgagggggagcatatatgctaaacatttattatcatacttaagacttggaagtcttatatttgatttaccaagaattaatcaaattaatctttgttttgataatttaccttgaaggttactaccgctatattgttgtgttaatccaagttgattaatacaataaagcatatagatcattggctatttatgaagaatgtatatcttaaagattatgcgatcaagaagatcgtgtgttgtactctttttcccttagtgagtttttacttgaatatttctcacgcaaggtttttaacgcggcaacaagtgcgatataactagcgtgtacgatgtactcttttctcctatccttttctcccactgggtttttggatggagtttttaatgagacatgtgtatagcgcggtattcgcccaaggtggagtgttataaaactattatctcctgccagagataaatatggactcataccaaatatatggaaacgtatcctaataggactcttcctattataggtatatatattgagagagatggcttgagaggttggttgatgtatccacatatgagaaagcaataaagctgtgatgcctctccctatatccgtgttcattattcatctactatatgattgtgtgtgtgagatcgtcgtcttctactccggatcagcgaataagccactagttattcaataattgcaaccctccagataagcagcggagttcagacagtgtggcaacgactaaccgtacattccatctatttttctagaacattcatcttataattactagaaaaatacctgtacgttgcaacggatgaagttattttaaattttttattgttattgtttggttaagatgaaattcactgtgttaaattcacttggatatatattttgttagaaaatcatgagttgtaattgggagtccaatcaaattaacatgtgaatttttaaagatatttctttacgattcttctgtatttgcaaaagcgaacgaacttaaaaatcgatttaaatataaatttgtattttcaaaaacgaacgaacttaaaaaatgactcatatacagatgacataccaaagtattagtaaaaacatcttcaatttttataataagtaaagatacagatatagatataaggtataagctatccttagaacacctttataataataaaattaaatcacaaaaaaagtaataattacttttttttctgaataagccacggagcatttcgaactttcagtacagacttgacaccatgcgccgagccaccacctaccgtagcgtgtacagtgtatatacaaaacccaggccgtagagccggtcgtcccatagaaatcaggcccacaggaacccagaacgcatctctcgccaaacacactattccaatgaaaagtttgagtatgattcactcgtgccagatttgtgcagaatctgcagcatgttccaactgcagagctgaaattagtttgtttgtactactctgaatgggtttttttttctttttttctctagacattgtttctttgcacggtgattgcaaacgcagtcctgtagccagtcatctgtcctccttgggatcttctgtgagtgttagcaatggcccatgattagaccacttaagtaggcccgtagtattttcagacaaagaagcaggcccgtaattaaggtaccacagcccgcatttgatttgaaagcagagtcctagtttcaaatttggaattctgaaagtttcaatggatctaccgtaaaattcaggtaggattccagcgattttcaatgtttttcgtgaacgcgcaagagattttcaatgtatcttctggaattcctttcttcgtagtaaattcgatcagctcaccttctcttgttctgtgtagtgcacacagagtatttgtcgctctcgtacgagtcaaatgagacgcaggtgtcgttgcaatgcaaccctccagataagccacggagcggagttcagataatgtgccaacgactaaccgtgcattctatctgtttttttatatcattcgccttatttcaaatataaacatatatgaataaaaaagtgtaagctatgcttagaacacctttaatggcaaaattaaatcacaataaagtaagtgttaattaagtcatttttctgaataagccacggagcatttcggaaataggactttccagttcaagcatggtttagttttcaactttttctcaaacttttaacttttccatcacatcaaaatcttcctacacacataaacttccaactttttaatcacatcgttccaatttcaattaattttcaattttagcgtgaaccaaacacaccctcagacttcacacctcactaacacaatgcgccgagccactacctaccgtagcgtgtacagtgtatatacgaaacacaggccgtagatcccgtcgtcccacaggaatcaggcccacagaaaccgagcacgatccatctctcgccaaacataaaaaaccaacacactatgaaaagtttgagtatgattcactcgtgccagattcgtgcagaatctgcagcatgttccaactgcagagctgaaattagtttgttaggagtagtactttgtttcatgtaaaccactaactcatagtagtacaaaacgttctcaaggacccctgaactcgaaattttcgtctatcgtatttcacaacttttttttttgaacgagtcgtatttcacaatttgcgcttcttgaattttgctggtttggaacttttttgagagaaagtaggagtagtagttttggtcaacagtgtttgtgatccaagtccactgcaagcttggaaaccagcagcagcacctggtatcatcggtggttggtgaaactcggtcttcttagaactaagcaagaacagctcactggaacaagctcgcccacttcaaccaagcacttagcagttaacactagtaagtcactaacacacgaccagcccatgttttatcacagaaaaaaacataattaacattaaattaacctcaaacacactgtttgctctgacaccactaatagtccaccaaatttataatcctcaagaaccaagaggaaagaaaaatagcaaaatgagcttatgtcaaatggttagtttttctgtgctgaaactagttcacattttagacttgatatatgtacggttaattattttcttagtggtaagcgatgtatttgtaaatatcgacagcaagacatctgtgttcacttcatcatatcctgactcaatctttcggggtgcccataagaatagggtttatgcatgtattcataggaattggtgtgcgctcattgtgagcatctgctttagggcaggtataatagcacatactacaagatgtaatatgcgtgtgacatgtaaaaccagatattactagtgtactattccctccgaattaataatacttcgttttggacaaaggcatgatctccaaaaacaactttgaccattattttccattacaatatatattaaagtgttaacaaatatatgattttattaaaatactttgtaaaactaatatatacatgtattctaaagtttgatatcacccttgtctaaaacgacaagtgttattagtccggagagaatacatgtttacaggtaattattgtataaattggctattaagatgattgtagataatttgaaacgggtaattggctttactattaaacttgttcttatatgtttatatataataaaacaagaaaaaaaattgtagtggaaacaagaggggaaagagggggaaaaaatcagtgtggtgtggcccactcacctaccgccaacctccccccaaatccgtagctttccggcgagtataaattggccgagctcgccaccgccgctttcaccaaccacccccccccc

SEQ ID NO: 81172 - DNA, 1922 bp, Oryza sativa
tgcctcaccatcttcaccattgccactcccattgtcatcaccatcatcacttacttacatctcatcaccctaaacattttccatattttcatcatcactttgaacatactcatctccgcttgaatcctcattctcactgacgggatcgggcgtgggctcacgacgaccaaggcgagtgcggggaggcatggctaaaaaacaaggagcaaaggatggataagcaaaaattttagaagccacatagtgaagtgggagaagggggagtgctgtctgtcaggggcagtcagaccgagagccaaggccggtcagaccgcaagccccaagtcggtcagaccgacgtccataggccggtcagaccggcggctcacggccggtcagaacgacggtcctcggccggtcagaccgccactgacagtagcacaaccgaatccttccacaatccacacaaatgattctaaaaaaattgctaggacaaagtcgcacaagattggaacatgaacatcaaggtgtaggtctatttcattaagattgaagcaatggggaaactatccttaaccctagaaattgaaatagaccgatttgagagaatgcacaagagggagagtgatttaccagttgaaggagttgaatcacaccaagaaactaccctctattggtgcaaatcgaagaacacctcttccttcacctagggttccatgccatggatcacaaattcaataaaaactcaaacaaatccatggaatagagagaggaagaggaggagattcacttatggtgtaacccgagtgattttgacggttgaaccggatggatttggtggagggaggtggctagggtttggtagaggagagaggaggagttttttcgacttggggatgaatggggatgagaaaagaaaaggtaggtgcgggatggaaaaaaaaagggtaaaaaccttgggcccaccagctcggccggtcagaccggccctctgcggccggtcagaccaccccggccacgccggttagaccggccctatatgggcggtcagaccgggcagcgccctgccggctgtgcacagcccttacacaagccggcaacccccacacaataaaattcaacaaaaatttgatttttggagcaattttgaaatgtgtgagttgaaatattgccaaccattcataatatttgaaatttatgaagatttgcaacaaaagtcacttgagtgctaggaggtgaccttttatggtctataggggtttttggacgaatttgattttcaaacaacttttgaaatatttgatttttgaatatgatttgaataaaaaaaacatttcaaatcctcctctctaccaactttgttttaaaacttttctcaaattccttctcaaactcattttggggtttaatctcattttggccaaaaacaagattctagtttcttcaaaagagggccaaaaggccattttcatccaaaatacatttttcttgcaataagaggcttggaaaacatatagggacccttttaaacattttccaagagatagttttcaaatttcattgattttgcaaaagttttgacttatgttgacttggacatttgaaaatactactagcaccactagttgatttgctcacatataaagggaggtagagcacatgcaaaattcccccttaatgtgacatgctccattttcgcaatgaagaaccaaatggcaataaatccaaagcataagagcaaataagaccaaatatacaatatgcaaaaagaagcaaccatggtgcaccatctcaagccacattagagaaatttatgacatttaactcattcctcaacttgcaaaagcgggtttcatcaagaggcttggtaaagatgtcggctagttggtcctcggttcttatgtggctaatgactatgtcacacttggcaacatggtctgtta

SEQ ID NO: 81173 - DNA, 1298 bp, Oryza sativa
ccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccatgaatagaatacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcagagataacggccttccgaaccttcggcgacggccgcgaaccacgcttcgggaacctccggaacgacgaaagctacgcgaagcacacaagcaaagctacaagcctataaaaaagcaataccaatacataaaaagaaagcacagagttctttaggttataacaaacattaagagacttgaacgggtcgattcggagttcgtatgaccaagatatgatcatccgaagtttaatgatgttatatggagatttacgggttattataattaggctttgcaactataaaacatgtggaagcgctagcctggaaaagacaggaaggctgcgctgttgacatgcggaccccacatgacaacctaaaggaccgcggtagaccgagtacacagagacggtccacgggtcgacgaaagcggaccccgtgtgtcaaccaaggcgagtggccgacaaacggagtccactagacaccacacgggctgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacaaggacggggcagt

SEQ ID NO: 81174 - DNA, 640 bp, Oryza sativa
tttttaggtttttctttttaataaactttgttaattgtttttgttgcttaataattatttccggtgctctgaaaattcaagtaaaatttgagggctccatttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaccctatacctcgatcaattctaaattaaagcgctagttttaccttcttctttccctttgcttttgcgccgtcaattttaatccatcgataatcatccatgcgcacatatgacgtggacctaacttaaaatgtatagctcaaagacaacggttagtccaaaattagcgcttgtcattaattaccaaaattaacaccgggggcctagatgcttcaatctccccctttttggtaattggtgacaaacactacaaatatatataatcaaacatagagcacatggacatatattgcattgacaagcaaaagcttccccttaaacatatgcataacaatcacaaatagcaaatatggagccaatgcacgattcaatttcacaaatca

SEQ ID NO: 81175 - DNA, 1168 bp, Oryza sativa
acgattcaatttcacaaatcaacatagcacaacacatagacaaattataatgtgaacttcacatatgaatcaaccgaatgcataagatggtcacaagtatatcaatgtcataccgaccatccatcatagcacaagttcacattaagaccacataaaagggctcataaataaatataggctattacaagaccacgaagggtccaaatgacatagagatcaacaaaacgaaaaagaacacacaatatagagtaatagcccatacccatacataatatagcccaaacctccttaacctattagatatcaggtgactaacctcactaccactagtcccaacccacaagacatagaaacacacttttctcccccttttggcatcaagtactaaaaagatcttcattcttgtggtggagaaggaggacgcgccgaagtggaaggatgatgagcatcacgacgacgatgatacacaaatgcttgggtactctccaaagtttggactcgagaatccaagacacccaccgtagtatgcaatcttcccaccgaagtattcaagttgccaacatcggtgcgcaagccacgaacatcctcatgcaaagcttcatacccggtagacaagcgttgaatgctttcacttagggtattaatagccccaagtaccgggttgaagtacttattgggttgcattccaaaataagcatattgtggatggaaaaaagcacttggatcatacccatgaggaggaggaggaggggctgcacttgagcttgcaccttgatcaaaagttggttggtgcacaagaggagctctaggagtggagagttggagacgaggcttgtactccttatgttcttttaaattgtgaccaatttgtcccaacttgctttgtcaacctcattatgtagggagcataatagattccttatctaatagttgcctttgagatggcaatctccttcatcataaggttgataacatcaaaccgacgaccatccaaaattgcatcaatgacatgccaagcaactccgcgtatgtcatcattgttgccgcatcttgggaggatggtggcccttactatgcggttgatcacacttgggagagccctcaaacccgccacctttccatatgtgtgccttcccccttcttcataaaactgagaaaagtgatcaat

SEQ ID NO: 81176 - DNA, 2716 bp, Oryza sativa
tggtctttgctccatcaagcttgcatctttaaaataatcatcaaactcatgctccatttgtgaccatgtagaaattgaactaggaggaagtaaactaaaccatgttgatgcaaagtttgacaaagaaagatgaaacaattttaacttaagtaaatcatcactactggccttaccacatttgttcaataaattggccgatatgctcaattgttgttctagtatcttcacctgtgaatttcgtgaagttgagcacctcaaatccttgcgggtatgggacataatctacgtattcaggatatggcctttgatatgtatgcatagctactttggattctacactgctaccctgcaagacattgtcactatctattccaacacccacatggccgatctataattcggtcttaggtaacaatactaatttacttttgcttgtgacacaatccgaactgtcatatagttcggctatattttcaatggtgctattgtctaagctagcaacacaatccggaccaacacttagttcagctatattagttattgcattgttgcatgaattattagcacaatccgaaccgtcgtttggtttggctatacatgttattgcgttatcatctaaactagcatttaagctattgtcatccactcggctttcctgagccagagcttcatgcaacacatgatcaacatcaaaaaatatctggccattcaatttctctttaatagaatcaagcaatacattatatgcaatgtcggccaaatccttttcagttgtattcaaactaaaacatcgacttttagcatctctaaacctctcaatataatcagtgacagattcattgtacttttgcctaatcgatgttaaatcagacaacctaaactcagtttcactagtgtaaaaataatcgtggaatttttgttctaattgagctcaagtatgaatagaatttgccgacaaagaagtaaaccatgtaaaagcaataccggacaaagaataagaaaacaagcgcaatttaaatgcatccgaattgctagcctcaccacattgcgccaagaattgacctatatgctcccatgtagtcctactatcctcatcattaaacttagtaaattcgggaactatatagccacaaggatatgggacattatcataataatcaggatacggcttttggtaaaccctagcacgattccttaccttgataccaaaattttccctaataatagtcctagtccgatcctccatagtttcaggccttggtggatttggtggcctaaaaagtggttgttgtggcacaatattattatattggccatatccaatgtcatgaggatatcctctattaggatcattataagcattagggatatgtgtagtagcatgacctacagtattaacaggtgatgaataataattaaaatcagcactgctagtggtggtataaaaacctgtagaaatttcaagggaactggtctgaccaggtattgcccagctatagatagcctggtctgaccggctaagcccccgatctgaccggcccatggcccgatataaccgatggttagtggtcggtcacacaggccacagtaggcccgatctagccaagatagggcacggtctgaccagctatggtgggcacggtctgaccggcatagtacacggtctgaccggccatggtagtcacagtctgactggcatagggcgcgtttagaccggtgtcatgaccggtcataccgtcagttaggttctgcatatagccgattcatgtgtaatcggctgtataaacacttgttgacccctccatagcattataagcatattatatagaagcaaaactaggagtagcagatgcatctacacaacgatcattaactttttgaatagcaagggatgggttaggcgaatcggagattacctttggtgaaactacgacctgagttgacgaagatattcctcgattaattctagccatataactcatagccaaaaccttgatatatttgacttgtgtacttagcaaaatcccaaaaatcaagagatcagtagccttggtcggccgatctcctgtgcagtaagcaaaatatttctcaaaaattaattagccgatgcaagctagacaaacagcattggtaagaaatttttattgatatacgtgcgcagtagtagatgggctttgatggatcggtctaatgcacgaacgttcgctggcagcgaacagccaacaaaaaagagaaacggagtgtcatagccctatcttttaggacgaggtatttaggattacttatttctgttaatatgttgcataattattatttttgcattagcttctacattcaattaaattttggagcaaattatacccctaattggcaaaacaaagcatcatctatgtgtgcattaagttgaacattagggaataactttcataatttattcaaatactagattgtttatcatgagttaacaaattttttctagaatttttacagtcagttctgaccttattaaaattcattgtagttctcagcataccccttttcacctttttgccagaattaaaatatttcgaatttttaagtgaaactttgaaaaatggaaactaggtaactcaatctatctccgcactagaacatatatttttgacactcttgtagctaggtcaaactagttacccaaggagagagagaaaattcttgaaaatccactattttcaat

SEQ ID NO: 81177 - DNA, 3673 bp, Oryza sativa
gtgtgtggtgatacattatgacttattgttaagtatggcaataagagattgattatgatggaattatgaagatgttaataatgaaacttaaaacttgtctttgttaattgaagcatcaactcctttacaaaagaattgcgaaataaaacttgctttatgctgaaattaaactacatattgccttcctttgaatatatgccttacatgtagtatggtacgattgacttgtgcttgccagtacattaacttgtttaatgtactgactcttgctcttgatataaccttttgtttgcaggttagacttagtctttgagtgatgcgggttccgattgcttcttttaggatgagaacttaatgggggtaaacccctagtcggtgtgcttgtgattgggtagtcaagcttccgctgttctctaataagtctatttggccggtcggcctatgtaattattaagttgttgtaagtcttaagtttctttcatcttagttgtgtttgctatgtataatcatgcttaagatgaaagtgtgaatctagtgcatatcctgggaactagatttacatgagtatgagttaggaatatttgagaggttgtagatctttagccatttttgtcaagtctcctgaatgtgtaacacatctggtcgccgccttctagtggtttgacgggcacatatcaggctgaagttgactggcaggctaagggctcagcaatgtctccaatatttctctctcgaggcgtcggatgtttcattatgcttgtttgatgacttgaattatttacttcatctctcaaatataatggaaggtccggagagtctacgacagcatggtatcagagcaagtaccgactatatggagccccttaagttggtcgcttagaattgcttcttaaaaaaaaattattttgagggctttgctctcaaatacaaattatttgcgaaaatcatattcaatcttatatctcatccctctatagagattgttttactttatgtctcatgttttgattttaaaactcgtatcttgctctataggaccgaaaccttttgaaaatgttacttctgtaaaaatgtaaataaaactacttataggtcatcataaagcagtaacaaagtgttttgaaaagtttcgaaatccatttgcaaactactcctatgtactagcacggatttgtaaaatatcgggttaaacatagcccctagtgaatgggttttgaaaatgagtctataaaatttaaaacttgctagataatatagagattctatctccttatgttatctctgaacaaaaaaaaatgaatttggtgggatttttcactttcctctcccgatatttcaaaattttaccggtatggcctaaaacatgtagttggtatagaatagaatttgctgtgcttaaccctctagattgtttgcttagatggaccacccaaaattcatctatcctctggaccaccctaacataatgtgactaaaagatgataacatttatacaacctaaaacttgattaaagtttcattttgtgccgattgttcttttctggaatcttgagtcagtctgcttgttaattttgtctagactaaaccgtaggtgataaacctgagaatttttacatgcatcatgtagactaacccagtaagcttcatgaattttggcataatttttagacccctgcatcatagtgaaacaatctagatacttagcataatcatattctggaaatttgtagtagctgcattcatcttttcatgtagcccaaaacataattgataaaatatgcatctttttacagtagttttcatacataacctgtaggctccacgaattttggttgaatttttgagtcattgcgtcatggcataaaagttcatataatactgtatagttctgtcctgaaatctgtagattgtcagtttcacaaatttgtgtagcctaaactataaatgataaaatcatgattcctttagggtagctcctaatctaacccatctatctctctgatttttgtcaaaatttttgtatctttagagctagacctaaaaatttgattaagacagtaaagtgatgaatcccagcacctagcactcatgtcggattaacccctatcctttgaagattattagaaaaccctagtgcaaaaatttattttattttaagggggatagtaagccatatttgtatcaaaaccaaagataaaatttttaaccttgcataattcttcttagacctaaaatagaaatcccattctaagtaagccctgtaccgttaatatgaccaaaattaatgattagaggtctatataaccataggttgttaaaaaaaatgtgtgtcgaccttaataataacagtaagggaaaccttaaatttgtaagtgcttaattttaagaggttctggctgatccttgttcttcattttattcttatagatgcctaccatgtacacaccgtactgctattgccgtgggttcacctggaactcaactcagcatgtgctatggcttatgcttcagtacgcccggttcacctatccacctgagtatcatatcctcaagaaacccattggaacatcccaaaccgcagtcatggttcgtgtaagcattcggggtagaactccactagagaaagaccttcaatatactggttatgggtgggatattaagtccgctttgcaaaactgtgcttatgttgctatcatccgccttcctatgagctacctgagttagaagaattttagtgctacatcccatccttaactgagggagctcaacacactacttacccagggttagctgaaataggtgtaggactacataccccatacctccaacttgcaaactttgtgcgctcactagatatgcgttatcgctcaaccttagctgagctgcaacgcgtccgcaccaaggtagccactttagaaagaagcattatgccaaggtatcgccagggacattatacaccggagttcatgtttggtgaggatgccatgcttgcaccagcacaagatataccaccacctgttggaatgtatattgaaagaagcccaccttcgcgcgtcgatgtcaggactgcttatcctccacttggaaccactggactgtatggactgccagagtatgttcaatggtatggtcgagtcttcaagctgaggatgagagactaagcaatagtcctatataacctctactgtcacggtagtatgacttaaggacaagcttaaggaatacgctaggtatatggtggcccattttggaagaaaatcatggtatgtaatatatgtaaacgagggcggcgctcaccgcgtggggggtcacggccaagtagagtagcggcggctcctctggcctcggggccaccaggatcggaggggaggtgaggtaggccttcaactggttgagggctcactcggcctcctccgtccacacgaacggccctgagcgcttgaggagcttgaatagggatagcgccctctctcccagtctcgatataaatcgacttagggcggccatgcatccggtgacacactgcacatccctaagcttattttctcgggattagcttctatgcctcgagacaagaccataaaaccgaggagattgcccgccggcacaccgaacacacacttttcggggttcagtttcaagcacgtggacctaaggctgtcgaaagcctcag

SEQ ID NO: 81178 - DNA, 633 bp, Oryza sativa
gtatcagagccaccttgtatagtttatgatctagatcattgcatataattgatatgcgggtgtagtagatgagatctattatgttgtatatgagttcttaggtgatcggaacatgagatgaaccgatagccgcatgggttgatgagatcaatcggtatgtgtgttggtgacttcactagaatgtctagtactcaccaaggccgagtgcaattgtgtttatcggatagtccgatgtccactagaaccgcacgccaatgagaaaaacgagccaatgagattgactcggtttcggcataatttgattacgccgttaaggttttcacatggcgaatcgtagatgagatctatgtaccccgtgacctttattgctgttgtatatttgatatgacatggtaggatagatcccctcagaaaaattaagtgtaatttatgctcttccaataattgcacctattacggttgtgatcataagtgatgggtttgccatagcaaagtgtcactttttatcatgataaaataggatagatgtcggacatctatatgcggagattattggtttacttgacaaggttatcaaaacggttttggatcttggggcataggttgggttggacatggagatgtcaccctaac

SEQ ID NO: 81179 - DNA, 691 bp, Oryza sativa
tgtagccttcctcatgatgtggcttgaaaagttcttgttttgtggtccgagctgtggtcctactgcgaattggcaacatatagctgagaacttggtagaaaagaaacaattcccccatggaaaatacttgctgggctacctgtaccaaaccctgaacagtgcaataaccaagatggcctctcgattatcaatcggcacaggaggtccttggtggctgcttcagatctggttaatcctgcacactatcatggttgccgatcagccactgttaaccaatgcaagatttccaaggtttgagccgatcatcggtgaagatggagaaaacatcaccacatgccgatgcatgtcttttggagaagcaacatctgtaaataccgcatccaagctattggctgagcccttcagagaatggttcaataatttttatgatggatttcccaggaacactagaatctggtttcctatgaaggacatggcacctttgaactaccgggtgatttttgtttcgaggagattaattcagaaaaatatgagaaatccagagaagtgtattcaagagcctccagcccttgcatcctcgctgtcggcatccaccaaggcaagaatatccaaatgacttatgaattctatcatccgacaagtgttgcaaggcaactcggcatgggtatacagccgatcagcttgttctttg

SEQ ID NO: 81180 - DNA, 1756 bp, Oryza sativa
cattacccctcttaatagtacggcgaaactaaaaataactagcaaatttgatcgccctacaccccgatcaattctaaattaaagcgctagttttaccgtcttctttccctttacttttgcgccgtcaattttaatccatcgataatcatccatgtgcacatatgaagtggacctaacttaaaatgtatagctcaaagacaacggttagtccacaattagcgcttgttattaattaccaaaattaacaccgggggcctagatgcttcagctagcagtagaaaatgaatttgataaatatgatttttctaatgcgcaaatgattaaggctgctagtaataagtttacctcttctacattattttggtggatttatgttagtaacaaacctgaaacttgggatgaattcaaaaccatgatgagaaaacttgtgagttcttatttcaaatgtactattcgtgagaaattagaacatctgaaataaggagatagaactgttagggagtacatccatgaatttaaagtttgtatcatctatagtgatctaaaagagtgcgatgaaaacaaaatgcacagatttttcaaggggcttaattttcatattcaggttgtgcttgctaatgtgatatataatcatattggacatctattcatgtttgctcatagcattgagagtgaaatcaaatgcaagaaagcatgaacaatgtgatttatctcatgtttctgaatcccctatatctttgtgcaatgatgatatgcaaacattggaggagcaatgtcttgtgcctcctgttactaacattttacaggaggttcagaacattaaacaaaaggagggagaataatgaacatgtgaaaaaagaggagaagcatgaagcacctataatatttgaagaaagtttgcaaggtaaattcaatggtgctgagataattgaaggtgagtatactccaggtgtgctacagatgtccacttttcatgctatagtagagcaaccattagtggaaccaattgctgagatgcctttgtcattagttaatttacttgctgttccttgtgataaagaagggttgtgtgataatgcttcttcacttatatccatgccacaactagtgaatgaacatgttatttctagtgtttctttgtgtgttgattttaagcatgttgtttagattgctaatgaagtagatgaacgtggattgttatcttctttaattactttgggctatgttcggtttgatgttttttgttagctcaaaaatttgaaggagaaattatttgctaaatctaatttgccatgtccaactaatgctatttttcatatctttggtgaatataatgatgttagaatatatttggtgcatagagtttacatatgttcggatttaaaacctcatgtacataaggataaaacctacaagctacataggaatattattgctaaccaaattatctcgagtttgccttcttttgattggaagaaacaagttgttttaaatggactacgcgaagagcaccatatggaaaaaccaaggacggtttttcatgaaggagaggatgatgtgaccatggctactatggatacaaccgtttctcacatcatggatgaacaagaagatatcaagatcaagtcctccatgtgctggaatccaattcggccacgtgctacactgctgacttcaaacggccgccaaatatgcatacgagctccgttttgggtccacgagtacttgatggaaagctctcggagtcgtctttcca

SEQ ID NO: 81181 - DNA, 3024 bp, Oryza sativa
catgcatacacacgtatgacatggttcaacttgagtcttctttgtgcatttggatttttggttggcattgcatattaggacccatgagcataaataaaagataaagattcactaagcaaacctataaccacacttgagcaataattataaagagttggcccactatgttgaaagtctgtgttgagcaaataaagaagtgcgaaagttgccagcgtcatggccgaagccaagccgcgccccagtatgatctgcaggccattgcgccaatatggcccttcgccagatggggactggacatcatcggcccgttcccggtggcacgaaacgggtataaattcgcaattgtagctgtggaatacttctctcgatggattgaagccgaaccccttgcagcaatcacttcggcagcagtacaaaagtttgtatggaaaaacattgtttgccgtttcggagtgccaaaagagttcattactgacaacggcaagcagtttgactctgataagttcagagaaatgtgcaaagggcttaacctggaaatcaggttcgcgtcggtcgcacacccgcagtcaaatggggcggccgaacgtacaaatggcaagatcctaaaagcactaaagaaaagactcgagggggcagcgaaaggcaaatggctagaggaattgctattggttctctgggccctttggacgacccccacaagaccaaccaagtttagtccgtttatgcttctttatggtgatgaggcaatgaccccagtagagctaggggctaactcaccaagggtaatgttctctgggggcgaagagggacgtgaagtatcactcgaactcttggaaggagtaagagtcgaggcgctttagcacatgcacaagtacgccacaagcacttcagcaacttagaacaaaaagagaaacccccaaaaaggcggtgctgtcgtcatcgactcggcggggatccggccctttcgccgaagcagggtttggcttgcgaggggccatggcgaacggtacgtttgcaatggcgaagaaagagaatgggtgaaacgcttgaggggacaagagatgctgtggaagaaagaaacggaggaagagaccgcacgcggtaaaatggcaagtgtggcggtgaaaaggaaagagcggcgggaatttatagctcacccgggcgaccgttcgactacccaccagtaataaagcaccacgtgtcgcaagggtaggcgaaacggtaaattcccaccgtccgagcggcacagtaaaaagcccatgaagggaaagcccaatactgttccgttcggcccgggaaaagaaaacatataaccaccaatcgcaggaggcgaagcgcggcaaaataataccagccgcacaagtaacaaacttcatttgcaggaataatgtaggtttcggcaggagcatcggtcgaaagaggggcgccgcataccataccacatggtttgcacggttttggccgaagctccaatctcccttgcccgtgaggggcttgttgccgaatggcatgaggcccttcgaccaagtctgccgaaacccatggcaaaggctatggagcaagaacggcgtgagacgaagagtcgtacgagtgccttgccgggccagaggcgtctcaggcgaagggtgcaaggcgaagactatccgccgaaggaagacgacttcgccatgacaagttcgcccgcgagggccgaagaagcctttccggcccatcaagcttagggactatagggccggcgatcgcctgacggcccatcaggggcccatgagcccctacaacattatgtacccctgtaaatgtccctttcataagggtaatcatgtaaattcccctgtacaacctaaaccctagtagtaagatcctgtaatggggctataaatagtcccctagggccatgtaatggggggatccccgaaaaaaggaattcaaaattcaatacatttcgtttccttccaaccactgttgagtaaccatgtccttcgacgtatgcggttgtcatttcgacaacacttataatccatctctttcaccggtaacgatttcgctgtctaaaagaaataacggtaatgatttctcctttacctccttctatttttttatctaaacaaattaagacatatttctcatttaacctgggttttcaaataattaattaaattaagactccctccaataactcgctattgattcagttgtccctgatgatccccgtaccgaatctcctaaataacccactactgattcggctatccctgatactccccgtactgaaccatctaaatctgttggcatctcctggaccgaactaacaacgccctgctcggtcctttgcatgctcgagccagctgctaacaatgcatatatctgaccactactaccgttaccgcacagatcaattccaccatgaaaacaatgcacggactctactagatctactctaaccgaaccacatcctgacacattgacatgtctattctaccatgtctgaccgtagcataagaaacgtgcatgccatccgacacaaacccaattgatacacaaaactaacaccatcgctagagtcacacacattatgcaccatggtacctccaccactagataaaccggcttgcatagattttgtcgaggagtaatcctctctagcgggtggtcgtgagggccccctttgtaagttcggccgggggaaatggcgcaatgatcaagggcctacttccgcttgcagtctaattgccagatcactctcgtggctgagtgggagatcggggattatacaggttcgggctgctgtcgagcgtaataccctactcctgtgtgtgggattatggtgaattattacaagaggtatcgagctctaagggaaacctagctgttcttcctccgagctcaagttctctgagagtcgtccccgttctcggtggacgaggtccaccttttatagttcagggggataccacatgcaccgtttgcacctaccccttcatgggaggagggggccacttgggcccaatcatacccgtatccttt

SEQ ID NO: 81182 - DNA, 1052 bp, Oryza sativa
cattatgcaccatggtacctccaccactagataaaccggcttgcatagattttgtcgaggagtaatcctctctagcgggtggtcgtgagggccccctttgtaagttcggccgggggaaatggcgcaatgatcaagggcctacttccgcttgcagtctaattgccagatcactctcgtggctgagtgggagatcggggattatacaggttcgggctgctgtcgagcgtaataccctactcctgtgtgtgggattatggtgaattattacaagaggtttcgagctctaagggaaacctagctgttcttcctccgagctcaagttctctgagagtcgtccccgttctcggtggacgaggtccaccttttatagttcagggggataccacatgcaccgtttgcacctacccctccatgggaggaggggcccacttggccctaatcataccgctatcctttgcttcaaccggaagcaacatggtcatttggctacaagtggggcccagcgacgccctccgcctgacacgggggacgcccctgtcattcaatcataaatgcgtgaagacttcggcagttcaccacgcgcggcaggtgctcctgggaccatgttgatgggacggggcatacctacccccactccggctgacacaaagcgagacgtgggggcgctgccacccgtcccatcgcctgcgaccagtcacagactggtcatgcctgattgacgggggtcaatcaagcggcgccacacgcccgcccacgccgcattaaatgcggtgcgggacggttgggggcgcacgcattgaaagcgcggagcggtgtcccttgctccgcctcctccccccgccacgtggtggccgggcgagggcctcggggtggcgcgtgctgagggcccgagggtcgtgacgtggtaccccaaggccccctggccgtgttagcactacgtggccgtttcccccgagggggcgggggaaatccaggccactcagccacatggccatacgggaaaacggtttccctctactgtgcatacccctgggcccatatcactgacagta

SEQ ID NO: 81183 - DNA, 1401 bp, Oryza sativa
agctgggacccagggttgggttgccagttcggtctgaatcatcgtaggccttgggttaaggcaggttcgtgagggttcacggccttgattgataatattgtatagctctaggatcgtctttacaaaatagctttgggcaactaagtgacttttaaatgctgtttactgcaaaacttaacccctatattattaaccccttgtacccccttgcattaatcatgcatctgccggtgtgacttgctgagtattgtggttgtactcattcttgctcaatctttcccctcttcagtaagagaggctttggagaagatgtcttaggtggagtcctggcttataccccagttgagcgcctgtgaagatggagccctaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaatgcaaatttcctcggtcgcgacatagggcgatcaaatttgctagtttatttttagtttcgccgtactattaagaggggtaatgacctagcaaagagatgattttaattgccacattaagtcattatgtatttagacttgggctcacacttcacacacacacacacacttcactcggttcggcctgaccaggggcggtcagaccggccacatagtggcggtctgaccggcgtgccctggtcggtctgaccggccacaagaaggcggtctgaccggcgcataaggccggtctgaccggcggcacatgcgcggtcagatcggcctccttgagatcgggatggtgctgctctggatggccgatacagagccgacggagccgtattcggtcagaccgagtcgatggcagtctgaccgagccgaggtcggtctgaccggccaccccatgtcggtctgaccagccaggccgatggggccctctgactgggctacaacggctagttttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaatttgcacacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttagtcttggagtttgccgcctcctagacggcttgtggaggagttgcct

SEQ ID NO: 81184 - DNA, 742 bp, Oryza sativa
tttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaatttgcacacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttagtcttggaggttgccgcctcctagacggcttgtggaggagttgcccggtgacctctctgagaagattgtggaggaggcccgacgccggtttgtgagtggtttgaaagttcactaccttcggagtgaaggaagaactaccccgagtaattgaggcttgggtagtcctctccgtgggctggctcccaccttgcccaccccttgacgaagggggcgtgcggtggcttcgtggttgagcggtggagttgggcttgcctcaacggagagtaggaaaccggcgagtttccgaacctcggtgaaaaatctcttgtctcattgtctcatttgattgtcgcatttacatttgtgcaatttactttcctagagatataattgagccactatcaccctaggcttgcaaaacatatcttagttgctgtca

SEQ ID NO: 81185 - DNA, 728 bp, Oryza sativa
ataaacaagcataaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattattgcgtcagcggctagggtttgcggtggaccgggtgcacggcagcggttcacgggaatgaacggccgagatcgatccatccaaaacggacggccgagatcaatcgggtctacggcggctcacggcaaacggccccgatgacgtcagcggcgacgtcacctccggcggcggctcggcggctcggacggcgcacgctcgccggcgaatgatgatgcttcggcacgaacgaaaggcaccaggacgtagagcgcgacgcggcgaactcaccggtgaccaaaacggcggcggaagatcaacggacggcgacggcgacgaggtcgaagcggcggagaagatcgggtcgacggcggcgacggtgctccggcggtcgtcggcgatgacgaaggggcggacaaggacgacgacgacttggcgaccacgatggcgacctccccgagcgacggtgacggctggagcgagggcgaagcacggctggagcgacggcgacgacggcggcgctaggtcacacggcgctagagctctt

SEQ ID NO: 81186 - DNA, 5991 bp, Oryza sativa
atccgattcgaactcggatccataattttccaaagcgatttagccgatgattcctaaatagaaaaggtagagaagatctcaaagattgtttcccctcaattcatttctccgcagaaggaaagacgcggccgaatttgaaagaatacgacggcggcccggcgctagggtttcggccggcggtggccggaggtaaacgatgagtccgacaagtgggacccacctgtcagcgacagcgcgctcgcgcggctgcgggctggactgggccgacttgggccggggaaagagagagagacagagggttttgggcccactttcggcccaaagcccaaagagacttttaaaaacctttttcaatttaaattattcatgaaatgcaattccatttattaaaaatacttccttagctcaaataaatcccagaaaaatctaggaattatataattaagcaaagtatttaatgaaattttatctggccccattttatattggaatttattaattaaaattagatcttctcttctagacttttaaaataaattctaataattccaattaaacaacaatttatatatttaggatttttagggtgtgacactcatctttttgtctcttcaatccatcatgctcccttgctgacatcctataaggtgctttagcaactggcttggttcctggtttcaactcaatactaaactctacttctctatccggtggcatacctagcaagtcatcagggaacacttctagatactcattgactattgggacaactccttttgcaattgccacattcacaaccctctttttaaactcattcatcttagaattacttttgtactcaacgttttgtccatctgcaccaactatctccacaaccttcttagcacaatctagtttgcctctatatttagacaatcaatccattccaaggattatgtctaacccgctcatatttaatagaagcaagtccactaagaatgacattcctatttacaaccttactcccaaacaaatagaggaaactaatgacttagttcccggtgcataaatcacccgtggcacttctaaagtggataaaggtaaatgacttttcaaaataaaactttcggaaacaaatgaatgggtggctcttggatcaaacaacaagaaggcaagctctaaattaacctggaacttaccaattatgacatcagttgcttcttcggcctcctatatgttgacgtggttaacacgatcacgtggggcaccttagttgatttgccttccaggctgtcctccatgagcctagaatcctccacggttctggaaacctccacgaactggtactccaccatgattttgctgggctggttgtggtgctctcaccactctgactcgtcctgttgcttgagcttttgctgcttctgatggaagatttttccatggacaattgggtctagtgtggccgatctgatcacagttgtagcacacaacattattacggggacaatattacttcagatggttacctccaaaaatgtaacatggaggctgaacttggcgtggaaatgctcgtggtggtggtggatgttgatccctataagtctaaacagacatttttgtcaacatcctgccttgggtaaccctttggactaccccaccctgttgcttctgatacctcttgcgagactcctctaagttggtacgggtctcttccttctgaatggcatcatcaacaagctcatgaagtgttgcaaatttgaaaccagacaggtggaacttcagagagtcttgcatgccattgaagaaagcttcaaccttcttagtctcagtgttaacatcatctagagcatacctggagagataggtgaattgctgcatatagtctgccacacacattcctttgcttcaaattaagaaattccattcgcttttgtgccattatcccgattggaatgtgtgctttatggaactgctaaacaaattccgccatgtaatggtattcatagttgctcctccaagtagatgcactatcagtgagctgatgagatgcatacaactccttctcacgatcattgcattgcaccgtgttcaacttcctctcaacatcacagatctagtcatcagccttcaaaggttcggttgctccagcaaacactggtggcttggtcttcaggaaatctgaccatttattacctagtgcagatccatttgatgatgatgcttctagagtacgattactcatcaactgagttgcaatagcctcaagaaacttcaactgattcattgcattaacactttgatttctctcaagggccgcaaggactcgagccaaactaggctcttctccaccattgccattactttctaacatgctgaccactgtcctaattagtcaaatctgcagcgatttaaatagagatagataagaataagcaagaatagagtaagttaagacagaatagaataaagacaaaagagaaaagaatggatagaaatgcaattttcgtaaccatgatgcataaatctacctaccacaacaaaatactttttaaaagcgaaaccaaattaacaagatgtagctacaaatcctagtggatttggcatacagcttgcataaaacatgccaatcaacacgtctactaaggttcaaagtctaattcttacgtgagaacaaggcaagagacaagaaattttgaatttagaaacgatgataagacaaaaaatatttagaaaataaaatatattttagctagtattgctaagacagagggggtaagaaagcactaaagaaggtatggaaggacgaaaagtaattaaacttaaggtttttcaatatatttttatatttaaaaatagctttttatcaaaaatcgactctaaaccatctaggtcaacctactgtcaagctaggctctgataccaagtctgtggggatacccagtttgagtacggtatctcgaaaccacccgcgaccgtccaggatttcaatcgcgcacagattgataaacagaacagtttttgacatatataccccaagtttttacataaattattacataaaagttaactaagacaggttttaggggccgactagctaaacactccttacaaacaaaagacccatacacaaaataggataaaaaacaccacaggcaatgcctgagagcagatcgacctagaacatgaactcgtcagcaccgtagaattcttccccttcatgcgccttctcagggaaggactgatcgtctgaaccacattttatgcaagaggtgagtaccgaggtacccagcaagacacatccataataatacaaatagaatgtatgcaaggcgtacaaggaatatagttcatcaaggaggtttcataacaagtcgattataaatagtttttccctacttcatcaaacatttcattcgcaaacaattgtaaatcatcattttaaaatggtatcaatattaatcaccattcatcctcatcttcaacatattacatattttaatttaaaatctactcataccatgataaataggaatcactcaatcacatagcttcttaaccggaagcgcggcaacattcgaatgatttaatgcaggggctacatttgccaggctagtgtacagggtcttgggatcacaattggggccaaacgtcgaagcctatgttgatgacattgtcataaaaagtcgcaaggccttcgaccacgcatcagacttgcaagagacttttgacaacctccgcgcaaccagcatgaagctaaatccagagaaatgtgtgtttggcgttcgtgctggtaagtagttgggattccttgtgtccgaacgggggatcaaagcaaacctcgaaaaaatcgatgccattcagcaaatgaagccaccatcgagcgttcggcaagtacaaaagctcgaggggcgaattgcggcacttagtcgattcttgtcaaaggcggccgaaaggggcttgccattcttcaagacccttcgaggggcaggaaagttcagttggatgccaaagtgccaagcagccttcgatgagcttaagcggtatctccaaagcccacaagctctggttagcccattggcagggattgaactgtggctctatctagcagcttcgcccgtggctgtcagcatagctttggtgcaagaaaccaaagcaggccagaaactagtatacttcgtctccgaagctctccagggggcgaaagttagatacattgaaatggaaaaacttgcttacgccctagtaatggcttcaacaaagctcaaacactacttccaagcccacagaatcatggtaccttcgcagtatcctttggacgaagtgcttcgaggaaaagaaatcacggggtgcctaagtaaatgggccgctgagctatcacctttcgacctacactttgtcgctctcactgcaatcaagtccctagtcctcactgatttcgtggccgaatggacacgcacgtccgtcccagagcccgagccagtcgaacagccatgggtcattcaatctgacggctcgtggtctcacaagtgggcgggcatcgcttcaatcctgacttcaccagggggtgtaccaattcgttacgcagcaagactgcagttcgacacaaccaacaacgcagcagaatatgaagcagtgttaatgggcctgaggaaagcgaaagctttgggcgttcggcgtttcctagtccggacggacccaaagcttgtcgccagccaggttgacaaatcctttaaagcgaaattagaaggaacgagaaaatatctagaagccgtttagtatatgggtaaatgtttcgccggcataacggtcgaacacttgccctgaggccagaatgaagaggctgatgcgctagcgaaatcagctgcttgtggagggccgcattcgccaataatctttttcaaagtcctgtatacaccaagtgtgccagcagatagccaagacatcatggcaattgaccaagtctagttgggcgaagacccaaatgactggcgaacgcctttcgtcaagcaccttaaagagggatggctgctagatgaagaatctatggcgaaacagttgcaactcagagctatgaattacaagctaatctccaggcaattgtatcgaaccggaatactgcagcccatgcttcgttgtgtctctttctccgaaggtgaggagatggtgaaggaaatacactaggggatatgcgaagcgcaccaggcagcaaggaccgtcgcatcaaaagtattttgctaaggcatatattggccaaccgtacttaaagtacgtgttgaacatgtcaaaaaatgtgaaagctgtcagcgacacggccgaagtcaaacagcaccacagtacgaactacagctaatcgcaccaatctagccagtcgcaagatggggcttagacatcaacggcccattcctagtggcgcggaacaattacaagttcgccattgaagccattgagtacttctctcgctgggttgaagccgaaccacttggcacaataactgcagctgcggttcagaagtttgtatggaaaaacattgtttgccgattcggggtaccgaaggagttcatcactgacaatggcaagcagttcgattctggaaagttcaaggaaatgtgcgaggggctaaacctgcaaatcagattcgcttcggtcgcacacccgcagttgaacggggcggccgaatgagcgaatggaaagatcctcgaggctctaaagaagagactggaggtggcggcgaagggaaaatggccagatgaaatgctatccattctctgagcccttcggacgacccccacaaggccaacaaagttcagccctttcatgctcctctgtggagatgaggcgatgatgccggcagaactaggggctaactcaccaagggtgatgttctccgggggcgaagatgggcgtgaagtatcgcttgaactcctagaaggggtgagagtcgaagcactagaacacatgcgcaagtacgtggcaggtacttcggtaacctacaacaaaatggttcgaccg

SEQ ID NO: 81187 - DNA, 2022 bp, Oryza sativa
acaccactaaactcaccaactacctaacactcgaaaacaaaccaacgcatgcacttacatcccaccactgatgtaatcacatgcgagacacacacaaccaaacctaaaacaagcaaactaacacaatgatctaagacaacggtttgacaaggcactctaagtcttccgggcatcggagttgattgaaggctcgttcggctcatcttcatcatcttgagtggctccccactcgattttggaatgggtgcgcttggattcttctacttcatcatcacttacgttgacaaccggaggatccgctagggctggggtaacttctttttccaccacacgaacctttggcgccaattgatagcgagggacaaatagagctctcttccttgcggtaagagaatcctggccttctgcggtggtgcttctcccttcaaggcggctagttctttctccaaacgatccactttgtcctctagcttgcaaatcttaccacgattccgatcttcacgatcttgagctgctaacacagtctctgcacgggtttcatccatagcccacagcatctcaaccaaatgccttgggtagcatcattctcaattccgtcagtctcaaggtagctgccacggtcacttccctgtggtgacgaggatggtagcgatactcagtgtcggccaactgatcactgtagcgatcgcgaagctctcctatggcgatccttgccacctcctgacatgcatggatgtagtttcttcctccagcttcgaacatcactgaggggatatcttcgctattactgtttaaggtgactttgacccggcacttctcttcatgacgatcatgaggaatctgggcataaaaaggggcagtcccaaatcctatggcaaaggacatcgtacgcaactcctggacaaatccctcaacaccaaacaagtactcagccttgtagcgcggcatctaaagacaagtgaaaggagggagttaagacatttatccaatcaatagcacaagtttttggattaatttgaataaagttagaaaatcaaagtaaaaagtaaaccaaacttgcaggataatttgaaacagttggaaacaaggccacaaattttgtgcttttgaataacaggtttcaaaagaaataaaagaaagtcataaaatcaacatgctaaatttatttccttgcagcaagattaaataaaacaatgttgtagaacttttgctggtaaatgagccattagtacagtaatagatgtacagtactaataacactggaataaattttgaatgagaacaactaaaagagattacgaagtgcatgtgccattattttggtttaattaaaagagaaggggaggagaacagttctacttttccaatatttttagagggcttctatgggtaaccatttggcataacctagggtcaaggaggttctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccattccacaggtagcttgaccagggctacacctaatcctccacaccatcagcatcattgtagaactcttcctctgatgaatgattgcaaggtgagtatatgacatactcagcaagccacgcagcaaatatgcaagtgctcaggataacaaaggatggcatagtagggtttcatttgcataaacagcatttaataaacatttcagaatttaataaaacagttaagtgataattaaacaatattaatccaacgctatacaacataccctgttgcataggcccaaccattctgaacaaccatcccggctgcacagttctatccccaaaccaggaatataccattccaaaccaggagctaatcaaattattat

SEQ ID NO: 81188 - DNA, 10924 bp, Oryza sativa
aataaaaacaattctaaattaagtaaagaaaacttctctaaatcatcatcaaattcaacgtacagctaaaaacggagttttaaggttcgtgaacgataaatgtacaccgtatcacgttaacggaatggttttactaccgttaacgtatatacggccgattaatcggttggtacggccgtttttccataacactggtatttctttaaaaaaacatgaaatgcgtagctctttgcttaatgtatttgtgattcatgacatgaggtgaagagaactctcctggacctaactatggttttatgtatccatactacaatttatgcttactaatgaaattcaaatattgtatattgtttgtcgcttagtgagtagtgagttagtgacttcagtgtagatgtaaatgacaacgaaaatcttatcttatagcttttttgacttgtattcctttaatttatagactttcttttctcttgttttggcatgactggggttgagaagagtgttcactacaattactttcaacaagaaagcatgcttagactttcttctagatacagtggtaaaaatgatacattttgattgtatgttgaatccttcacaaaagaatgaaagagagcattttatggtgaagatattaggtccttatgattatcttaattggagcttgcaaaggccttttgactgtgatgcaagtatatgaaagatgtaagaatatgcaagctagctcatatatcttgataaaagagatactcttttaagaatcaatgtagcacaaatcataccaaagtcaatcatttttcagttaatgttaataataatctcatgagaagaatgtttttattgcctttctaaggggagttattcttagtataagaattgagcaagaagtggatgatcgcccctctcattttcattgttaatctgtgtactatgtgaagaatttgttttttcctaacaaacatttaatttcatttagtaaagcattatagcaaattagcaattgattgcttgtggtagcaacaactgactttccttgttgcacttgagtgttgaatttaaaactttaacaatcaatttttagttcttcatttgatcaattttgttaataaccaaacccaaatattaggctttaaattatttgcacgagggggtccatttgtttacatctgactagaaaaaatacccgtgcgttgcaacgggtgaagtctattttaatcttattattgttatatggtttacttaagatgaaattcactgtgagagttcgcttggatatatatatttttagaaaatcataagctgcagttaggagtctgattgtctcaagttagcatgcgagtttttttaaacagatttcttatatgattccttttgtattaccaagagtgaacgatcttaaaaaccgactcaaatacggatatgtatttccaaaagcaaacgaacttaaaaaccgactcatacacggatgacgtatcaaaataccagcaaaaacatcttcaatttttataatagtagagataagatggttgaaacctagacgaataacattatcaaattcaccctagtctatattttatttcagaaaacctctttacaattcttggttttgctgactatgcaggtccacctggctctggaaagggaacacaatcgcccattattaaggatgagtactgcttatgccatttagctacaggtgatatgttgagagctgctgttgctgctaagactcctttaggagtcaaggcgaaagaagcaatggacaaggtattgcacttggaaatcacccacataagcagcagataaaagttagatggccaaatgaatagccagccagctctgaactcctgatttctcaaagcaaaacatgttccataagtatttttcactaacttcatgtttgttagggagagcttgtttctgatgacttggttgttggaattattgatgaagccatgaagaaaccttcatgtcaaaagggtttcattcttgatgggttcccacggacagttgttcaggcacagaaggtattcgatttgtacttttattaatagttcagccaataaaaatatttttctttaggcaatgtagctatgttttgaactacactgtttactttcgggttcataatatttttcttcttcagcttgatgaaatgctggaaaagaaaggtacaaaggtcgataaggttcttaactttgccattgatgattcaattttggaagaaagaattactggccggtggatccatccctccagtggcaggagttatcacactaagtttgcacctccaaaggttcctggagttgatgatgtaagttgaatacagaaatatggacttaataattattatactttccaaatttattttattttgcgtggatttttggttcagcaatttaattgttggatattttttcctatatatcttgtacaattctttagacggtcttcataaaattatgtcacggtgtttaacctatgtgatatttatgtcatggtgtcttatctacataactatattatataattctatacatcaacaactttgtaaagtattcaatattgcattatcacatattagtttgccaaacatctgttataactgcattgataatgatacaagttgcataaggatttctgttagttcattatttcctttatcaagtttttttttgtttcttaatccatttagtgacatattttgtgtggaccttgtatcccttttgagtctgcatagttgtagatattttgcttccttgcaacaaatatttttccagttaataaaggaactaatagtatataaataatttattcatccagtttactattttctttgtattgcatcaacgtttcttctgcggtactgtttctttcactgccctttttctatttaagaaaactgctataaaatgttgactgatgctttcatttgtcttattcgcctaggtcactggagaaccactaattcaaaggaaagacgacacagctgaggttttgaagtctagacttgaagccttccacaaacaaactgaaccagtatggtgctctttctagtgaattataatgttttaaagtatttaggaaaagttggttgtttttttaggcattatgacacgtgtagctatttacagttcttgagagtgtctgcctagttatatcgttctgaccgtacggttcccatttgacatcttctggattcttttctcatgtgttctatgattgcatatcctttgatagccaagacttcgggagggtttcatcttgttctctaaaatattgctgcttgtgaagattcagtattttttacttcaatgttgatttgctcccaccaggtgattgactactactccaagaaggccttggtggccaatcttcatgccgagaagccaccgaaagaagtaactgctgaagtccagaaagttctttcgtaaatgtaccaccattttgagacgaaaattcgacagattacccagacacactgggtccggcttttagatgttcaaattgacgctgacatgcaaggtgtagactgctctctttttgtattgggtactcttatcagatttgatgagcacagtgctttgcgttgttttagttctaataatctctatggcattgatggaaggaacatttttttgtaccaatatcacagggttctttcacccttgagagttcccaaaaaagctttgcttatgattatgtgctgttagtgtgttcctatagtacaacattgcgttacgctagagaattttccgctcccaatttgcattgccataatcaagtttcttcgctgcaattgtgtggttatttgcatgtttgaattattatcaatggcaatgactccattatgttacaagatctggactcacatttaagtatagaatcctatatcctatatatcataggtggttccccactaagtgcaatcttataaaccgattccaaggttagaaccctgattcttgatccccagtgggggggccctaatgagcgtctcatcgtgtgggggcgtgggtgcatgactagctcgctccaactactactacaacaacagtactactatatgtatatatacgggggcgtgggtgcatgactagctcgctccaactactacaacaacagtactattatatgtatatatacggcagatcctttaacttaactgcacatacagttgagtcactgacatgtgggtcccactttgccatggcccatatgtcagtgactcaactgcacaacagttaagttagaggatgatatatacgtatgtacatactttatatacacaactttgttatggaataggttatagacttaataaattcgtctcgcgaattagtccaaggttatggaatgggttataggctcaataaatgtctcgcagggttatgaaatgtgttttggaaatgggttttgtcagtagtctacgtttaatacttctaattagtgtcaaacatccgatgtgacaggtgctacaaatttttagccccatccgaacatccccttacgttatcaaacacctttcagagtttccgcctagaatcatgatttatgaaatttctctttcaatggccacaagtgatcaaaaagttttaatggccttgggatatctagcaacttcctcttccaatggccacaagtgataaaaaagtttaagtggccttgggatatctagcaacttccttgccattccatcaaatgactgatatttattctccttttttttaaaaccaatcgtatggccattatttatggcatgacgtgactctttcttttttcattctttgatttctcttcctttcattctcgatgcgccaattgagtttttattgagatcacctcacgaaccacttccagcgctaagccaatcgctggtgaggctcgggagttatctccaattctgttaagattgattttaccgatcacaaaaacaaccttatctcttaatttgatttctgttaggaaccggataagtgggatttatccttttccttaacaaacagaaattagcctaaaaaatcaactgcatcaaaattgtgtaatttacgtgttgtaatagtgacataattcagcagtaagtgtgtaggagtgtcatggtgtttctggataattatgcagaagatcagaggggaaaacaatccgttaggctcaataaaaagtttcaagtttcaatgcctttgccgcacaagacaaagagggcttacatagggtcaatccatcagaaattgatatcaggaactgatttccctgttcaaatagtccacaaacatcctcgttgcgctatcagcatctgctggtgggggaggtccactcaagctgtactgccctgccagcttaatgaaagtgcgtcgcaggcttcgaagctcaggcagaccgactgatctttgaagacatatgtaacaaccagttaaggatataatggttctttgcttatactccctccatcccaaaaaaacaaaaaaaagacaaaccctgagtttccgtgtccaacgtttggctgtccatcttatatgaaattttttttataattagtattttcattgttgttagatgataaaacatgattaatactttatacgtgacttgtttttttaatttttttcataattttttcaaataagacggacggtcaaacgttggacacggaaacctagtgtttgtctttctttgggacggagggagtacaacggatagaaggtgcccctacctttgaagcttacatatcaaggcttcctcgtagcataaaagtgtggccaattattattcaatgtgcaaaactaccattttggaagtattttcacctacttgattttcaaacagttgcaaggtgaaagaaatgtggataaagctctatatgaaagggtgtttttgtatcagaagattattttacactagccagttaagattgctagatcttcatatactgcacttataatatataaaaaagaatcaattgacacacaaagcttaagagtatattgtttaaacttatatgtatacaggataaaagaattggctcaaacagtaaaggatatagttggtaggtcaggaccaagagaaatcttattcacgggaagcccaagaccacaagattgtgcttcaacaattgcattgatcacctcctgcaaatcagctcaaaaggtatgctgactaaagagaaatccataattgaaatatcagatatcaaccaaaatgactgtcattacctgcgttgctttgtccatctcgtaaagggaattagcttctgttgtccgagcctaaaatatcaccaaggctgtgtttagttcagcgcaaagtttggattttggttgaaattggagatgatgtgactgaaaagttgtgtgtacgacaggttgatgtgatggaaaaggactgaagtttggatccaaactttggatctaaacacaacccaaatcaggattcaattccaacagctacaggtacaagcataaatgcaatagcactacacttccagcatcataaagagagtacagtatctgcagaaagtgactaaggcattgattcttctgattttttgtgcatttacaccatcacatttagattttgacagaaattgtttgccaggggtacaaagagctaatacacaaaaaagataggaactaagctgtaagagtatatggtagttagagtcgtattaggataggattgatttgtgtggactccttccatatctgtaatccttccttgtctcctccctatactatccaacataagcatattcattgaagaacatatggagttaagactccatatcacaataccaagccaaattatgagagaatggaataatttggaaaatgaattatttggggattatatgatcacgcggcagtttttcaagaatagattgcacttacagtctgagtggctattgtaggttggagaactttcacatctcttgtcttagagtccactttcttagtcaaatatgatacagcctcagcaataacaggagacgattccattactccatctattcaaaatagtacaaaatcagttttgagttttgacattgcataaggcaatatgcatatctatggtaggtactgatatagatatactgattacctctagatggaaacaattcaaaaagaggagaatcccaacgattgcgcctatctggcttctcaaatctacttaccagatcatcgaatctgtcacaatagaaaaaactggtgagcggacaatagtacctggttatgtattgtattaaatgccagggacacatgctttgttatattcccaaggaggcaaaaataacaatggatttcatagcctataaagaatgccaagaagcaccaaaaatttgaatcagacgtgacaaactagcagcacgttccgtagggccaatattatcagttcagtttgttgcattagtttagattcttttgtcatcatattaaattggtgttaggagttggattagtaaggatcagtgagtaatgaatggggaaagcaaggattatcaatttattcacccattcctacctttcccttctatcccctgcaacccttcccccacaatactcttcttctgctctaacctgccaaagcctccctccttccatgattacccaatatgatctctagaccataatacaactacatgcaacatatctgtagtttgtggaatcaatctatagaactaaataaaaaaaactgagaaatcatgcagcatttcctcatttgaatttaataggtcaagaagatccaaaaaatatgaaatctctcacatacatattattatcatacgtgggttctcctttctcctgacgcttggtgttccattccctacaatggtccacttctgtatcacagaaaagctgaaataaaatagaagcaggaagttatcagtctgttatatgagttttcactatatcaaatggtgtaaaaatcatagtaaattgcgtattggaccacctttctatcatagcagtgttttttttcaccttgggatagcaatttttacaaaatgttgcacttaagacctacctatctaaccttcaggtcaagattcacatgcttgatcatagttggtactggtggagatggagctcaagctccgctagcttgggacatgctcgaggtcgacctcaaccttcgttaccctgccccatgcatccgtgctcaagactcattgtgcagtgttggttatgtgccccagcccccaatcaagctggtgcagccgcggatgaggaacttgggctagcatagactccatttgactagctgttggtggggcagaagtgtggagagatgagatccatatggagttagaatatcccaccatgattcattagctatgcatgcgcttgaactcaaactagagctctgccgtgccgcatcgagctcaagctggagaccgccagtgctgcactcaagctcaggcgctaacgtaggtcaagaacgtgggtggggcctgttcattggcgtggtgagcttgaaccaaaaaaggggagagagaagagaagagggggagagccagaggaagaagaccggttcaatgtgaaaaaaattgcaaagatttctggtccaaagtgaaaacaatgccctacctatctagtccaagttgcaacaatggttaaaaagagtggcccaatatgcgcttattccaggcacacacacacacacagaaaataagaaaaaaagagtccatgcaggactgctaacatgattctcagttgcaaataagcagattctcaggcacatgaattgcctttttgagggatttttgagagagagagagagagagagagctcttaatcttgggcttgatgccaggagaggattagtcacgctaccgcaaccacctaagataactgtccggacgaaacatgcctccaggactcttatccaatacttgatcatcagggcaactcaactaatcctagaaaaacatctccaaaccaaacttatctctagtccataactcaattacagcctgttgtgcacagccagtgaagcagctgccagtaggactcatgtccatgacaaatttaccgtgtgtctgagtatcgaaggaagtaagaccgaggatgcaaagaatccaagtgagatcaataaagtagtggatgccaacagatcaaaacaagatatgtggcaattccttccgtacactttactactccctccattttattatattatataagtcgttttcacttttttcaccctgccccatgcaagttttggaggaaatttaacatgaggtagaacctcatggaaaaaatcctttagtctttatctctcctcgaattcatgtgtttttcctgcagcccaatcaaacaatcattcctatgtttttctatgttttgcaatcctctgttttacatttccattcatgtcagaatcctatgcttttcttattcctccgtttttttcattcctatgattcaaagaggcctttataatatgaatggaggaagtatcttatttctctgtaaagcttattttactttgtttctcaactgtcattctaatttgtgggtcttaaccagatcaagattatcacacattatttacaaattaatattgagttagttctcttgttattgccatcaatgttatttgatcgctgattgatcctgatcaccaagggaccgaccaggaaaattaatcgtcgatcagcctcgattagtcgacctgatcagtactatgaatactagaacctatattctatatagtgcatagtataaagcaatcacagcactaataattgatggcaagatggtcacttgccctagtataaagcaaccagcagtagtagcacatattcacatgtgctaaaccctaagaattgttcaaaaggtgatcgataggtgctctgatcggacaattaattgtgcctgatcgacgattaattggaccaacaatttatgatcgagtgaatgtccctgatcggagtagtcaggagactgatcaggatgattaagcacgattaatcggacgatcagataacattgattgccatcatacatgatctttttcctccaaattggttttgtacctaacttgtagtgttaactaaaatccataccttgatgacacgtgatttttaacgctatgctagtctttgagtaaaactaatatttaaaaatctaaaagaatagaagtagacaaacaaggcagcaagcaggttaccacacagtatcttattccagatgcccgtgcaagacaccacaactcataccggtatccctgcatattataggtggaattgattatatcaaaatatggcaacacatgcacactaatatctcaaaatcatgtttcatttgaagcatcatgcgttaacaatatgccaacaaatcacagaatttactacatattacaattttcatgagaattcgcaaagcatgtagctgtttattagtaacgatagaactgacaacagaaagcaacacatatttacaaactagattgccacttaactgattcatgaaatacccatattgaaataacttgttggttggaaagcaaactttgccagttacatatttttggtattgttcaacattggcttgcgcctaacttttgcaataactaagttcagccaagtatgtcttgacatactatttgtggccacattggaagtgaggcaaattatataggaacttctcaagatctcattggtgacgcttgagcttcaagcagaaagatcaataaaaatgcactcatcacgtcctctacatggcttcagcttgcattcatttgctaccctaactatgactacaatcatacttggcaaatatttcttatttttccaacttaacgtgctaaaaaccatcccacttaggctttgttcagttaatttttgtgccaaagaaatccgcaaagtcaccagaaatgatatcgtgcttgaaaaccatcccacttaggccttgttcggttaatccccatgagg

SEQ ID NO: 81189 - DNA, 867 bp, Oryza sativa
acctttgttgtttctgtcctcgaacaacggtcgatcgaactcctgatcctttgcatcaccctcgctgacaacttctcctaccacatttttccctcttccttcctttcgagtcaccgatgctcctaaatccccagccttgttttgccatgcttccttctttcctcccaaaaccttccttgaaccttcagctgatttatcccatcggctcacaagtgtgcctcccttgttgctccctgatcccgttgttgttttctcagccctgccagtaccgctgtccattgccctttggccataactgggcagattcgaccgcccggcatgatgtgctccgctgcgacctggccttccagcaaagcctcctcttatggtcccaaaacttctagcccctcttggcctgaagccctgactcatccaacctctccctcctccctccctgttaatccctaaaccaggatgaaagcgaaaatggaagtcttctcctccacctctctcctagaaaaaattgccttcctcctcccaatgtgaatcatctcttcttccccagcctcgattgccctgtcggtctcaatcttctctatgcgccatggtggaaacctcccgaatctgttgctcgctctccgttgtctgctctgtttctgaactgcttctttgaaggatatgggtatacgttctcacgggatacgaggggccagctgtatttcttaggataccaagcgttggtggctaacccaagcgtttcttcactcgttcatgctgcccggcccatgacagcagttggcctgctccaaagtggaacttgatttggactttatgtccagaccccaagtaaaactgtttggacggcccactatccttctttagtttgaa

SEQ ID NO: 81190 - DNA, 4074 bp, Oryza sativa
attaagctggaggatgcattacaacaaaggccatggagttaaacaggttatacaataaagcagtagttctaagaaaatgcatttagttacctccaaataaccatctgccaactccatctactacacttagccaaccgtcaataactatctgccaactccatctactacacttagccaaccgtcacaacttatgagctaaatatacattttcaccacttgtatgcaccttaagattaataaagatgatgttgtcaaaaggatagaaatatgaggtttatcttgatattgcccctgctaacaaaacaacacacggagggcaactatctgagttaacgcatatgtatagaaatattaaaaagcatattagttcctataccagtttaaggtagctatattggtaaaaacaaggtgcaaaaagaataattaatatttgagggatcagagaatcaagagaataactacataattaattagttgaaaatagctcaaattggagcggtacatgtgcagctaaaataacccatgcatggaatacctacaagcatgtgcaaacaggtacatataaagggtgcattttgtagacaatttctgctgaatgaaagccccactgatggcaaccagatgcaagattgcctgagttgaccatattaataattctaagcccagccccctccataccatcaatcaatttgtaggatatgaatagtgaatattgcacatgggttttcgaggacaacctcattttcttttgatacgagtcttatctttaatatacggagttctggttgtacactcaaaagtcgaattttatataaatatcaacatgtaacagtgatataaatttgtagtttccaatttccagtacattaacagagtggtcctcatttaactataacatcagcagcagcagtgataaactcacacatataaaacctatgaaatttcatcaccaattcagaattgcatggtaaacacgaatcccattatatacctgttctactccgtacaactaatttatatatatatacttgccctactccataccaaatttagtaattgcatgctcttagggcatataatttgtacctctatctgtccatgttcaaatgtcattactgaagatataaccaattgctaaaggggagctcttatggtataatagataatgttttttttgttttgaaatgaggcattcatgagctgcaaagaatgtgaagaaattggttcacaaaggcggcacgaaggtggtggtgcccaggcgcggttccaatccggtggtggtggatggtggcaccggcattgtcggcgaagactggaacccaggcctggcggcaggcttgttacctgcaagaagaatttcactgattagtttgcctcttgacctcttattctgattaacaggaagaaaatttgatatagacaaatcaaaatatgaactcagtttggtagatcagaaataaatcaagaaaaatcacaagcagatttcagaatattaaatccacatgaacacagattctacattaagctgcattgccctcgacattatgaattcatctatgaaattattccatgaacaaacaacacatcatatctgactttggattgtacccagcaatttaagatcaacactaaaagatgtatcacatctgagctgacttcaagggtcagtgatattgtacacatttcttttacttgtaaatgacaaatccatttttcttctagggtcactgatacttgtaaatgacaaattcatttttcttctagggtcactgatattttacacattcctttttctagatattcagaagaaagatatattaacccatgccaagttttgtttttctgaattcatttttcatccgcccgattgactcgaacaagaaaaaagagaaactgaagacctggcagttcaatcaaatatatactctccatcaatttttgtacaacgaagacctggcagaagaggaggaactgaaggaggcactcacggatcggcgggcggcgtggtcgtggtcgatggggatcggcggtggcgtggccgcggaagacgtgcgggcgacggtcgatgggatcggcgacgagggaggcggcgtcgcgagggaggggatcggtggcggcgcgcgatggaggatcggcgtgaggcgtggtcgtgctcgacggggatcgacggtggcgtggccgcggaagacgtgcgggtgacggtcgatggggattggcggcgagggaggcggcggcgcgaggccggggatggagggcggcgggtagggaatcgcgaggggaggagggcgataggaatcggtggcgctgcggagcaaattgaggggcggcgcggggcgtggagatcggcggcgagattgaggcgcgtgacgggagttacgggagaaagagagaataaagggaagaagttacgggagaaagagagagggggaggggaggccaatctgcgcgcgagggagagccggagaggtgggtgatctagatcgttggttgcagagcatatgattttggccgttggatttgtccaatgatgaatgagtatgagtaagatgagttggtgcattatagggtagatgttttttttctttgaaatccctaaaggaattttaaagaagctggatttttacagatccagatttttttggcaatgtgatgagcacaaaaagaagtataggttagctaaatggagtgtgttgtgtagacctaaggaatgtggggggttgggaatccaaaacctagaaatgcagaacaagtgtatgcttagtaaatggattttcaggttgatcaatgaagacggaatttggtaaagtttgcttaggaaaaaatatttgacaaagaaaaccattttgcaagtccaaaaaagaccaggggactcacatttttgggctagtctcatgttagccaaagagtcttttcaaaggtttggttccttctttttacaagatggctcagaagtaagattttgggaggattgttagataggagttcaatcctttgagaaggagtatcctaacctctacaatctagttagaaataaaaatgaggtggtggccaaggtaatgagtggaataccaatgtgtctttcagaagatcaatagtgggaagaaacttagaagcctggtatgagctagtgtcgaaagttgttaacactgtattgacagatcagaaagatcgcttctcttggaaaaacaataaagaaggcattttcacagtaaaatctatgtacaagttgctcatgtatgaagggctggttcctaggaagaatttcatttggaagctcaaaattccacttaaaatcaaaattttcttgtggtacctcaaggaaggggtaattctcactaaggataatctagcaaagagaaggtggaagggtagcctaagttgttgtttttgtaactctaaggaaacaatacaacacattttctttgattgctcaatggctaggtatatttggagtgcgctcctttttacatttgggattaggcaaccgtgtagcatgtctcaaatgtttgggaattggctgaattttgttgaacctaggctcaagagaatattgtttgtgggcatagctgtatttctttgggcaatttggttatataggaatgatgtggtctttaatggctccaatcctacatctttcttgcaggtcattttcatggaaacacattgggcaaggacttggtctttgcttcttaagggaaccgatgaagaaatagttaagaactattgcaaagtgctggagaagcgtgtggtgaaattcttctccgtgtatggctggaaccttagaagaagatgggaagcctagtcttttcttcgtttgttgttcttaaaacctttgtgctgtcatctcttatgtaatgggagaggtcagttgatacattttgtacccttttattagggagagtcttatgtactcgtgttcggatttttggctgtgtacaccccacaaaggtgtagaggccgggtttgataatcctttatcttaaaaaaaaatggtgacgatggcggctcagtggtcgacattggctcacggcggcgcgtggcacagctcggtggtcggcgacgacgtgtggcgcg

SEQ ID NO: 81191 - DNA, 716 bp, Oryza sativa
ctctagaacctcgcaatcccagcccaactttcgaaggaaggccgggccccatcaggccgatagcctgctcgaaatggtgaagctccggataataaaagggataagccggcaaacatcgactgaccgccgcacttaatcccccccttccctacctccctccgacggagcgccgtctcaaaatgggcggcaccttctccaccgccttcgccatggcggtggccgccacctcccctaccattggcactgcgccattctcgtctcttactatccgcctttggcttcggcccaaaccccttctctttaatttttggctccttcttcccgtacccaagtgcttctcctgggttgaatccgtctcggaggaaggggaggaagaatgcgttgaggaggattccgaggaatccggtgccgggggggaagacgatgacggggaggacaacgacgaaaagccgcggcctgagccggtggccgcctctgggttcgagttcgcgtcggccgccggagggctacgtggagcccgccccgttcgacgagctgaccccggagtcgcccgaggacgtggcaacggcgtacgaagcgctctacgggccggcctttagcggcgagacggtcatgggcaacaacgtcttctaggtcaaggtggtggatcccgtcgacatggaccgggagcagcgccctagcgaccagttcaacgagcgggtcgagcatgtcaatcg

SEQ ID NO: 81192 - DNA, 942 bp, Oryza sativa
cttctgaagcagctgtcacagcctgattttctgtttcaggatttataaattatttaataaattattaatagaatttatattaaatgttcattaatttacaagtgaagttaaatgtgggaaataaaatttcctaaatataaagcatggctggatttaattcttattaaattctccatgattaattatactctctgaaattttctcggatttttcggagctcaattcttaattttaataatacaaagaacatttcagtaattatccacatattaaattaatcattaaatggtcttattacaatcttgttaagtactttgggtgtccaagtattttcaggatttttcttgaaattatttgagcattggaagtatttttaacaattcaaagatcatttcagtgattaatttaattgggaaaagtaattaaaatccccttttcattttcgggccgaaacaggaaaagttcacctttaattcttggcccattcttccttcttttcggcctgcagccctctccctctctttcccgaagtccaatttgcattcctccttaggctgtgtatttgaggcccagccaaaagtctaaattccctccctgcgctactgttcatcttccagctcaggcagagcccgagccagccgtgctcgtgcacagttgccgccgcctctcctcccaaatctggcctccacttccccggcgccgaagacctttagaagtacctcgccaacgtgaatccaagcttcgccgccgggggacggtggtccagccgcatctcgccgtcgcctcggccgtcgccctcctgtgccgccacctctctcggctccgcaaggtcaagagcaagcccggcagccggttcccttgcgtcgaagaccccgggaagcccgtcgttgcagtcaactcgaagttcgccatcgcgttttgatctccggcaaggacttgctg

SEQ ID NO: 81193 - DNA, 679 bp, Oryza sativa
  unsure (1)..(679): unsure at all n locations
aggtctccgggtcactctggtaatgactgcccgtaaacccgtgaggagccnatgtacatggccaacaacatcatcgggtatcgtccacaagaaggtcaggggtggaaccactcacgcctatatcatcaaggaggtaacatcatcgatccagagaagaccatgccgcaggagtactgacacacgattgctgtcgtttcctcaatggagtaggaaaccgtcagtgaacgagcaattcgctcgttttgttgaagtaatccagaaaatccacatcaacgtgccgttgttgtatgctatgcaagtgccaacatatgcccgttaacaaaagtacatactgaccaacaagagaccgctcccaacatcggaggtagtcaagctgacggagcaatgcagcaacttggtactccacaagctcccagagaagatcaaagatccgggatgtcttacgatcacttgcttgatcagggtacaacagttcgaccaggccttgtgcgatcttggagccagcgtcagcgtcatgctaaaggacgtctttgacaagctcaacttcacgtgtgttggcaccaacaccgatgcgtctacaactggatgactcgtcagtccgttacccggcagggataccgaaagatgtgccagtcaagatacgggatttcttcatcctggttgatttcgtggtactaga

SEQ ID NO: 81194 - DNA, 660 bp, Oryza sativa
cctggtttggagatagatctgtacagccgggtatggttgttcagaatggttgggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaatgagttactagaaaaaaggatttattgagtcgagtacttcagagtgggtatttcatgtgctatttgccaagaaaaaggatggaagtcaacgcatgtgtgtggactatagag

SEQ ID NO: 81195 - DNA, 615 bp, Oryza sativa
accatttattacctactgcagatccatttgatgatgatgcttctagagtacgattactcatcaactgagttgcaatagcctcaagaaacttcaactgattcattgcattaacactttgatttctctcaagggccgcaaggactcgagccaaactaggctcttctacaccattgccattactttctaacatgctgaccactgtcctaattagtcaaatctgcagcgatttaaatagagatagataagaataagctagaatagagtaagttaagacagaatataataaagacaaaagagaaaagaatgggtagaaatgcagttttcgtaaccatgatgcataaatctacctaccacaacaaaatactttttaaaagcgaaacccaaattaaacccacaaggggaaattttggtttttaagggccccttttttaacccccagaaaaaaaaatttattttcccccctagtggatttggcatacagcttgcataaaacatgccaatcaacacgtctactaaggttcaaagtctaattcttacgtgagaacaaggcaagagacaagaaattttgaatttagaaatgattagacaaaaaatatttagaaaataaaatatatt

SEQ ID NO: 81196 - DNA, 4558 bp, Oryza sativa
ttttatccctctccttaatacctgtgcccaactctgaaagtcattatatttggatggagggaatatttcttttgctgaagaagacaggaacatctctgagagagtgtttaagtctagggacatactagagctggataactgagtatatggaaccagtaaacccacgagtggtgttttgcatcaggaaggcatggaccttgggaacaaggatcagtggcaaatccagggggcaaaaggaggtctggcctctcccagcatgttgcttccccagcctggcctggcgaaaccattagatctctaaagctctaatgcaacccgcgggatatttaccaattattttcgtaatcattgtcactcggcaagtcgacccccctcatatctaaatcctggcttctccactgacagggatgccaagctccttgtcagtggcagtgcagagtggattggatttgaggagagcatgcagaggggattagattgtgcatggaggtgaatatggaaatgaaaattcgaagtttgacacagccttgaggtctcttcttcctctctcctaccatttgtatttggtatgactgttttgcagaaggaagaatagaaaaataggaaatgcaagtgatattcaggttaagaagttgaaagaatggaaagggaaattcaatttagtccaatgtggcacttcttagaccaaaccaatcaaggagttgcattttttcaattagcttttgggattggcaaatcctagagtccccatctaaagcatatgatcagttatcccagttctattatggtgttttgttttgtgctatgagatgtctaattttgttactgacattaggcagatgacaaaccgctgatgtggcctgtactttttggatatggcaagacctttttaaaaatatcagaactttagttttgtatgttgtatccttttgtttggaaaataactcttcccaatctatttcttcctgcatttggctaataaacatgtgatgcttaaaagcttggccgtacatttaattgttctgatctttgaagattaataaaaaaaattctttggcggagcaattttataggtgttcttcctgtgatggtatcaataattggaatttctaacactcaaatcttgtgcatatgagcatatcgacaataattgtgcatctcctatctttctggcagttatgtctatctacaataattgcaattctgagtattatttcatcttggtttgtcctgcacaacaagcagagcagatgcagactatggagcagccagggtcatgttgaggcctgcttgccctggatctggtgtaattgcaggtggagctgtgagggtcgtgctggagatggctggggttgaaaatgctctggggaaacagctgaggagcaagaaccccctcaacaatgcaagagctaccatctaggcgacccaaattatgaggcagttcaaagatgttgctgcagagcgcgggcttccaatggagcagctatggaaataatcaaataaataaaccttaaattgcctccaatattgttctgttctccatttcttgagatcattttcagttgtatctgtcagtggggataatcctacatttaagtcctctccccaccctaaatgcattatgtgtctccacatatacatggcaaagctttagatgaattgatctgcgaatacctttagcttcactagtaatagtgcatgtgcaagacacgttccgcacgtataaatgcgagtttattatgttttcccactatgcatattaaacagaccatataaatgtgaagtttaatatgccacatatctctctgtttacaatttgtcgtataaacggaaaacaatcaatgataccaaaaatacaatttgttatagtttgataaatgtttggcataatatgaagtgtataattgcagagaggagagagagagagagagagagagagagagagagagagagagagagagagtttttttatgtaagttatagcttccttggtcacctggttatgatgtgcatatgtggcttgatgacattgcttgccgataagaaaaccctgaaaaacaccaaatagaatgggagaaaaagcaaaaagaattactcgcagaaagtatcggcaagcactaccactataataaaaaagcattatattctttttataatgatgcatttagcataattagttactactcttgtctaggtagcacacaaattaaactgagtcatgtcgcaccaaacctgtcagatcagttatttttcataatctataccacaagatttcagcattatcttgctgctatcgtttttaattttggtgctacatctacgcctattgtaaagaaaaataatgaactgacttaaaaggaaaccaacctacactaaatctgacacaaaggagccatgaaatgttgtgtcaaaaaatataatatgaatatttgttggaattattttctggaaagatagtgctctatagctctatctgccctaaaagactacatttttttcttgaacctttatgttcataaacaatgttttagctaatctttattaaggcaaattattatagtttcagcataatttcagcagcaacgtcttggataggaaattgtattgcatgtatctatactgggcttcaaaatgcaggataaaaataggatgggatctacatattttataaatagattctcactgtttatcatgggattacatggagtcgtaccgacaatttttaattcagatgttagggctctcggttgtcaacgtaagcaatattattcttccctcacaataatatctccagaagcttctgaaacctgaaaaagacatattggtttgcataaacaaccactgagaaaaggaaatgctttgcagagctagtaccaagaaaaataaaattaaaagttgccatcagtaacttaagaaacaagagctttatttgataaaaggcagatacatccagcaccaaccgtctatcaaagccaagatctgtagcagcattttgtaataatgaaaattttacatatacacaaattgtggttccatgttgtttctaataaaaagtattcagatcagcttaaacatatatgcctattgagatgcagttaacaacagaattcacaattatttcagtagcattgatatggaggattataggacactccgaggaaattaacaaagtacgtcgcaggaagaagttctgtacaatgagcatatttgtatctcaagaagcttcctaataagcaaaattcaagggaactcaatggtgttcctgacctggaaactcaatcatgtgtcaaattgataggagaaacaatgcaggtccaaactgaatgaaacttgctatacaaattgatctatgtaggcaggggaaatactacatccaacactcttgcatgaatatgtcagtcatgcaagttcacatacaaagaatcatgaaagttctaccagtttttaatatgcttggtgagcccttgggttactaagggagacaatgctagcggttcagccgaacgaaaggaggttctttgagcccttaggtcagggtcagatcgagcaggactaaccagttaagttgtacgaagtgtcaacaaccaaatttggtaatttcagtatcagagatggagataaagtcgaagcggaatccaagatggagatcgttccgcaaacagaggaaggatcggctaaagtccgaattggctgtgaccgggatcggcagagtctgaattggacaaggttagctgatcgagccgagtccgacaatatggtgcggtacacgttgttctttttgagttaatgtgcttcatgaggattgccatgcacggattgagtcgtgagaaggcaattgtatctattaattaggatatttcatgtaatttccttagagatatgtttgggcaaaagtctgccgcaaagacttatggtatctaatagtttgttagagataagagtcgtttccgacacggacatattttgtaatctcgggtataaatagaccccgagcctcatgtaatacaacaacacacgttcaatacaatctcggcgcattgccacccctttactttcgttttgtttcgacaagttcttgctttcgggttgagctgcatcggtttcgatcttcaactagaggtaaaacttgttatggaggcttgcgttatcgggattagtgcttccatatttatgatactctaatcttgttcatgtaattcgtcgagttatcatatattctatataatctttggcaatattgttatctaacctctaatcggctaacatctgttacttgaaggcagccgatcaggttaaatactgacgttggcttagattatataggatatccaccactctatgaaacatccagcggcttgattatctagatgttgtccttcttttcatacttatagctgcatcagttgagtttgaccttataagtcgtgattagaatcacgatctctagcctgctttctggttgccgattagggtagtatcggggtttcagccaatcttacctgatttagctttatgttccatatgcttaactgatatgctagatctgccctttatgtta

SEQ ID NO: 81197 - DNA, 1261 bp, Oryza sativa
cggttggttgtcatgcctggaaaataactatccagaatgctagtgtattaatccccgtcccaggaaaagccaggtacatcacacatgatacaaaagacacatctttattaattatcgcgataatatttacattattgcataggcacataagacctgacaacaaaagaaaaacaacactggactagcatgtctacggttccatcttcacaaacgcttaactagggtataagccaggactctgcctaagacttctgttgtcgaagcgacaactacgtacgttgaaggacgtggttattcaacagtgttgggaacaataaatgtattactttaagatttttcttcgggatcccccccttttacatgtcctagggggctatttataatcctattataggttcccccattagggcttaggctttacagggaaatttacatggctgcccttatgaaagggacgtttgcttgggtatatagtgatttggatacataggcctctaatgggccaattggcgaataggcctaagcaactgggatggcctcttgggcctcttcaaagtcgggcttgttatggcgaagcccccatccttcaacctacacactttgcccaagatgcatttgatcttgccagataccagcgcgatccttcagccttcgccatctctgctttatagtcttcgccatggggcttcgcctagatgatcttagcgtcttgggcctgaatcctcgctggttgcatggtttcggtaggtctggtcgaagggtctcgtgacataccgccaacaacttctacaaaagtttctctgactggagggtgaaagattaagcaaggatgagtacaaccaccatactcagcaagtcacatcagaaaacacacttaatgcaagggagtacaaggattcatttataaaagggttattttgaagtaaaggggcatttcaaatcatttaattgtttaagggcattttagtcaactcatgacctatctctagtctaattattatcaagccgtgtactcaggcgatcttgccttaaactaggcccaaaggtgataaatctagtcattcccgattattagaataaaacctctaactttaggtcattgctaggcttgcctataaccgagggcgcggctattcgaatagtttatactctagctaggggtgtacatctttacccacaagagcagtgttgattacatgtcagccgtgcatcgtgataccagaaaggtacccgaggagtcaagatcgcgacataacccacc

SEQ ID NO: 81198 - DNA, 532 bp, Oryza sativa
ttaacacggaaatgcttgttttaggcttggcatacctagatctgatcatatcaagaagagctggggcaacagctgatgcttctggatgcattgccatgcacttcatacagacaccaagcatgtatatcaatttacctaggacaacaaagtagcgaccaaggaaatcgataccatattactaacgaagttcaacatgccattcttccttcacattagtttacactggtattttttctggataaaagggacacacaaattattcgtatcagttgggatgttgtgcattgtgatccttagcaatctcaattacttttctacatgctaaattacacattgcagagataatgtacaaaatcatcaatatgtacatgaatctaaaacaaaactgtggagaaagtttattagtattatgtagtacagatttatatagaggtgaattgaccctaagcataattcgtaaatttacaactaccaaatcaaatgcaagctatctacggatctaccagcgggggcgaagcccaatagaggcccg

SEQ ID NO: 81199 - DNA, 1731 bp, Oryza sativa
  unsure (1)..(1731): unsure at all n locations
agtgtcaaaacagcgaagccctatatttgcagtccaatattgcaatgtgcgcgggaagcagagaagagaacgagaagaattgagaaagaaggaagaaaggggataagaaagagagagaatagaggaagaaaatttagaggaaaagaaaaggaagtgggacccgcagtctagacccttcctccctgagttgacttcccccatggaagtctaaatcacttccctgtactttagtgtgtaagtccaaaggaccaggccctcttatgaagtctatttacctcctagcagagggaaaagtacacgcaaggtccctcaacttgttagccagatacaaaatcgtccctcaaccgcaaaaccggacatccggcgtcccccaacttacaaaaccggtcacaaaaggtccctcggcggttttgaccccggttttgttccacgtggtggctgactcagcgtgggacccacgtgggccccacatgtcagtaagccatgtcatcacctctctctatctttcctcccccttcctctctctctcacttatctcctctcgacaggatgggcggcccgggcggtgggtggggatgtcgccggggtgaggcgggagaggaggtccgacgatcgccgaccggcgacgcggcggcggcgacacgggagaagggaagggcggcggcagcccagcgcggtcgcggcggccaacagacaggcatgggacgggcggcgtgaagggcggcagcggcgcgtggttgtagacgaagccgaggaagacggcgtcgacgtctcccccagcctcagccaccggggaaggagctgggcacgggtggcagccgtcgagggcatcgtggcttcggtcctcgagcgccatcatggtgtcgccgtcgtcgccgcattcctcccgtctcgccgccaccgccaagccgacgcngacgcgttcttcntgcctngtcgccaccgcccagcggaccagcttggccgctgcggtcgcccgccgctccttctcgtcggcgagcacggagaggaagctgacgccgccgccttgctcccctcaccgccgccaccgccgccttgctcccctgagccaacgccgacgcattcctcccgcctcgatgccaacgctggcctccccgtgcctccctgccatcgtcaccgcgttcctcccgcctcgccgccggatttggacttgggaggagctcaccggcctccccgcgcctccgccggccgcgcgtgtggctccaactctgccgccgctcctcctctccgccgcttcttccccgtcggccgtgctgaccctcttctccaccgcgtcggtgacgccgccgccgccgccgcatcggcccttctctccgcgtcagttatgatggtcgtagccgcgcgccgccatcgctgaccgcacgagggggacggggaggccggcgaactcgcaccgccctgagcccgcgcaccgccacccgggagccgccgtcgctagccgcaccacctttcggccgcgcgcgcagccgcctgtgcgagagcagagagcgagaggaaggagagaaatagagaaagagagatagggtgctgacgtggcttactgacatgtggggtccacgtgggtcccacgctgagtcagccgccacgtgggacaaaaccagggtgaaaaccgccgagggacctattgtgaccagttttgtaagttgggggacgtcggatgtccggttttgcggttaagggacgattttgtatctggctaacaagttgagg

SEQ ID NO: 81200 - DNA, 607 bp, Oryza sativa
agtatgctttggtcaataccttattacttgctctattctcttgttcttttgacatggtatgaatgcactttgattaattacttcttcatatttaaatgcatgctagcaaaatatattacacgcataatgacactgttggtacttaaaggcttaaaagctagcagctgttgagctagctgtctcatgaagctagcttaattaagtctgatttatatatatatatatgtagacatccagagagagagagagagagagagagagagagccagagacaagcttagcaacaacaaccaaaagcaggagcactaactgcagctgttggcgatcgaattaaggatcctgcagctacaagcaagaaggtgcaggtgcagggtgcggccatggcgaactaccaccaccaggagtactaccagatggcggcggcggcagcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtac

SEQ ID NO: 81201 - DNA, 10014 bp, Oryza sativa
actaaagatgaactttagtcccggttggagttaccaaccgggaataaagatgatttttagtcccggttggtaacaacaaccggtactaaagatctttctcttataaaccgggactaaaaatgatttttagtcccggtttttaatggaaccgggactattgtggatttgggtcgaccgaccaaagatggtttctctactagtggtagaggagttgataaggaagaagacatgggcattctcttacagaaattttagaaaatgcaatgaaacggtaagtagtgacatattttgaataaccgtagtattgtaatggcataagttcaaatagttaaataataacggtatttctcaaaatcgtggatgacaagctagctcatatatataggctgcttgagctgactcaagcttgaagggcagcttggattggcgcattgagagctcgatcgagcaagctcgttgcagctcgtgagctagtgttcctccatcacttgcacactgtatatattcatcctcctactcctccgtggcgatcggcagaggcaagcgagtggtgcggcagttggcaagcgtgacgaggggtgtgcagcgagggcagtgcagcagccacggcggccggcgagtgcccgatgagcgcattgagctggcaaccacgatgaggggatcggagcactactacagaaggcctaaatggtgccggttgagaaaccccctaaggtgccggttccacctttgaggcgccgatgagcctaaaaaaaatcggctcgatgcatcgagccgataaattgagccatcaagccaatcccatctaatacccaaatcccaacatttcgtcaaatccataaacacatgctatagtcaataatcctcagaaaaacaacacatcaagaacacatccatcaagaatacaacaagaagaatacattcatcaagaaccggatggagaggaggagggcgccactgccttctccaccgccacagacgtctccactgccaccgccgtcgtcggatggagaggaggagggcgccgctgtcttctccaccaccaccactaccactgtcgcgggaagccgctgtcgccacctcccgggctatcggaccaccgccgcctcccctcccatcgccaagccgccacagccacctcccctcccgccagatctggcggaggggagggcgccgccgctgggccatcggaccaccgccgcctccgctcccgccgtcgagccgccgcagagccaccgccgccacctcctctcccgccagatctagtggaggggagggcgccgccgccacctcccgggccgtcggaccaccgccgcctcccctcccgctgccgcacgacgttgcagcagccgcctctgggtcgccgcaattcggtcgagggagagagagaaagagagccgggtgaggtggagaaagacagagctaagagagaaagagaggggtatggataaggataaaatgaggggaggagaggataagatgtggaggttggttcggctcggctcggctcaaattttggggtaaaaaccgccacctataatttattataggtgttcatttttaattaaccagcacatataacatattaaaggttccggtttttataaaaaaacggcacctatagaataggtggcggttcttatttggaaccggaacctataattgtttaaaggtaccagttttttgtgaatgcaacccgcggaggtgacgaaaaggtctataagtatcggttttagcatttccggcacctatagtgccgacacctatttgatgttttatagtagtggagggtggctgctggcgagcatgatgaaaggagatgcagccagcaagcgtgatgagaggagggtgacggctgatcatgacggggaaacaagtgcgatggtcatgggtggctggataccttgcgtacactagtagagaaacgattttttcatgcggttaaaagtgattttcgtatgcggatcttccaaccgtctggaatgaagtatctgtaaaaatcgctatttttgtgtgtgggtggcgcacccacaagcgaaaatcagatttttcgcgtgcggggtggttatgtcgcccgcaggaaaaaaataaaaagccaaaaaaaaattaaaatccaaaaaaaaacccctaaccctaaagctgccgccgccgccctcctcacggtcgtcatcgtcgtcgtcgccgtcgccgtctgagcccgcccacccgtcgccacctccacgggatccaggtgggggacggccgctaccgccagatccggtcggggggcagccgcctccaccagatccgggtggggggcggtcgtccgccgtcgtgcgcccgctactcccgccttccaccgagcccgtcgctcccagtcaccaccaagcccgccgttcccgcccaccgctctccatcgcctagcaccgctgcgtgcccgtcgccgagccgcgcggtgccaccggccgcaccggagattgagagagagagagagagtaagagaggatagtgaggtgagagggtgagagaggatagagaggtcagagggtgagagagatagaaatgataaggataaggatgaggatgagtgcatgagatgaaattttgaagtgttgaggagggaaaaagaagaggatggatagacttgtaggtaagtgtttaagaggtccgcacgtgaaaatctgcttatttttgcgtgtgaacccttaagaggcccgtatgccaaaatcgattttcgtgtacgagcctcttaagggtccgcacacgaaaatgggaggccgattttttgcgtgtggatgtgaaaacagtccgtctgtaaactaaatagcttatcgtccaggaaaattgtttctacactagtggtagtcgctgtgctgggagaagtgcgatggcggggcgactgttgtgcaagaagttcatgagattgggatgcggctgatgacgctgatctctggtcattagaatataaggattagggagttagggactatggattggggtggattttggagtacgtttttagggcttagtagagaattggacggccactaattggcgcgcacacgcgtcagctggcggtttcacgtggttttttctctattattttcgctttttcttttttttcatctttttcttttttttccttttttcctattttcttttgtgtttttccccattttttttaattattatgacacgtgttttcaaaaatatttgagttgaaagtttttaaatcttaacttgaaagtttttcaatctgaagaaaatttcaaatctagagttgaaggttttctattcttgagttgaatgttttcaaatctcgagtccaaaatttttaaatctggacttaaaaattatctcaagttgaaagttttcaaatctcgacttgaaaattttcaaatctgaacttgaaaattttcaatctcaagttgaatgttttcaaatctcaaattgaatgtttttaaatctcgagttaaaatttttcaaatctaaattgaaagttttcaaaatttttcttacaaatttaaatttcgagttgaaaatttttaaattttgagtttcaagttttcaaaatttgaattcaaagtttaaatgttaagtcaaaaaatttcaatcaattagtaaaagaaaatcttccgaaaaaaagaataatcttatcttaattaccgtcattacctaaaactaattcagttagttaggagtttaatacagttagttaggcgctccgggaacacgtgccaccaacacgcgcgcccagttgctgccaagtgggttgctggcctactgattgttgagctcgcaagccaactcaaactggctgcctggcccgttatggaacacgagcataaatgatatcttgcctcgttaaagaaaatgctacgagttgagtcaagctgagatgacctagccatagaccgtattaacgataagcttttcatccatccatagttgggagggctcgggggttcgtgttcttttacacgaggggacttgcctttcttattttacattatattattgttactttcattgacagtatatgtgatgttcctagtgcattgtatttgacagatcgatcaaattgacagcattccaatatactaactaaaatatatttaaaattaacggaaaaaaactgaaactgcagcaaaatcttcacaagcgggcagaatcctttggtgactggccttacattgttggctgaaaagctttttcataggcgggttatcgcccgcctgtgtaaatggttcatttgttttcatatgcctttagttaagagatttgttccgatccaataaaaagtaactcgtcatacttacggtatcaaatcatttttgattgttagatggcagggtaagatgggtattgttagatccaacgatcgaaaactatttggtaccgtgaggtaccggtacctcgaaatactttctgatcgttggatctaactggacaaaatgagcattgttagatgcaataatcgaaaactatttgataatgtgggatatcggtatctcgagatacttgtttttaagatgggatcaaatctcttagttacatgtggtacatcgaaccgcatgtaaaacccattttcaaactgcatcaagaaaatagttttccgtagtgttgtgctaactgctaattatccaactgatttcacgcaggtttgtggaacagacaaggagatagatcgtgacctgtggtggtggccattgtgtgcgtgacggcaggagcaccaacgtcgacgacctcgaccatcctcacagcagtacgtgagctcgtgaggcaccaccgtccttacccgcgaacgacgcccgggcacagtgttatgacgaatgagtacgagttggatacagaggaagacacagtgttatgcttccttccccttgttttttatatatagggtgtgtttagttggggaaaagaaaatttttaggtgtcacatcgaacgtttgaccggatgtcggaaggagtttcggatatgaatgaaaatactaattttagaactcgcctggaaaccgcgagacgaatcttttaagactaattaagccatcattagcacatgtgggttactgtagcacttatggctaatcacggactaattaggcttaaaagattcgtctcgcgatttcccccataactgtgcaattagttttttttatctatatttaatgctttatgcatgtgtccaaatattcgatgtgatgtttttgggaaaattttttagggaactaaacgagcccataatatgttcacagacacagtaagtacggaggatgtaattaatgtgttgcccattgtatttcagacagccaccaaccacgagcacagaaaaccatgggcgtagggcatagtagggtagtagtggtttagtactacccagttttagcctctgtaccccttacatgtttgtgtcaaaatttggctaatagttagtttcatttgagaaggccaaattgtttagaataaccggtgcattttgagtgatttgcttgagaggtcaattgagattgtgtgtgcaggaatttgtgatgcatggagagatcgtgtgtacaaaatgatgggtggccgtagcatttcatctggtttggagatggagagcagagcagcactgcatacctatgcagagtgccgtgtagtgcatgcagcgatagatggagcttggtttcttgtgtctttagccggatcgtattggtgcttgatttctgcaatcatatggaggcatggcttctgatcacatgctgtgtggatttgctggtggaatatgcgaacggaagggcgtgtgcagatggacgctggagatcgatcgctcggctgcattgcatctggctgcgcagggtgccgtattgcggtgatctagactatggaagatatggaagatagagatattttggtagttaatttatttagattaaatcgtattaggcctggtttagttttcaaatttttttctaaaaacaccacgtcaaatctttagacacatacatagagtattaaatatagattaaaaaaactaattgcacagttagggagaaatcgtgagaagaatcttttgagcctaattagtccataattagccataagtgcaatagtaacccacatgtgctaatgacggattaattaggctaaaaagattcgtctcgcgcgtggtttacaggcgagttatgaaattagtttttttattcgtgttcgaaaactcttcccgagatccgatcaaacatccgatgtgacaccaaaaaattttttttcacgaactaaacaggccctagttaacttgctagagtttccatgtacgtagggcttgtaggtccggtgcttaggtctccctatatataccggggtattagatcagattgaagaccccaacaatttaatctattaatttcatgttctttactttaccgttactttttattttatttttatggctaagttctagcaaccctaaaatttagttaatctttgccttttgcgttgaaaaacggttgtgctcctccacgaaagcgagaaggttatcctttactagtttgctcggaaactactcattcgtcgtcacgtaagtacgatgttatcttctttactaatttgctcgtaaattagtcgtttgattccaaaatataaggatttttagacccagacacagtcttcgagatgttactttaaccaacaatatatataaaaataaaatattttaaataaaaagagttgcatattataatagtttgattaatgataaatctagtaacatcaattttacatgattgatcctttaattttttttactgttaatagtcaaagttaaaaataattggcttggcactatactaaagaaacctatattatattttagaacggagggagcagtggtttaggactaaaccagttttagccccaataccccttacacttcttcttctcgtcagtgtgagtggtactataatttaactgatagatatggaggggacttcaactcgcctgaacatagcatagacctgtctgacgatagacactgtagtctataggagatcgacggattgagatcaagtgcggttgctattgtaactgcacaatagtaactgcacataattatggccattcgttttcagatccaacggctctagataactgctacagtgtgagcataacagtgcatccatgctacagtatttttgctacagtaccacttcatctcctgactctagatcatgtgatgttgtgatgcacatgtaactgcttaagttacggttataataacgtataacgactgcacaggatcctgatccgagatcgacagacacactggccagctcgtgacgatatacacaggaactttttgacatgagcatgttcagaggatgacgcattgacgctctgtctacgggaggagaccgttcgcacgttttacggcctgtttatgtcttgaacgaaaatttttgactttgtcgcatcgaatatatgaacatatatatttaaaatattagatgtagactaataacaaaataaattacagattttatatagaaactgcgagataaatttattaagtctaattaatccattattaacaaatatttactgtagcaccatattatcaaatcatggcacaattagacttaaaagattcgtctcgcaatttacacacaatctatataattagtttttttatatatttaatactccatacatgtgcctaagcattcgatgtaacagggtgaaaaatttttgtctgggaactaaacagggccttagccgtgatgaatctaaaaagcaaataagcacttatcaggaatttatatctaaaccttactatattttatatgaatgttttcaccgtccagcatggaaggatggtactaaattaatatggaccgtcgatacaagatgatcgaacggctgcctaagaatcaagtacttggcggtaccggcacacataccgtctagtacaaaccctcttgagggcaaaattgtactttcttgtttattctcacagaagccacatcctgttgaatatataagcacatgatgatttaatttattccataaataaatcaagacattgcatagataaactagtataatcgcatcatacaatctacacttgtaaactagacagtaaaccataaacagatcgtatatgcgaaacacatttaatgtgcaccgagggttttgaaagatcggctgcacaacaggaataagttgcggtaccgggcatatacgacagcacgcagcactcgagctaagtggaagatgagctgttatggactaatagcaagcagtcgcgcaaagcgcttcccaaaaaccttattgtcgccttctcccagtgcaggacgtcgaaggcgaagattccggtgacctactctcccgatggccggtgagcaggatggagtagactatgagcgacggcgcactacagaggaggagacaaaccctatattgatttcgtgtgtattgcttggatgcagcggctcgctttatatagagatattacaacgcttgatcagggcgccttcaagatctacaccccacgtaaccgaaccggataagtcatgtctaatttatccggactccacgcggctccacgcaccggattattcggtgtgtttccaaaaaacaaaccgaatttcctgcaacaaaacaaaactgcaaaaggagaccgcatctacgcaagggtgaggaacaaattaattttgaccaacaattcgacgtgtatgtcgttgttgatgtgaaaacacgacggcctgagagatctgcttaactctagtgcaggtccacggctagcctcgagtgtgtcaagggtgtgccagctgatttgattctgtaatcagcaagaaagacaaaagtagagttagtcagccgatagccgactggccgataggccgatagggtatcgttggtggtctcagccaaagttaggcccaccaagcccaagtcataccatatcgatagtatcggccatcggcttcatcgaccttgatcaactcatactctatgtatagccgatacggtgtccagccgatgcgcaatctgactccaaattcaactcgattccacaccagatcctcgtcgatcttcttccttcttctccgaacctgacgcaaattccattgttaacagtcgtgtacgtgcctcgcctcgccttgccaggagagggagcacacgcgtgtgctcctcttgttctctccaccagacatgcctcaagtagctaggagagcatcctcccttataagaaggtctccctctcctagaataggcaaggttgtactaaactccccatgcatgccatcccatgaggtgggcttttgtgattttcaaagaattaatcttcgaatgggctaaggcccatccactaattccaacaatcccccactaaatatcaaaatcccactgggatttgccttattccaatgtaccgcttatataccagcagttcaatggagatggattaaggttgaacatctacctacaactccaagctacacttactcacaacttgaacaatggactacaccttgaattgcaagtcttgtgcaagtaagtttcactcagagtcttatctggtactacaacgtgagtagactaccctcgggtgtagcgtataggtcatactcctttgtctcatagtaagcttcctagaagattcacccaaaatatccgtagactgcgaccaacagtcaaggtcaaaaaggtgcgttctttcaagaatggtttgtaggatagtatcttcgctaattaaaggcaatagaactcattaaggcatagccaacctgccttgtaactcatgagagtacatgcatcttcacttagagaaggtttagattgatagtctcctctacttaactaatggcttattcttcctaggttctaattcacgggatctccgatgacatagattgggttaccgccatagcataactcacttgggtctcaagcccatctcctttgatacactatctatcacatttcatgatagtccattcgtgaaggaatctgccagggttttagctgtttggatataattcaatgttataatctcggagt

SEQ ID NO: 81202 - DNA, 1348 bp, Oryza sativa
cccatagggtgttcaaccaggattccttttggtggagggatatcattaatctctctgtttttttagggtgattgcaaggtgtgatttactctatgggacgaccactctcttttgggatgatacgtggaatggtcatataaggagtaattcatatccaagtctatgtactcatgctattaacaaagtttagtcagtggttgtcacttgttcgaaactcatgaggcttatatggaattcctacagctcagagcggaacttgatagtttaactttgtcccatcagcaaggggataattggagcttcattcggaagcgcaacctacacctcaaaatgcttttacatgctgaactttgctttcatgcaaccttcaagaccttttcactggagatggaaaacaagatgtgtgatgaagaacaaagtctttatttggttgcttttcagtgataggctgaatacaagggacatgctggatagaaaaaaatgtgctcctctgaatgctgatcttatatgttttctctcttctttgcagcatagggaaacctttatttatctctttttttcaatgccctttcagtaagagatgttggcataagcttggaatatcatggaatacctctttggaattctttcggatgttggtcttggcaagattgaggtttaggcataagggtttcttggaaatttgcttcatagcatgttggcatatttgcaagcaatgcaatgggaagatttttcagaatatttgtcgatgttttagatcacgactaaggtatttgcatggtatggggatcattggtaccagagtatgtgtaagattgaggtaaaagagacggaaacaaggactttaatacaggttcgggccccttattcatcagaatcaggtaatagccctactcctgttggctgaagccggtgttgctctttttcatcagaatctacaagtacaatatttgggataacctatctaatcgttgtcgacttggcagcatggaacaccaatatgtagttgacgacggggtagttttcctccttaaatacgcactcggcgagatcagagatagcgctagatccctcttgtcagcctctaatggcaccaaattgggtatgtgttgatggtccttaaattataatatctgaccgtcaatacctgcatataatggaataaaatatcgtattcaacttagtggtagagtttattactaatcatttccactagtgatggtatatattcggatggcacctgacaaactaacatagttcagaggaaatatgcatgaaaactgacgataactcaaacacatctccaaacttatggagttttggaccccaaaacccaattaaacacctc

SEQ ID NO: 81203 - DNA, 6476 bp, Oryza sativa
tgttatttaattactttgtctaagtaagatagattttcatctttgtgggttcattgcttagtattcatactaagtgctctaatactagtgtaggatcgaatcacaagaactaagccaaccagaggggggggtgaatggttgatatacccaaaaaccaaaacttttagcggaaataaaagttaccctcaaattcgatggatcgtggactgactgaaggtgttgcgccggtctgaccgcttgatgaacatcggtctgaccgatataaatcgatcggtcaacccgccgagattgcctgctgccgtctgaaaccgccgccggtttgaccgctcttatgccgccggtctgacctccgccttgccgtcgatctgaccgccggtatatcgctggttagaccgccgaacccgaagaaacacaaatcgaagaactctcaaagtagatgacaactttattgcttctctttgtgtttacaaagtgcaccaacagcactcgttacaaaaatctcaagtaaactcgaaaccctagctaaactagcaactcaattgctctcaaaagcgataccgggaagcctcacgctccccctctatttatacatgaggtaggcagcctaaagccacgaaccaaactcatactaagagtcctaaacaccttaggaaaccctctagtacaaggaagaaactttacataatcaatcgtaccaaatttggactccttccaaattcgactccgcatcccatactcacacaatacctccatcgtatgccatatggaatcttcaccaaccacgtgcatcaactctagccttagtatcccgcatgatatctgaccaccacggacatcgtcttaccaccaagccgactcccgatccatcaccgcaaatactctcccgaggcattgagtcacctacacatgaaacaaacaaagaaaccatattccgagaccaagctatccccaacttgagtcattagtagcaaataacagtattacatacgtatagtatccatctcgaagccataaccatgaaacaatcacggatatccaaagaaacaacccgaaaccgataccaacacagcgtcggccggtcagaccgcgggcctggccggtctgaccgctcaacacaagccggtctgaccggcaacctccgcccggtctgaccggtcccaacaaaaccgagaaaacagttatatccagaaccacttcgacagtaatctccaaatatcaaaaccaataatcatagatgccgattgttcatcacagaataagaatcaaaacacactttgatcttacaactagcactttggataaagaaggaagttcctgtacaagtattagagtagtaattaataacttagacgtgatgtctaggttagagattacctctgtttgttgtgtatcccacagatttgtcagaggtagacggtaggtggtgacagccctgaatcccgtcctagtaatcctccgcgttcagatacatcatagagatatagccggaaccatgctagcagactagcaggggtcggtacccgaagcaatagataggaaattacctttaacttatcttggataattaaaacaaatagaaagtcctctctagcctaaccagcctacctatagttgttgaccttggatagtcttagccttaggtagattacacgcgttccctgagttcgatatacttttggggtcacccgaagatgatgtgctacatcagtattccatcgcttgcagatttatctgtggtcgtaagaaataccaacagtatgtctaggctaatcttttatgatgatatctggcggcttgtattgttgtatattttgactgagcctgttgattaggcttgtcctcctattaacattgaaatttggtaagtccctaagagaattatcacaccgccaatagtcggattcttgctatattcggtgaatgaaattaatctattaaaggaagcttatccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacctgacgcggggctgcatctgttcagttcgatctccggcgaatgggtaactcctacgttccgccggtgcaggcaattgtcttgtttacgttggtgtcgtttaaggctgcatcagtacattcgacctcttggattgctccggtttggatgatatatttgtctgcctatttatcatatgtcttagttagtctaggcttagtatctcaatttagctctatcgattgtctctcgctttagggtttctgtcggtatcggctaaattgttttacaagattagattagctaaggcatctaccaccctaaaaatcagtcaagggcttaattttctagatatgatgtttcttttcatacttagtgttgcatcagttaagtttgatctactaagtcgtgtttagaaccataatccctagcctgctttttgactgccaataagggtttcatcgggatttcagccgatgagttatctggatgttgcatcggcttacaaggattacatacaagttggatttagctgatggcaacaaaaatttcactgtttaatctaatattgtggatttatgacattggacctccagccgatgtatgctttaaccttcggatcagtgcttattctatcatgtcattgttagccgattggtttctactagattatattattgatatattatattatcatcagtcgattgtctttatatcattatccacattgggtatatagcagattgctcaaaaccatatcgctagcggctggtatcggcatcggctggaattattcctttggtttgacaaccgatcggctcattggtctactatttgtatatcttgtcagttgcagcaacaaactgactggcacgcccgcatctcatcaacctttggacctgcactggagctaagcacatctcccaggccagtgtgtgtttttcgcatcaacacctcccctccctaggaggtcttctatttatacccatagatgtccccttgtccaagtagaagtagagagacaagtatggatataatccgagtagtccatatagtttccatgtagaactctgcttgtccttccttatccggaactccttctatatacgaggtatgattccgtataaggcttcgtacaaggtgggccccgctgaccttaatcgactaatattgggtatgtgttatccataaccatgacaatattgatccttcgtttcacaattggtggtgtgctttcagaaatgatattcttctacatatgtgtaggacaaataaaattcttaaacaactagtttttgattggttgcacagcatttaatttcttttctggaggtgtttacctcttgtaacattcgctgtaaatatagttttttctcttttacaaaattacactactggggaaatgtctggtagcattcaatttcaaaaaaaaaagaaatacataacatctgatccatttgatatagacccaaccaacatgattctatgtaagccacataatcatctatccaccaatttcactcgtttaatgggcgccaaattctggtacttttggggtcatgatgctaagaagtatactcattggtctacttctattttgttgtgaaggtagatagcaaagttattaaatttgtcaattcccctttgaacattatgtatagtacatagctagttatcaaatgtagatcacttcaaaattgtttgtggagaacaaaagcaaattcggccacactacatacagtcaaatacctcgatacaaattcagccattgggaagttaattcagccaccggaatctaagtctccatagactacatagaacagaacttaacacaacagaaatcaaatgaagggtgttgtgtccctgatgttgcagagcaagatgcagggtgccgagagcccgagacgcgatgggggaggagactgcggcagcagcgacacagtcacgcgcatcatgggaaatggcgtggggcttggggggtggacaggttcggtagtgttggtcgcaacaccgtagccacagagcaagtacgcacagcagggaggataggctgcggtggtggctataggtgcaggcggcgacaatgacacatgcgaggtgaggaaaccacattgccgcaagggaaggagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatggtgatggtggggctccattcctgagggtggtgacagggtgcttgaccatgggactaggcgaggaggtgatagggtggtatggcaacggtcacgattgtgggaggcgacgatagtagttgaggccagtcagccaggcggttcacctggatctggcgggggtggcacgcaagtggtggtggactagcggctctaattgctggttagcttggtgttctccggtgaagcggtcttggacatggccaactaatgttggttgctaagaagactgggctaagcaggggagcatcgaggtagcgagcggccgggtgagcgagccgggtgagcgcctagatccggtcgcgtggtgccaagggcagcggtcatggtggttgtgcttttggtgtggatggcaaagatggccctaggggcagtggctaccagattggtctttcttgtccagattggtcgagtggattgaaggcaagtgttgacagtccttaaatcataatatctaaccgtcaatgcctacatataatgaaataaaatatggtatccaaactagtgttagggattattactaatcatttccgctagtgttggtgaaatatatgtatgcatgtattttaaggagaaaacacatctgtcctgtgacaaaatacacctccggataatcaggacacgtttacatggattggacggcggaaatgctactgggcgggcgagcgccctcgctcgcccagagcgatcggttccccctcccccctccccctccctctctccacctggtttccttttttggcaccgcattactttcctattttagtaaatttatgcacctaaagtttatacacctcaagtttacacatttaaagtttagagaccaaaagtttataaatcaaaaagtttatatatccgattcaaatttgaatttgaattcaaataatttttatatatatagtatttctatacatctaaagtttatacacctaaagtttatatatccgattcaaatttgaatttgaattatgtccgattcaaatttgaatttgaattcaaatatttttcatatatagtatttctatacatctaaagtttatacacctaaagtttatacacctaaagtttatagacctaaagtttatatacccgattcaaatttgaatttgaattcaaataattcaaatattttctatatatagtatttctatacatctaaagtttatacacctaaagtttatagatccaaagtttataaatcaaaagtttacgtacccgattcaaatttgaatttgaattcaaattttttatacataaatttttctaactttttgttttttttaaatttttttgtggtgtactgtaataggaaaagaaggggaggaggaaggggagaaaggagggggggccgatcgctggatcgctcgcttagcgagcgatcgcccatcaagcgcccccattggagggcccatatgccaatcaaaaccacttagaattggcccaaatcatagcataggatg

SEQ ID NO: 81204 - DNA, 9105 bp, Oryza sativa
ccatgttgatctgtgcacatactagtactaggtgttggggttatattactgaatatgcatccttagttcaataagcaagacataattttcatgagtgattggccaagatagtatcatctaaaatttaatggactcttaataggataattcaagtatagatcagccatctcagtgcatagttgatagcaagaattatcttggatgatctacaagtgcatttgagttaagcattatatctgtatatagttcagtaaagccatcatagaatgaattttgaatgcatgcatagttagaaataatcattgttctatttaacctcaagaggttaagataactagataatatcactattgtgctactatttctagttaaataggcagagcctaaatgggtagacagtaatctatttctcagtatagacactaaataaagcatctaggatccattggcagaatcataggtatcaatattaggtcagctagaagagcagagcatatttagagaaaagaatgacatctattaggtcttgttcagttactagggattaaatccccaaggggaagcaaaccagggagggattgagtgaatcccaccatgtcacttaaaccctgtggggatataaattcctttctcctaatccctctattaatggaaaccctgtgttcggttatcaatttttttttttttgctactgatcaataggaacagccgaacaaccaccctacaatgcttatgtgcattaaaatgtgacagacatgtgtgacgaatgatcttgaaccaaaacaaaatgtaattttttaatggccgatgatcaagagcatcaatgcatatatcaactacatttgaatgctcatttcaactgcacgtttcgatatccgtaaaatcttttgctgatgagcaactgcggaatacatacaaatcttcatccaaaaattcgacacaaactggctgtcaacacgaactggctgtccaggttgtactgaaattctaaacaaatgagcatagaaacaaatgagcattgtactaatacccaaccaacagtgacccctccttccctgtgctgtgcacactgctcaaagaaaattaatgatcctactagtatctcacagatcattcgaaatgcaaatgcatgcatacatgttaatttaacctgtccttttcgttttcttgatcaatgctggggcaaaacatatttacaggtgcaggcttgcagctagcatgcatggggcaaaacagatttacagtgcaacactgtgatgagtcgcgattaaacagtcagatcagatgacaaactatgccaatttatgaaacaccaacttatattacctttttttagataattaacaccaacttttatattacttgtaacaatgaaagcaaagaatgccatgaaatataactgaagaaatcaagaaatccaacaatgtgcagcaatcaatcgatcactagagattagctagctaagctcagtaattaagagaaaggaattcatataagagccttcgcggagaactctatcagtttctatttggttaccgaagctaaatggacccgagctgttgatgaccgaatagaaaggtttattttcaatggcatgtcctagatgatgtaggctttgcttcctcagcattaaaccaatcttcaggattctcaagcgtttcagctatttctagatcaaccaaaagctcataacttggtttattcttcggttaccatatctttgaatgacaaagtgcccgggaagaaagatctagatctctatcatcatctatctctatatctaaatatggaagaaccctcgaagcctgtccccgacgacgatgccccctgggtgaaaggaaaggggccgccattctctttctttcctcaatcgttccgatcatttctctcattcccttttgtttgtttggtggggccccgggttggttcgtttattcttttccatgtattagattatccgtccgagccatatcaaattaaaaatatctaaaatcaaattcaatatagaaattggaatagattctattagaaaacatatatatatcgatcaaggatgctgaagacatcccagcgtattgaagtacctaattatctactggcccatccaagaaccaagggaggaggaaatctaggtgacacatcaatgggaaagaagacaaattcaagaatgccgctgtttacacccaaatttggcacctagggataaaataggaaaaattgccaaagtttggaaatctgccggtttcctccgagtgggccggtttgaccgccatgtgttggccggtcagaccgccggtcgaaggccagtcagaccggcggtatgtggccggtctgaccggtagagcccgagttcgggtctgtttcgccgggtctcgaggtttccttgctcgggaaggcatgtttcgggtttcctttgaattctatcctgagttggacgtggaggaggcctgtagagggcaagaccaactcctatataagggacatggccggttcaattataactaaccaatctacaatcaatcaatcgaatcgttttttatattgcttttagttttctcttagtttgtccatctttgtcgatttgtgccgtaaatcgtccgccgccgctgcgagagtgcgacacctctttgtaggtttgtcctgaaaaccttccgttttgcccacgagacgggtagttatctagaatcggctctgctagccggttttgttatcaaaacccatcttggtttagcttttgctagatcgaggtggttggtgactctaggatcaccgcaaggcatttaggtgctgcgatcgtgcttgtcaacttgtcacaaaaagttgccaacacgatttttggcgactccactggggacatctgctcaacgtcaactcaacttcgacctcaccatgacgaagccgccgtcatccaaggcggaggtggagctggccaatgtgataccaatcatatttgatgatttcgaaggggaagatcgcaagtccatggaggagtacattaaggagatcacacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagccgtgtgcgccgctgccgattcctccacccgattcgctcgattctctgagccgtttcttgaattagttgaggggatttgtttcccttatcctcctctatctcttcccccaaaaaaccgactttatccctttgaattcgacgcgaatttggattcgttttcgagtttatgtctccaccaaaccctaggttttcccggcgcgattccttgcgttccaagcctgatctctctctcccgtcgctataaatagagtcccctccctctcctctttcggccgccacctctccctctctatgccatcgcttgtagcgccgtccccgtgttcgccttctctctccgccaccggcagctgctccagccgccgtttgccgccgcctcagctgatgccctcctgtgccgccacctctctcggctctgcaaggtcaagagcaagcccggcagccgattcccttgcaccgaagacccagggaagcccgtcgtcgccatcaacccgaagctcgccgtcgtgttttgatctccggcgaggctctgctgctcctcccgtcatcgccaagcttcgccgccgcctccattggattcgcagctgcgaagtgaagcctggccacccctgcattgtcgccgaaggtcgccgaaacactgtcgccgccgtggacagtacctcgccgccatcccgttctcgtcgccggccatcttccatcgctgtccgtcatcacgtaagtgttggtaagaatttccatcgccttctctacctcccggtgccctccgtttgcattattgtgtcgtggttcgccggcaaccgccgctcctatgtcgttcaccggtgtagtttatccctagggtcttaatccaatataatccaatccgtggttggtctagcattgtcatctccgtgtgttgctgccggaacgttgtcatcatcccttcctctccgatcgctttggttcggtgagacttctattcgttctctcttttcaatggcatattatttctttttaatatatgtcatctaccaaatataatctaatattttccggaggttgttttaatcttttctctcagttataaatcatttataaatggtttaattaatttggaatagtcttttctttaataggtttaattggaattaaatcttgtaaaattcgtaattaatttatatgaaatcggaatgagaccgttcaagtctcataattcatctaaaatcatgatctacatatttgtttacttttatgtactgtttatttggtttttattagtctttttctttgttttgcgtgttagcttgtcgtttccgtcgttgcgaaggcaagtcacacagatcctaaacacaattcctttgagcttgttgatcctatatttaaattctctatttatttcaactgtgcatttattttcgaatgtcatcgggtggtgtgaacctattcctttgttatggccaatttgcattgaataccctattccttcataccttgggtaacaaattaattagcttgaaccttatatattggtttggttcagctaatagctatatatatatatgtatgtatatatatatatgtatatatatataaatgtatatatatatatatgtatatatatatatgtatatatatatatgtatatatatatatgtatatatatgtatatatgtatgtatatgtatatatgtatgtatgtgtatgtatatgtatgttgtgtgtgtgtgtatgtatgtatgtatgtatataataattgcttagccatgcttagaaacattagctcattaatgggatgaatcacactacattattacttatggttatatttaattgtagctcatgatggttaatcgtgttatgataattaactgataattaaaatttgattaatggtgggttgtgagcacatggttttgaaggtcgtgctcatgacaattaaggaccggtttgcgagctactgttgtgagacattaaccgtaccaactacaagccagcgtgggcaacggctttaccttttgtatagcatggttctttacggggtgctagactgagaagcggtgagaagtccgtgggggtcgctggggagtccatgcctctggttatatttatagagggggtgattatgatccaggaatggtgcattgtggtgagttgtgttgtgcagagggtattgtcacaacctctattcgggtactttccagtatcgcgacgcatggtagacatgatgttgaggctgtgtcttgtgggtatagtggtacacctctggccagagtaaaactattcgaatagctgtgcccgtggtcatgggcgggttgagcaatgtttttcgtgattagtctcacacctctcacaataattattgatgctataactggtaataatttgtttagctcctggtttggagttagatctgtacagccgggtatggttgttcagaatggttgggcctgagcagcatgggcgtgttgttcagtgttgattaaaattaatgattaaattagtttattgttttactactcttaaatgtttattaaatgctgcttttgcaaatgagcctatattatgccattctttggtatccttgtgcacttgcatatttgctatgtggcttgttgagttgtcatatgctcactttgcaataattaatcaacctcagttgaagaaaatgatccagaaggagaagacgtttggcttataccccagttgagctgcctatgggagtggagccggagcttcgctagaccattaattttgctgttgttttcttttcttttgtaagtatgtaacgatgttattatgatggatttgtatattaaattgtcagtttgtgtgcctcggctgattccgggacgagggttttatgcacaaataagttcggaaattgctagtgagtttccgggcgtgacaccaagtggtcatgggactaacaaaaacaagccttttgtttgttctaatttaatgccgactcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacggccggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagacatggaggtcaacatggcgtgtatgttgcctatggagttttgtgctatggatgaagctgaggttgctcaattttcactaggtcctaaagatgcggtttttgagaagccgatgagtcaaaccgtcatatgaagcctctctatctcaaaggtcataaggg

SEQ ID NO: 81205 - DNA, 23299 bp, Oryza sativa
atctttagtcccggttggtaacacaaaccgggactaaagatcaaatacgcccgttacccttttgaaccgggactaaagatcatctttagccccggtttttattgcatccgggactattgtggaaatcggccgaccgacgaaagatggtttctccaccagtgtatgccgcttaatagctctgtcattcgagctgcatgaacaaacacaaaccttagattctctatacttatatttcatataactcttaacatttatttttgtagatataattatattttgtatataactatatcaattagcatatacgtatatttcggacccactatgatttagcagataagatgttttttcttttaattaatatgaaaatttctaacatccatagtgaatgtagtagcttgcttctaaactatgttaatctttacctattgtaaattcgacacgactgtcctcgatataaaatggcacgacttccgcgtccactgtacaatgaagcatcacaagtgaaaaattactcctcactttcacttgcaccaaagacaagcaaacaaaaacacttccactgctcatgcatacaggggtgactagtcgagctgtggaagccactttcactgcaccatgtctgactcagtctgtctcggtgagtgtcctagcctgctgtagctgtgtctagacactatttagatggaattaaaactttttagtctgtatcacatcgaatatttggatgctaattataaatattaaatgtagactagtaataaaactcattcaataaccctggactaattcgcaagacgaatctattgagcctaattaatccatgattagcctatgtgatgctacagtaaacatttatatcggagaatttatagaggaaatcggattttaaatttccagaaatagctctcatttatataattagttttataagtagtctatgtttactactataagttcatccgatatgatagggattgaagtttaaagtttagtccctcgatcagacaccctaaactagtgatagtagcaaagggcattatgggattttattatgttacagtgcatgtcagcacgtgtcatcttcaggcgtaaaccatatctacctggcgctaacaactctggccgctcccttcacatatcaatgcccgcgtgaatcttagcacggtcgtacggcagagattataggtacatatgaactcgagcactcgagctcaaatatgcattttcatatatatatatatatatacacacacacacacacacacatatggcaccatggtatgaaatacataaattcgttcaaattcttcaaaatttttaaattgtgagtacatacctagttataagtattcgatgcatatctatacatagcaacaaaacaactcaaattgaactttatttcacaatccaatattacatacctaactaattatatgttcggatgctatatacctagaatcaaaatctaacaaaaacaagttcaaattcagttcaaacttgctttgaactagttattagttaatgttcatacctaaatatttaaaaaaatttcatactcatttgaattgggtatatacttaatttgaatcatagtgcccggacaccatgaagcaccaaacaaattatttatatatatatatatatggaacaaatatgaaccaaggttcatatgaaccacagatctcagctgttcagatgttccaagatgtatgtccaagctgttcaaagttatcacaattgagtggtacttgggaaagagttaattacttaattgcttaagcagctcgctatggtacatatgtagaggggtgacaagtatggctatgttttgtcttgtcactgaactttttttgaccaagtagaacaggacattgcactgcttgctccataaataaagacatgacaagcttagtggatgtgattggggttgagtcaagagcattggtaagaataattttataaatttgtttctatttttgggtgagtgaatattgatagttaattagttgctataactgatttcgcatgtcagatgctattcttgaaactggctttttactaatcatatattagtgattttttaatgtattagtgttaacttggtcggattagcatatatatatatagtttttttaatctattagtgttaacttgctataactgatattttaatgctatatactggtttcgcatgtgaatattgtttcttttctcttgttatccatggaattttaatatacatgaccattttggaaataacacacatgtgatttttttaaatttggatagatgccaaggatatgatatcattttgcaacgtcatttttagacctcacttttcaaaatgatattttcgttgtatttcattttcggcgttaacaaattgtagtgtacgttattttctttgtcgattacgaaattatattttgcaatgtagcatatatatgtaaaaataaaaatcatgtgtttttatatttttaatatatgccaaatgatatatcatttttacaatgccatttttggatataagttatattgtaacttttcaccatgatacaacgaatctggtcaaaagctaatcatgctttttttagtcagatttatataatatttgtaacaattttttttgacattctgacctgcaactataattttttaccaaaaggtacattaccattaatgttttaaaatggaggggacgcagagttttttttttgtcgggattttttttgctgtaaaaaggtacacctgccgcatgtgcagccattacattttgcattcatatcgtgcatgtgtggggtcgccgtatagcagcctgagcaagggcaaaaattgagaacgcaacatgtacctatctaaccctgcaacacacagccgtatataggggctccatggggcaggtacatctttgattatggttaccagacataataaagccctagatgtactggaatatgtgtacacgtgtcgctcaaaggaatgaggtgcatatacacctcggttcacattatccaactcctactttattcatagacattcataacaagagggtaataagaaacatttatcacaaaaacatttatacatatataatatctcacatttaacccccaagaacttgaatgcacatacaacaaatagcttcacatacatcacagcttacatatatccataggacacaacctccctaatgcacacatcacaggttacatacacccgtaggccgaagcctctaatgtactccttggctgggcttgagctcacaaaatgcaaactgatccagccaaccttttgacgtgttttggtacagatcaccaaaacatgaaaaacaaatcaacgctaaggttcaaatccaaaatagtccaacatagcagcatagcctaggtaggagcaaccattgttaagttgaatatgaactccaagattgctttcatgaagagctatatcaggatgatagtgtattactacaaaaccatcataggaatcggtcttataggtgccagttcctttaaaaccgacacctattggtcatttcccatctccacacgctgaaaatgtaagaaccgacacctttaaggcactataggtgctggtttattagtaaaaaccggtaccaataatatattataggtgtcggttcttttaaaaaaccggcaactatacaaaacgagccgagcgtcgtatctcacctccttatctaatcccacccacatctggtccttatctactcgactctctcgcgctctctcactctcgcaactctctccctcccctttctctagcggcggctttccgacggaggctgctcggcggtggcggcaggcttccgaggcttgcggctgtccggcggaggcggtagctctcgctctcgcaactctcccctccccccctatgtcacgtctctctccctctcctctctctagcggcggctgcccgacagaggctgcccggcggaggtggcaacggtggtggctgcggcagccgcaccctccctcttccggatacggcggctggggaggcgacggtctcccgcggccagcggttgcccgacggaggcggcagaggcggcagccgcgccctcccctcccgtgggccgcggcgctccctttcgccagatccgtccccgacgtcttcacatgcgagtcctccaccaccgccatcccggcgacgctcaaggggaaggacatgacccaagggccccgtcgccgccgcatcatcctcaacgccgtcgactcaacgggttcgagtatgttctttttatctcgttcttgttctctttgtttaatttctctcaagttctcctgttcatatgtgtaccgagaacatgaggatttggatcagatgaacattataattaaatggatgtaggaattgttgttgttattgatgtcttctttggattttgattttggatgtggggatattgttctggatctgaggatgtggacgggatcacgggatggggattggggagggtttcggctcgattcaagctagttatggattcggctcgatttgatctggagttcttttttttttggctcgtgcagacaaaaaggtgtcggttctattttacctataggtgccagtaccagcaataggtgccgaccaattggtgccggacggaaaaccggcacctattgccagttcacaaccagcaccaatagggctttctgtactagtagtgatatgtaaaatgaaactttttgatggctgctttttgttgtaagtggaaggtagcattaattggacctaaataattctttttgtagacatggtgcttgatatccaaaagggtataacacccatagaacgtgagacagaacatcagacatgtgtttccataaaactcatgttctaacatgacaattaacatatatcaaattctgacaaaatataactatgacagtttatagttcatagttagcatcacaagatctttgatttattgcaaaataaatttactaagttccagtcctttctaatctgaaataagggaacatccttgtgatctaatcgtgctgtggatttatgataagttcactgaccttgacaataagggaaaaagacagatgttagaactttaagaggacttgtcgctgtaggtgagttgaactttgcaattgtggcagaccaccattgccgcatcctcgctagtgcagttacatcgaggacttggggggcgtggcttggtggacggcctcctgggtctccaagcgcattgtgccgccctttggacagaggaagagaacctcggtggctgtgaggggatgaacgacagaccagaaccctcggggtaggcatgaccaaatctagcgcctcctaggtttggggcagccagatccgattcctagctcccatacaatctccgggctagctggccctcctcgccattggtgatgatgtccttgcttgtgtgaggtgcggtggctttggcagaagagaagaggaagggccatgaggtgccgagtgttggacaccggtggcaagcatttctagcgaggattcatgtgagagggatatgttggaattagtgcatgggcctcagcccattcgaagattgattctttgaaaaatcaaaaaaagctcacctcatgggatggcatgtatagggagtttatgtcacgcccagaaatatacaccattttccaaacgctcagtgcattaatcctcgtcccaggaggtgaggtacacatagatattgttgattattacaagccaaactttattacatgggcgactctaggccctcacactcaaagataaacaaataaaacagcggaagaatacggaacagcagcagccacaggcactcgacagcggagcgaactagagatccaagcattcatcttcctcagatccatcctctggattatttttgtgagcaagagtgagtatcaccatcgtactcagcatgtcacaccggaaatgcaacaataatgcataggggaaacaaggaaatggctgttctaagaaacaataatgcaacaacagggtttatttgcataaagccatagtttaaacattttaataaggttaaagctcattttaaaacacgatcctgttctaagccaatattttaatatcatcaaggtctcatgagcctgcgaacctgccttaacccaggttaatttccacatgactacatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagatgtagataattcctctcaatcaataaagatctaagcagcggaaaataagataaacggcgcagacggctccacttcacaggcagcttgaccagggctacgcctaatcctccccaccatcagcatcactgtagaactcttcctctgatgaatgattgcaaggtgagtatatgacatactcagcaagccacgcagcaaatatgcaagtgcacgaggataacaaaggatggcatagtagggttcatttgcataaacagcatttagtaaatatttcagaatttaataaaatagttaataattaagcaatattaatccaacgctatacaacataccctgttgtataggcccaaccattctgaacaaccatcccggctgcacagttctatctccaaaccaggaatataccattccaaaccaagagctaatcaaattattaccagttatagcatcttttattatggtgagaagtgtgagactaatcacgaaaaacattgttagacccgcccatcaccgcgggcacggctattcgaatagttttactctggccagaggtgtaccactgtacccacaagacacagcctcaacatcatgtctaccatgcgccgcgatactggaaagtacccgaatagaggctgtgacaataccctctgcacaacacaactcaccacagtgcaccattcctggattataatcacccccttataaaacaaggcatggactccccagcgacctccgtgggcttatctccaccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcacgactctcaaaaccatgtgctcataacccaccattatgaagttttagttggcaagtaattaattaaccaatcacgattgaccatcgtgaactaacaataagccatcattaaataatagtgaatcataagttatcccaatagtgtgctaatgtttctaagcatggctaagcaatcacatctaatatctagctgaaccaatatatatagcccaactagtcaagttaaaataacccaaggtatcaaggaataaaggaatcaagaacaaaaagggctataacaaacaataggttaattccacccaatgacattcgaaaataaatgcaatagttgaatagaaacaattgctttaaacgggatcaacatgctcaaagggttgtttgggatctgtgtgacttgcctttctggccttggaactcttcaaattcttctcctgcgaaaacggactctccggaaacgtcgaaatctaaacagaaaagagcaaaaacaccaaaacagcacataaacaagcatgaacagtacttgtggatatttttaacatgtagatctcaattttagaaaaatttagagacttgaaccaactaaatccgagctaagatgaattagttatgaatttttaaagattaaatcggattaaaacacctatatggattttaatggaattatgacgcaataatgaattatttttgaaaaggaaaagagatttattgcgtcagcggctagggtttgcggtggaccgggcgcacggcagcggttcacgggaacggacggccgagatcgatcttatccaaaacgaacggccgagatcaaccgatccacggccgggccacggcggacggtcccgatgacgtcagcggcgacgtcatctccggcggcggctcgggagcgcaagctcgccggcgaacgacggcgctacggcacaaacggagggcaccaggacgtagagcgcggcgcggtgaactcaccgatgaccaaaacgacggcggaagatgaacggacggcggcggcgtcgaggaaaaggcggcggagtccttcggcttgacgacgacggcgatgctccgtcagtctacagcggcggcgaaagggcggacgaggacggcgacgcgacggtgaccacgatggtgaccttcccgagcgacggcgacggctggagcgacggcgaagcacggctggagcgacggcgacgacggcggctcgaggttacacggcgctggggcgcttccgacggcgagagacgaaggcgagggtggcggcgggtagcggcggacttggggatccttttataggggcaagaaggcggcggcgaaggcccacggcgaccggcgatgcgaaggaaaggttagggttcagaggaaagagaccgatccacggatttccaaagcgatttagacgatgattccaaaagagaaaaggtagagaagatcccgaagatcgtttcccctctattgatttcaccggagaaggaaagacgcggccgaatttggaaagagacggcggcacggctcgactaggattcgggcggcggtggctggaggtagacgacgggtccgacaggtgggacccacctgtcagcgactgaacgcgcgcgcgcggtggctgcggactgggccgagttgggccggggagagagagaaggttttgggccgactttcggcccaaagccaaaagagacttttaaaaacctttttcaatttaaattattcatgaaatgaaattccatttattaaaaatacttccttagctcaaataaattccagaaaaatctaggaattatagaattaagcaaagtatttaatgaaattttatctggccccattttatattggaatttattaattaaagattagatcttctcttctaggctttttttaaaaaataaattctaataattccaattaaataacaatttatatattttggatttttagggtgtgacactacaccatcatgacttcaccctcccaaggtttgaaaaaacaagactaacttttggtacattgctcagcttgcccataaccgagggtgcggatattcgaatagttttgaactctgatcagaggtgtacaactttgcccataacctcaacacgtgttgccacgtgccgggtaccaccacggtactcggatagaggtcgtgacaagactatacatctaggactacccaaaacaggagaacccgctgaggtttcgttgcccaccggtccccgatgaggagacaggccctcccttgcatcgggtgaaaatcggccttaatcctggccccacacccttccaaccaatggtatctcttttgagaagatctaaactttcagtcaggccttacccactagacttgtgattacaagaagatgccttgcaacagaggcccgcagaccggtccttatattagccgtggtgcgactaccaaagtaactagcttgcaccccgagcctagcccaaaaataagttttagttacacaaaacattttatcccccatctattgacaaaccagtcaatagttaataactaaaccagttttaattgttaaccaacatagtctagtttatccaaaagttctaggttggaactaagcacaataagcatttacctaaagcaacttgtcagtccatcatgtagagtactagactagtcaggttataattttactagggttcacaaagatcatggatatcaaatcaacatcatggccataacaaagagcataggaattgttgtcgaaaggacaaccgcatacgtcgaaagacgtggttactctacagtggttggaaaacagttatagtatattaaattgagattttttcttagggatcccccttttatatggccctataggtctatttatacccttgttacaggcctccccattagggtttaggttttacaggggaatttacatggttgcccttatgaaagggacatttatatgggtatacagtgtaattgaggtacatgggcctctagtgggcctgctggcgaacgctggcccaacggcccccgggctcgatcgactgagatagcctcttgggcctccatgaaactggacttgccatggcgaagccattcgccttcgccacacagccttcgcccaagagcccagagaacagataactttcgtctggtcatttacccttcgccgccccctcaagcctttttttgagcgcctcgagaatcttgccattcgtgcgatctgccgccccatttgactgcgggtgcgcgatcgaagcgaacttgatttccagatttagcccttcgcacatttctctgaatttgttagagtcgaattgcttgccattgtcggtgatgaattcttttggtattccgaaacagcaaacaatgttcttccatacgaacttctgtactgctgccaaagtgatcgccccgagtggttcggcctcgatccatagggagaagtattcaatggctacaattgcgaacttgtacccgttttgcgccacagggaacgggccgatgatgtctagcccccatctggcgaaaggccagattggtgcgataggctgcagctcgtattggggcgcggtttggctttggccatggcactgatagctttcgcacctcttgacttgctcgacatagactttcagcatggtgggccagtatacaccctgtcgaaacacttttgaggcaattgttcttgtggcctggtgtgcgccgcagagcccctggtgtatttccttcgccatttcctcaccttcggcaaaggagatgtagcgaagcaaaggttggagcaccccggagtgatatagctggcccgagacaagcttgtactttgcggctctgagctgaaggcgcttcgcttctgcttcatcttctgagggctagccgttcgagaggtactttacgaacggggttcgccagtcctctgggtcttcacctagctctgcctagtcgattgccatgatgtctgtgctctctatgggcacacttggtgcgtacaggacctcaaaaaagatgcctggcgaatgcgggcctccacaagcagcagatttcgccagggcatctgcttcctcgttctggcctctaggtaagtgttcgaccgttatgccggtgaagcacttttccatagaccagacagcctccagatacctcttcattccttcttcttttgcctcaaaggatttgtcaacatgacttgccacaaatttggagtcagtccggatgagtaagcgccgaacccccaatgctttcgccttttttaggccccgcagtatagcttcgtactctgccgcgttgttggttgtgttgaactgcagccttgcggcgtatcgaatcggtacgccccctggcgaagtgagcactgccgcagcgcccgcccccttgtgcgaccacgagccgtcggagtacatcacccaaggttgttcgacaggctcaggttcaagggcgaatgccgatgtccattcggctacgaaatcagctagtacttgggacttgatggcagtgcgggcgacaaaatgcaagtcgaagggagataattccgccacccacttgctaagctagccagtaatttccttgccccggagcacttcgcccaaagggtactgcgatggaccgtgactttgtgggcctgaaagtagtgtttaagcttgcgcgaagccatcactagggcgtaagcaagcttctccatttcaatgtatcttatcttcgccccttgcaatgcttcggagatgaaatacactggtttctggcctgactctgtttcttggacgagtgctgcactgaccgccaccggcgaagctgctagatacagtagcaattcgcttcctggtgctgggctgatcaaagcaggtgtgctctgcagatattgcttcagctcgtcgaacactgcttggcattcgggtgtccaggtgaacttttccgctccccggagggtcttgaagaaaggcaagcctctttcgaccgcttttgagaggaattgactgagtgccgcaatttggcctgcgagctttttgtacttcgcgtacgctcgacgggggcttcatttgctaaatggcatcgattttctcggggttcgcctcgatacccctttcagaaacgagggaacccaacaacttgcccgcgcgaacaccaaagacacacttgtcaagatttagtttcatacccgcagtgcgtaagttgtcgaaggtctcctgcaagtcggacgcatggtcgaaagccttgcggctttttacgacgatatcgtcgacataagcctccacatttcgccccaactgcttgtaaaggatcttgtacaccagcctggcgaaggttgccccggcgttcctcaggccaaagggcatcctgaggtggcaataggtgccgaatagtgtgatgaaggctgtcttggggatgtcggccggattcatgtggatctggtggtagccggagtacgcatccaaaaagctcatgagtttgcagccaactgtcgaatccacgagttggtcgatccgtggcaaggggaaatcgtcgttcgggtacgctttgttgaggcctgtgaaatcgacacacatgcgccatttgccgttcgatttctgcaccagtaccgaattcgccagccactcggggttgttgatctcctggatcaccccagcctagagcagcttttggacttcggcttttgctgcttcttggagatcagcggacatcttgcgcagcttctgtttccttggcttggcatccggtttgactgctaggtgatgcataatgaggtttgtcgaaacacctcccacctcgtcggggccccaggtgaggatatcaatgtttttcttaagcacctccatgatgttctcaacttctctttcacctatgtcgcccccagcgatacaagccttgcgggatcggcgtcgtcgacctgcgggcttcggcgcgtgcttcgcccgatcatgcggttcggcctcaacattgtgcactgctctgttgatcacggccaaatcgccctttgatgtagttgaaggttgaagccccttgaccacgattgaccacgatcactcctgcagggccaggcatcttgagcttgagatagttgtggtgggagatgtcttcgaacttgttcaaggttgcacggccgaagatggcattatagttgtatgggatgtcgacaacgtcgaacaatatttgctcttcgcgcctgttgtcacctgtgccgaaggctaccaccagctgtacttggccttgtacttgaactgcttctccgccaaaaccgcgaagcgaggccggtgcttgggtgagggctagcgctggcaagcccatcttgttatatgcttcggtgaaaatgacatcggccgaactttgaaaccagctacctcggccgagatcaccagtgggtcttgatatgggaacagcactccttcggcatcttctggcccgaaagagatctgctggctaaggtatcgcggggccccttcgcccgccgaagtgatgttgtgcaccattcacagctgcatcttcttttgtcgttttgacggttgattcggcgggttggcccttgtaattacttggattactctgcgttgcccatcttggcgctgttcggccggaggtgcttgttcttgagcagcttcgcgaggtgcttcgacgactgcaccttgttgcagccttggatcttgtacattgccacgctgccgaatgtttcggtattgctcggtggtgtgcgaagagcgtccgtggaaggcgcagtaaaggtcttttctaaccttcttgcgaacgggctgctgatagctgcttgtttgttgggcgtcgaactccttacgaagggcttgaatttcttcgacagccatcacagccttgcctgcacggtcagttctaaatttcctccaagtcatgggagcttgacttggccttggcggttgtccttggatcgccggctgagattggtgaacggcgagaggagctggttcggcgacctgtgcttgtacttgggcttgagcagcggcgactgaggccttatcatactcggcttggatcgcttgccgccgcttggaatcctcttcgccccttgcgtacccatcaatgatgcgaagcaggtgctcgagtgtctacggctccttgttagtaattttgcctttgagcagcccgaccgaagcggcgttgatgacggacgcttcagttatgtcctgcacttgacatcgggcttacgagaagcgacgcatgtactcccttatcgactcccccggcctctggcgaatgccgagtagatattgctgcgtcttcggctcctcgtaggtgcctcgaaagttaaggacaaagacatcgcgcagttgctcccatgagtaaatgctgttagctggtaaattgaagtatcaagaacgagcaatgccgtctagaacgagatgtattaccttcgccttggtattttcgtcgccatgagcggcttcaatcgcggactcgtagatggacaggaactcctttgggtccgtttcgcccgagtaccgcaggacgggtgggaacttgaactgtggtgggattggacgaatattgattcccccactcagtggtagcctcttttcgcccccagccttgttcgcggcaccctgctacagatatggcgtggcgaagggcgaagtcatggcttgtgtgtgaggttgggccacagtgctcagctgccctgctccgaacagtgacgcttggtgcgccaccatggatgaaccgaacgattgctgggtccatgccatggcgacctgctttggcgcctgatttgctccgaagcctggtgtcggtgcctgtgattgaatggttggtgcttgagcagcgttgctgaaattgaattgtggtccttgactccaaggcgaagtgtcacgcccagaaaattagccctaaatttccagactattttgtgtattaaatccctgtccaggaccagccagggtacacaaaacgacaagtaatatacagttccaaacgtaaataaagcataaaatacttacagaagaggcacttagtcctcacaccgaaagagaacgacagcagcggaaaaaggcgatcctagcggggcttcagctccactccacaggaaaaactcaactggggtctgagccttggtcttctaacttcgtcttcagctcagaagcactacacttctgaaaaaggggaataatagcaaggctgagtacaaccactgtactcagcaagccacaccaatgatgcagacgtgcaaagggaatccaaggacgccttgcggctatttgcataaaggcggttgtaaaacattttattgagcaaaacagtaaaacagttgagtaattaaggtaagattaaatctccactggtcaacgctacaccacgttgaacaggcccaaccaacccacctgaactacagtgcattgggtcgatttattaagtgtgagactaatcacggtgaatatggtcgatcgcccataaccgcgggcacggctattcgaatagttttactctggccagaggtgcacaactgtacccacaaaacacagtccaccggcatgtcaccatgcctgcgcacacacatcaccatgtcgagtgattgtgacaagactatccgcataaccctcccctaaccatccacaccacgctaaggtttcacccccacccctcaaaaggcagtgggcagtcccctcttgcaccgcggtgaatccagcaactggacaaccggacaccccggccgacccaactccatcatgcccacccttgccaccggtgcttaggaaagggtcgagctatacttcagatcaagcagttacccactcctgcttgtgataagcactgttagtcttccagggtttcccgtgaaccggtccttaattgccatgggtgcaactcgcaaaaccatgcacccacagcccaccattcagtcgcattttagttggataattacgaccatgaaccatggccagatgtctcgagcacgcagctcgtaaagatgctagatgtctaaaactgtaattatcccatcaactgagctagtggttattaagcatggctaagcataaagttctagctaggtcacataagtaacacaagctagtcgatttatcacccaaggttgacaaaggacatatatcaagtaaacattgcacaagcgagcagataggtaaaccctgatcccatgtaattagcaaaacatgcatatttatttgcaaacggtaaaacatttataaattaggatcaacatgctcaagggggaatgtgtgacttgccttgcttcttcactttgatcttctaaactctttttctcgcgactgcgaacttccgaaacaacggattctacacgctggcacacaaaacgaggaaaaactctaataaaaaccaagaaaacagtacataaaaagtaaaaaatcatgtagagctcacttttatatgaattttgcaagttgaatggcccaattcggagttcaaatgaattagatatgaattttacaagttttgagccattttaatggatttctagaattaaaccgaattattgcgcaataattatttattttctcaaaggaaatagggagatgctgacgtcagcaaggggcgccggcgccgacaggcgggcccaacgcgtcagcgggaccaagggggctggcgcacgatggaccaggtccacgcgtggcctcgggcgcgcgtccaccacgtggacggcccaggtcggcccaagccgatcgggcggctgagcagagcggcggccaggccacgggcgcggccgagactgacccggccggccatggcacggcggctacgcgcacgcgcccggacgaccgccggcgacggcagcgcgtcgcggcgatgggcacggggagcggcggatggggaaaaaggagagggggcggtggggattctcaccgaggacggcgacggcgagacgaccacggggaggcggccggcggcggaaaatatggcggcgaccggcacgggaggcgacgggaacggcgttccgacgacgcccgaccacggcggagccacggccgagggccggcaagacctagggaaaatattggagcggttagggagagaaataggtgaccggagcggcgagaagaggccgctggaggcggtagaggtggtggtggctcgggttggcggcggaaacggggctccggtgatggtttggggatttggagtggcggccggtgtgcggggcagcgcggcgaagccgagggtggcggcggatttgtgtggcgatggctgaggcggcgaggagcagtggtttgaggcgacaacggcggtggtggagctcgggtcgacggtggaagcagtcctcgggcgacggaatggacgggtggagtggcggccggggcgtggcacaacgcggcgaacccgaaggcggcatcggcgcggtgcggcagcggctagagtggcgatggcaggcggctggaggaggtggaaggggcggcggctcggtttcatggtggagatggagttccgacgatggaatggggaaatggagtggaggccgaggcacgacgaggcactgctaagctggcggtgcaagcggagcggcgcggcagtggctagtgcggcggctagaggcggctggagctcgccggagagcggcggcgtgtgggctcggtgcggggagagcaagggagggctcggcggcttgggaaaaatggaggaaacggatgaggggaggccggggattttttttataggggagggaaggcgggatcgagcccgagagaggtagaaaccggccggcgacgtggagctcgacgtgggggtggcggcggcggttcggcgccgattccgtgaggagagtgggggaagtgggggaggaggaggtggggatcaagtccacgctcccgcgagacggggtggggcgcgggaggcgcggcgtcgtggggtggaaccggcggccatggcggttgcagccggccggatggaggtagggggagaagctgacgagtgggccctacggtcccacttgtcggccggagtgagagggaggaggctgagggggacgtgaagtggacttttgcaaggggaaaggggaacgggccgacggcccaagaatggagggggaaggccggcctggcctgggaaggagggggaagggattgggctaagcccaaggaaagaggggagggattttatttgtttttcatttaatttaattggtttaaatgaacttattattattataattacttctcgagctccgaaaatttgcaggaaaatattagagaatattttagggcacagaaaatattacaaaatattctcgaccaatgatttttaaaggaaattttttaatttccccattatttcacttgattaaattgatttatcttttatttaatttatagacatgcattattaatttatttttaatcccgaacgaaaatcggggcgttacacgaagcccccggaccgggctggttcgacggcaaccaactgggtgcaccttgacttgtactcccctctggtcgggccgaaggggttgtgcctgaaatgttatggggttggctgagttgctaaaggaaagcttgaagctgcgcctgcagagccgaagtcccttccgccattgcttgtggcatttggttgggtggtgaaggttgtacttgggcagcgactggccgaacttgtgactgttatgagggaacgggtgtactgttgcggccgaaggctgcccggcgatgtacactggcgcttgcatggcttgcggcggaagggtctagattgatgcttgcgggtggacttggggtggaatgtagcccaccgaatacggaaggattggggccgaagcgaccttggcttgccgcgctgcctcgtacgcctgctgttgttcttgcatctggcggagcatgtcttggagtcgcgtcaagttctggcgcatggcctccatgtcggcttcagtttgtgcttcgaggttggggttgacttgtgcggcggcgagcgcggtccaagccgtcgccggctgcgacggagcagcttggggtaccagtagctggcttgtcgaaaggatctccgccctggtctggagcgccctcgccgccgcggctgccttcgctgcgtcgaccgtgttcggcaccagccccgacgaagtggctggagcggaaggtggcttcgccctgacagactcgacgtcttgggctcgagcccccactggttggcccggtttcggcaggtccggtcgaagggtctcatgacatgccgccaacacgaataactaataaaacaatataaataatgaacgatataatttataaagcaatgcaatacaagtaaaaaacataattttcacaatatgggattcaacatgttcaagatagatatgacttgccttgatcactcacaaaatcttcggcatcaacggcgatgaacagctgatctatcggaatggcaggatttacacgaccaacgcgaagaaatagaaaaatgcttataaaaaccacatgaacagaagcaataaagcacataaatgggttctatgcatttttaggagaaattagagatttgaacgggtcgattctgagttcaaacggtcaagatatggccatttgaagtttaggtgttgtttaaatggaaatttgcaattttgtgaattatttttctaaaggaaattagaattattgcatcagcgatgagagagggtgcgcgtgaatcgggtccacgggatgggtcccacctgctagatgcatggtccaccgtgagacgagaacaccgagacgactcacggtgtactggcgcacaggcacagccagccagagcggcacccggcgacgaccaacggcgcggcggcagtgcaacggagcacgggaagataaaaacggaaagtggaggaggtgacggttctcaccgagcagacgtgggggcgagaggtcgaccgagatgccgatggcgagggagaaacagcgagaagcttcggattacagtttaggtttgatgaaaataaatcttgatgaattttaattgttggaggctcttttaggcttttaaaatttctagaaatgcatttaagcacgatttaaatttagggcgattttcaaggcgttgcagctcagtaccaccttgtagagggagacctccttataagggagattgctctcctagccactttaaacatgtgaggtggagagaaaaggggaacacatgtgtgcgattgcggcgtgtacacgacatacacgtcgaatggtccaccaaaattggttcctcacccatgcgcacatgcgctctccttttgccgttttgttttgctgcaggaaattcggttttgtttctggaaacacaccaaataatccggtgtgtggagcggcatggactctggataagatacgcgcgacatatccgatttggttacgcggagtggagatcatgcaggcgccctaatcaagtgtcttgatatctctatataaatcgagctgccacctccatgcaacacatgagaaattaatctagggtttgcttcctcctctgtaatgcgtcatcgcttgtagtctaatccatcccacccgccggcgtgcactgatgatcgggagagtatgtctccgaaaccttcgcattcgacgtcttgaaccggtagaaggcggcaataagatttttgataagcgctttgcgtgactgcttgctatttgtccacgacagctcatcttcctcttccctagagtattgcgcgtcatcatcaacactcggtactgtgagttcttcttgctgtgcagccgctcatccaaaaccctcagtacacattcaatatttttcgcatattcgatctgtttatggcttattgtctagtttacaagtgtagattgtatgatgtgattatgctagtttacatctacaatggcatgatttatttctggaagaaattaaatcattatgtgcttatatattcaacaatccaaaaaccttactataggtattgtggttttactatggctggttttgctgatgcactgaggtcagacaaatgcaccagtgtgcacttcatgagatggcagatcaaggtcactctgtggttgatggctatgaaatgcttctaggttagtaatggcaaacctgaaggagttctcactactgaaaagcagaaagaattcgaggaggccactactctctttgtgggatgcctttttaacgttcttggcgaccgtctggtctacgtttatatgcacatgactgacactaaggagttgttggatgcaatgaataccaaattcggtgctactgatgctagcaatgatatgtatgtcatggagcagtttcttgactacagaatggttgacaaccattctgtagttgagtaggctcatgaaatacataccatggctaaggaactcgaactccttaagtgtgtcttacccgacaaatttgtggccgggtgcattattgtgaaactatctccctcttggagatgtttcagtactgcactcaaacacaaaagacaggaatactccgtcgaggggttgattgcatctcttgatgttgaggagaaagttcgggaaaaagatgccgcgtctaagggcgatggtgggcagtctagtgccaatgttgtgcacaaaggtccaaaacaagtacaaagagaaatacaaacctcagcagagcaccaacttcaagaaaagaaaacgaagaatagcagtccaaaccaggatgagagaactagctttgtgtgtgaattgcattgtcatctagaagtgtccacaacgcaagggatgatggcacctgtagggcagtcttctaaatctgccaatgtgacaattgacaacactggagatagaagcaggtatggtaatttacctacagtttttttagttgatcgtatactaactggtggattgatacaggggctaatgcacatgtttgtgctgacatctcgcagttttcttcttatcagatcacacaagattctaccgtcctaatggggaataggtcacatgcttctgttcatggtgttggcatggtacatctaaagtttacttgggaaagatcatgcagctgaagaacatgcagcatgtccctactatcaacaggaatctcgttagtggctcccgtctatatagatatggatttaagttggtgtttgagtctattaaagtagtcgtgtctaaaaatggatattttattggtaaaggctatgagtgccgaggcctgtttcgcttttccctttctaatttctgtaataaatctgtgaaccatatttgtggcagtgtggatgatgaggctaacgtttggcactcacatttatgtcatattaattttgacttgatgtctcagctttccagtatacgtttaattcctaagttctctattgtcaaaggttctaattgccatagttgtgtgcaatcaaagcaactttgcaagcctcacaaagctatcgaggagagaaacttggcatctctagaactcctatattcagatatttttgaaacgaatggggtcttgacaaagggtggaaaacaatatttcatgacgttgattaatgatgctactagattttgctatttgtatttgttgaaaatgaaagacgggctctagactatatttaaatttataaggcagaagttgaaaaccaacttgacagaaagataaaaagacttaggtctgatcatggtggatagtttttctcaaacgagtttgacttattctgtgaggaatatagcatcatacatgagaggacggatcactattcttccgagtctaatgggactgccaaaaggaagaaccacacactaactgacttggtgaatgccaagttggacaccgcgggactacctaaggcatggtggggggaggtattgttgacctcgaatcatgtgttaaatagagttcctaatagaaataaggaaaaaacaccatgcgggatatggattaggaaaaaaccatcactttcttacttgcggacatggggttgcttggcgaaaatcaatgtatcaacaacgaagaagcacaaacttagacctaagactgtggactatgtctttctgggatatgcttataacaacattgcttatagatttttaatagttaaattcgaggaacctgttatgcatgttggtacaattatggagactcgtcatgctaccttctttgagagattttttccaatgaaggatacacatagtacttctagccaatcctctgaaataattcacagttcaatcacaccaccagaacaaattgaacatacaaatgaacttgtcacttaggaggattatagtgaagctcctcagagaagtaa

SEQ ID NO: 81206 - DNA, 3159 bp, Oryza sativa
tttaccgagttcgacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactagggtctataggaatcttcttttctggacttcgagacttgaattgtctcttgacttctgatgcaatgtaagtgtcaagctcctcttgcgtgcaatcgtaccccgggtccttgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctaaagggtccgttgggatggccatgcccgacgccaccttcatgttgtgagagattatttattagtaatcaacatatataagaagcaactagcggaatggctaaatcttagctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatctgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctattagtcgtcgcgcagcctctcgtatctgatcgccgaagacagtgagccatcagctgggttgagcgttccaccgtgagcatagtaccagaacttcgatcgttccggccaattggctgttgccggttcgatacccctctcaatcaagctagcctccatctcttcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttctttattccagtactggctgcttccctccgcgattgtatcgtacaatatctgttcctcatcgcgggtcagccatctgttgatacaagaaacatttgctaagtcacgagacatttatgttttaacaatctaagtcatgtatgctaagtgtaaatgtcgtacattagaaccctacaaaaccttacgtgctaagtctaattacaaatcgtgatataagctaagtctatgtgacgtatattatacaaccctagctagtaaataattatatactaagtctaattacaaataaaataatcttatattaaaactcaaataatatgacatgctaagactaaaatagtcatgtatgctaagtgtttcgtgcgtatatgctaagtctaattaagactacaatagtcaattgctacttgtcacaccacttccgtagtcaataattacatactaagtctaattacaaatatagtaatcttatattaaaactcaaataatattacatgctaagactaaaatagtcatgtatgctaagtgtttcgtccgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacagtcttatatgataag

SEQ ID NO: 81207 - DNA, 16087 bp, Oryza sativa
agctctacatatttggtagtactatagctgtaccgtaactactacatgttctatgttactacaatttcattaggacattactgtcaaaagtgcagtaacattctatatattttacagtaacgcggtgtgttactgcacttttacggtagtgttactactggaacatagtaacatgttatgaaatttttttataacatacctactttgttctatggtggtaatgaaagatataagaatcggttatcatatttctttatcgcaaagtaagatgcaaaagaaataagtaataatccttaaaactaaacgtgccatggggtgaattggttagaagaacatgttatgaattaagagatcatgggttaaagtattgaattcactaatttatttttttattttttaggaagagaaaaaaggaggattgttcgagggagagaaaaaaaacgagggaagggatggagaaagggagtcggtgccaggaggaggaagggagaggagagggcgccggggaagggagggattgggggtgggcaccgggagaagggatgagagggagagagagcgagagggcgctgggagaagggaggggaagggagtgcgtgccgggagaagcaagggagagggagaggtgccgagaggagagaggatgcgcgtgtgggaagagtggtggggaggatgcgggggaagggtgggcctgatccagatagagagggggtgtagagagaagagatgtggactacaaaattgtaaatagccatagtacggatttcaagacgctgtgtgtattgagaggggagactagatattaatggtgtagtcagtatgaaatgctggattgatcaaagcctactaagggtttattcggttgaaaggatttttaaatcacaagaatagaaaaagtaacggattcggatgccacatatactccaatccataggattttttctaagaagtcttacctcatgctaaagataatgtagaataaggttttaaaactatgatccttaggaatttggtagaatctattcctatgaaacaaatgttgcatagagaaaaaaatcatatggtttcgattcctgtaataattctttgaaaatcctttgaaccgaataaagtccagttatgtccttatgttagagtattaggtgtatgtgtaagttaggtcatatttaacataacttatgttagagtattaggtgtatgtgtaagttaggtcatatttaggaagtttaagattttgagaaataattggttagtagacaacttttgagtatccgaagaaacttggaaaaccatccagtttcaggcttatactctcttcatccaaaagtccagtacgtatattttttttgaaaattaagtctatggtctttgctgtgagatacccaaagaacacgtatttatttgataccataaaaatatgatagtgagctgctggacatccgacgtattattttattatatccagtcaataaggagaaggacagataaacttagataaaaggaaaggttgcccttggggtcatcttgtttaacctgacctaggaccagttcgaaccagacccttgccagtctcagcccggggatagtgcagcggtaagctaggtcatcaacggcggcgagatgtggtgacagcggattcaaatggcgctggcggattataacagcggggctggtgggtttgatcatggtggattcgagcggtggggagcgacggcagattcaaaggagatcgaggggaggcggccggacggcggcagtcggtggaggccagcgctgctgggtggatttttttttcttttttccttaatgtatgattcaatctgtgttaaatgattcgatttggttgaatgtgtggttcgatctgtgttattgttgtgaatgattttgagaatgaatatgttgctgtaaatgatttaggatgaactattgctgcgagtgatctgggatgaactatattgctgtgaatgatctgagataacatgtgtgagatatacaaaatagaaaaaaaaagaaaaaaaaaacttagtcccagttattttaacttaatcccagatttttactcccggttagaaaaccggaaatataaggggttaccaactgagagtaaaatacatttctccaccagtggcagcttcctcatgtttgtccgtccgtccgttccggcggtagagcacctgcattcgtggaggctcgccgaagccgtacgagcttgtaatgcctaaatacgaatttaatcagggaaaaaatctggagggctcggcccatgacagtgctcccggtactgtactagctagtagtgcccatataattatcaacgcgattaacaaaattgtaatctagtttgtgctaataaatactactatcactgcttagataacaatgtggttaatatttgtagttaattgtagtggcacgtatttactgaccgatgcgatggtgatagagagatactggtactagtgaacaaactcccctttacaagccgaccgactaagctaattaccacgctctttcttttcctaatcagggcaaaatggtagtttcgacgctctttctttctccatcttcatcagatataataaaataatacgttggatatccaacagctaattaccacgtttctatagtgtccatgacaagataaagttctttgggtgtctcccagcaaaaacacaaatttttagtgccctgttttttttcctggtgataaaacaaataagtcagacttttggatagagagaatagtttattttctgaattctatagccacagattatcaaaatatagatgagaacatggtttaccttatcgcgcggtaaccgtgtggttaacaccaagacacggtaacggtttttcgcaatatggtttggatgaatttgagcaaattgaaaattatgaaaaaatttgaaaaaaaatgaaaaaaaatcatggatgtagttattgatttagtggtagatggtgaaaaaattttctgaaattgagtaagataaattcaaatttaagggcaaaaccaaaaatagtttagaaattggaaaaagaaaaaatgtattagggttaagtcaaatactggaatacactgtgaaaggttgatgtttattgagatatgaagatttgtgaaacaggtgaaaggtttgctagtgacgctgaaaatggttttgtagagttgatatgttatttatttggtgagtagatatgctcaagtttgttgctcatgtgaaatatggtagtgatgtgcaagtatggattaaaacggagcggatatggacggataatgctcatgccatattcgttttcatcttttttaccggatacgaaaacgaatacgaatagctcgaatacggaaacaaatatggattatctcgaatacgaataagaatcaaatatgattggatacgaatacggaaataattttttctcggtacacgaaaaccaactcaacttctaatagaaacaaatatcaacatatataattagctcattttatataaagtaaagtataatttataaatattttttaaaaatttaaataatattaatagtatggactagtgttaagatattaactactattaaaatctataaaggtatattgaaggttatagatttagaaagaaatggggtatgtctcatggcttctgcggatatctgaatagcactgttcagcggatatccgaattattatccgtatctgacggaaaccccaataccatatccgtatccgtatccgtatccgataactattcgatccgaaaggtatccgtatctgtttttgtccagagcggacggaaactatctgcttcgttttcatccctatgtgcaagtaatgctaatttgtaattattatgctatgaaatattgaattgcttcgaagtacatataatatagaaaaggttatgccgattttttatattttacacccaacagttagatttgtaattatcctacatattcttccaataatccccaatttctacatatatttaagcattttcttgaatttatttttaatttcatgtgttctactacacaaccggcgaaccgcacgaatatcatggttatcaccaaaaaccgcgcggtaaccatgaaaccgctgattttttaaattcaaatttttagaggtgaattttacgcggttttcagcgattaccgtagtaacctcaaatcagtaaaggtatccctggataagaatctaatataattataacttctagaaaaagctgcaacaaccagaagttatttcaaacttagcctttagttggattgggatttgcatcaggtgcagtcacaacagtaacttgcaacttaagaagaagcagtatggcatcatcggatacaagccggacggcctagatctaacgtatcacaccgcactacagcagcaaatactgtagcatggagtactgttcacatggtcagtgtagctacggatctagctagaccgttgatcgtaaaaataaacggccgaagttgcttgcagttgttaagttgcgtaacttgcattcattgcacatgatccgaattcgttggattggtgattgccatgacctacatacagctgtaaggtgcactagtgcacgtcaacgtttgctggaggtgtggccaagtcaaataaaataagaagtcatgtcgtgaagtgtggatgagctagcagcatacgagtatatatatgtataaatatgttactggtgatcatatatattttttctattctaaaatataaaaggttttaggttgatatgacacattccagtataatgaatagtataatgaatctgaacaaactccctaccaccaggtgagtgtttattacttaccggagtaagtaacggttgtttgcacgtactagtctgtcctaaaaaaagccaaactctggctataaatctggacacacatgtgtccaggttcatagttaggattggacttttttcaggacggaggggtagataagtgtgttagtgggcaattaaccacgtgagtgttgtcggctaggtcctgctgcctgccagtcgttagataagccgttgcttgattggtgtgtgtgcctattaagataccccgcgttttactgtgcgatttataaatgtgtatatgttaaatatttttgaaatgatcaaagttaaaatgttgaaacaataatgtgagcaagataatttgacacatacttgttgatctctatataatataatattgtagatgatgtgtcatgtttgcatgggttttgttagtgagtgaagaagtggcatgcttgcatgggtttttaaatggactaaaatagtaattactagtgggtgatgatgtgatatgcttgcatgttgagttttagcttctaataattgttaatggtaccaactatatagaaagtataaattaagtatatgaaactatagattaagtatgtactgtaaatcatcttgttctgtgagtgagtgaaaaggaaaaaaaaaagcactggtgtgctgcagggtttaccttaccgccggggccagggttaccgcgccccggcggtaagcacggttaccgctcggtaaccgcggtaaccgtgaaaaaccgtacaaaaccgtgcaaaatttatcaaaaattcaaattattttttaaatttatttgtatttaaggaagttaccacggtatttatattaccgtacccccgcggtaagcccggtaaccgcggtaaccgcgcggttaccggcggtgagttaaaccctggtgtgctgtgcagcagcagaagaaaaagaagacctccattgtgtctgcgcttctctttcctgagccaaacacggtgtgttaatgtgtgggatcttaattcttaattgttcggacgaatttttgaataataagaataatcaaacgttataaaaaaaaattaaaacggtaaatattttggaacggtgggagtaattgtgagctgggccatggaggacagaagccagggggcggactggcagaggcaaaaggccggagacacgaggagatgggtggccggaggagttgcggagagacagcaaggggagcgaattttttttatttttaattttttttattaaaagttttacaaaaataattttctattttgaaaattgacggaagtagtcgcctaccgccctctgggaaggcgatttttaaaaatcgccctcctagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgaggggggcatggaattttgcaggcggcccccttgccgccctcggcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactatgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacactctttgttcgatcatcaaccgatgtaaatgtatgtaggtcatagtacatattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataacttgttgacttgaccaccctaaactctctctgcaaggaaactgcccaatgcttcaccgccttcttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagagaagggactgggctttatagggggagaggcaaaaatcgccctcccccagggcggcaagggggccgcctgcaaaattccatgccccctcgccgcccatttgcaggcggcccccccccacagtacaaaatcgccctagcggagggcggcaagggggccgcctgcaaaattccatgcccccctcgccgcccatttgcaggcggccccccccacagtacaaaatcgccctagctgagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgattttctcccagagggcggtaggcgactccttccgtcaattttcaaaatggaaaattatttttgtaaaacttttaataaaaaaaattataaataaaaaaaattccaaggggagagacgtaacgaccgtcgtttcaacttcgtttctcactattacaaaaatcagttttacaaactgtcaaaagtgatttcacatgcggccaatgccaaccgcatgcacccaaaaatctgcgaaaatcagaccgcatgcaaaaacaaattctgtgaaagaaaattaaaaatggaaaaaacccggccgaaccctagcccgccgccattgtagacggatccgcgcggggcggcgccgctgctaccgcctgagccagcacccctgcgcatcagatgcgccgccggctgctggccccaccacctgccgtcgctgtcggatctgtcgtccccactgccctctgtcatcgtcggcatcacatccccgcgagggagggcccctatgctggatccgcgtgggacaggctactggcgccggttccaagccaaggaagcctgccgtcagccaatgtgcccgaggaagcccaccatcagctgcacccgaggaagcccaccgtacccatgtaagcccgctgctggccagctggcagcgccgcccatcacacccaaggccacccgccgtcggccagctgagggcccttggctgctttctcatcgtcgtcgtcgtcggcggtggcggcagtggtagtggtgccggggatggagccgcccgctcccgaccgcacgcctcctcatcgtcggcggcagcgctaccgcccgtcgctgcccactcaaagggagagagagattgagcagaggagagtgagacgagaggaggagaggagagaaagaaaaggtgaaaaaaatttgaagtggtgacgagagaaaaaaaagaggagatatttttgtatgcggatcacttaaggacctcacatgttggtggaggtgtggccaagtaaagtaaaaagtaccgcgagggaaaagaaaaacctccaccagtgtgcagtgccacaaaataactttcgtgtatgcgtttatcattcctaagccaaacaccgtatttgtgttagcactacttaaaaaagtttgttctggcggcactcttacacggtttatacggacgtggcttatagaaaaaaaccgcctacaacctagggctcataaaatcgtgggatttgcattaacaaaataccgactgctcatgggaggttctctcttaaaagacccgcccataaaagcgaatttttagtttttgattttatttttagggaaaagaaacctgattttttttttgtatttttagatctatttggggacccataattttacacgtaaaatataggatttgaacctagtaccttacacttaacatgtagtctccatatgactgtatcatctcacctatgaagcagttctgtgactatggggatgctgctattctttcaacttcacctcttacaaaagctgtaatatatattttatactccctctgttttatattgtaagactttctagcattgcccatatttatatagatgttaatgaatctagacacacacacatatatatatatgtgtattcattaacatatatatgaatatgggcaatgctagaaagtcttacattataaaacagagggagtataataaatgttaatctagacataatcttgtagattgcgccaacctatacaactttgatgtagaccatatgtcacaccctgaaaattcaaaatatataaattgttgtttaaatagaatttttagaatttattttaaaagcctagaagagaagatctaattttaattaataaattccaatataaaatggggccagataaaatttcattaaatactttgcttaattctataattcatagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagccggcccagtccgagccgccgctcttctctctctcccgctgacaggtgggccccacctgtcagggtcgtcgtcttcgtagcgccgccgccgcccgaaaccctagtttcgcgccgccgccgttcccttccaaatccggccgctcctttccttctccggccgaattgaaagaggggaaatgatccccgagatctcctctaccttttctcctttggaaacatcggctaaatcggtttggaaatcgatggattcgagttcgaatcggatcagcttttctctctgcgagctcgagctttccatctcgtcgccagccgccgtgggccttcgccgccgcctcctagcccctttaaaaggacccccggtgtctcctctacccgccgccaccctcgcctttgcctctcgtcgtcggaaacgccctagcgccgtgtgccctagcgccgccgtcgccgccgtcgctccagccgtgcgccgccgccgttccagtcatcgtcgtcgctcgggaagaccgccgtcgtgctcgccaagtcgtcgccgtcctcgtccgccgcttcgccaccgtcggagaccgccggagcatcgtcgccgtcgtcaagccgaagagcgccgccgtttcaacctcgtcgccgtcgccgtccgttggtcttccgccgtcgctttggtcgccggtgagttcgtcgtgccgtccgctacccgttggtgccctccgttcgtgccgaagcgtcgccgttcgccggcgagcgtgcaccgcccgagccgccgagctgccgccgccggtggtgacgtcatcgctgacgtcatcggggccgttcgccgttcaccggttgtggaccgatcgatctcggccgtccgttttggatcaagtcgatctcggccgtccgttcgcgtgaaccgccgccgtgcgcccggtccaccgaaaccctagcccgctaacgcaataaatcctcttttccttttcaaaaataattcattattgcgtcataattcaattaaaatcaatttaagtgttttaatccgatttaatcttcaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttcttttcaactattgcatttattttcgaatgttattgggtggaattaacctattcattgttatagcccttttgttcttgattactttattccttgataccttgggttattataatttgactagttgagctttatttatattggttcaactagatattagatataattgcttagccctgcttagaaacattagctcacttctgggataacttatgactcactattacttaatgatggcttaatgatagctcacgatggacaatcgtgattggttaattaattaatgtgccaactaaaacctggtaatggtgggttttgagcatatggttttgagagtcgtgctcatgacaattaaggaccggttcacgagtttcggttgtgaaacattaaccgtgccagccacaagccagcgtgggcaacggctttatcttttgtatagcatggttcattgcggggcaccagactgagaattggcggagataagcccacgggggtcgctgggagtccatgccttgtttttaagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggtgggtctaacaatgtctttcgtgattagtctcacccttctcaccatagtaaatgatgctataactggtaataatttgatcagctcctggtttggaatggtatattcctggtttggagatagaactgtgcagccgggatggttgttcagaatggttgggcctatacaacagggtatgttgtgtagcgttggattaatattgtttaatacttaactgttttattaaattctgaaatatttgctaaatgctgcttttgcaaaagaaaccctactatgccatcctttggtatccttgtgcacttgtatatttgctgcgtggcttgctgagtatgtcatatactcaccttgcaatcattcatcagaggaagagttctacaatgatgctgatggtgtagaggattaggtgtagccttggtcaagctgcctatggagtggagtcgtctgcgccgtttatcttatttttttccgctgcatagatctttattgattgagaggaactatctacctctgtaatgacattttattcgcttattaattagagtaataattgtactatattatcaatttgttattgtgtgcctcggctgattcctggacgagggttcacacacatgtaagcgtttggaattttggatagaaattccgggcgtgacaccatatctccatcctagctcatttgaaaaagtttaaaaaaattgttttgcaaaatagatccgggagtttataatgaatatttgggtccctaaataatattaaattaaaaaatatacaaatactaagatgtagatctcgttaactggtgctcctatttttcaagggaaattttcttaaagataactgttcgtgaaaatcaatttttacgggctttccatttccaaggataattttcttgaagaagtctggctataatgtataggtcaaaagcttgtaaggaatatttagacatctaatgatcgcatatataaaacctttcaactatataaagttgtagatcgtgtcaagatatacagttttactagacaacatgtctcccatccaacatcgtttggaaaactaaaatataatctcaaaaatagatgtgagggcaaataaatgaatatctgaactcgtaaacaatctcaaatgaagaaactttcaactacaattgtagatctcattgagagctacaattttcaatagagtttgtaatcatctgaggtcgtttcagaaaaataaaaataaaaatttctaagatagatccgagagagataaatgaatttttgagagaaatgacctggaagtacactggtggagaaatgctttttagtcccggttcgtaacccccctgtagtcccggttttccaaccgggactacgaatccgggactaaagatcgctatctttagtcccggttcaaataaccgggattaaaaatcgatctttagtcccggttggtaacaacaaccgggactaaagatcgagctgaccttttttttttttggcatggccctgttgctgcatggtttatatatatatatatatatatatatatatatatatataaaccatgcatatatatgtttcaatacatatatatgcatacatatatatatgtatatatatattatattatattatatgcatatacgtgcataatatatatgtatttatacatatatatgttatgcaaatgcatatatgtatatagatatatatatgaccaaaatatatttacattatagaaaatgtgtacacatgcatatagaaacatatgtagtcatgtattaattacaatacattatatgtcctagctagctacgatttcgacgtagtagtagtcgctgatagctcagaagctaaggaccggtgaattgtgtttccgtcgtagtagaattcacccttgggatcaaggatttcttcgttgatgaatcccatgagttgttcttgaaccactgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccacacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctctatttgccgcggaccaaatgacggaaccgataccaagccctacatggagtttaaagctatgattcgtagtagcaattaacataacaagattttcttaattaacagaggaacttatgacggtacctgtctataagttcaaaaaccttgtcaaacgtagactcttttttatccattgagtcatatacgttgacggtgcaggccgacaggtcgaagagtaaaagcacccagtggaatctgcaatgtgcgtggggtgcattacatatgaaacacttagcaagttcgtacgggaatgaaatttggtatgtaggaagacagtaaaattgaactaactctgtgttgtacggcaatagtatgaacgtcttgtaatgctgcgccttcaggagatggacgagattgtcctctgt

SEQ ID NO: 81208 - DNA, 2407 bp, Oryza sativa
agaatggttgggcctatacaacagggtatgttgtgtagcgttggattaatattgtttaatacttaactgttttattaaattctaaaatatttgctaaatgctgcttttgcaaaagaaaccctactatgccatcctttggtatccttgtgcacttggatatatgctgcgtggcttgctgagtatgtcatatactcaccttacaatcattcatcagtggaagagttctacaatgatgctgatggtgtggaggattaggtgtagccttggtcaagctgcctgtggagtggagtcgtctgcaccgtttatcttatttttttccgctgcatagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttatcccagtgttattagtactgtacatctattactgtactaatggctcattttccagcaaaagttttacaatgttattttatttaatcttgctgcaataaaataaatttagcaagttgattttataactttcttttatttcttttgaaacctgttattcaaaagtacaaaatttgtaaccatgtttccaactgtttcaacttatcttgcaagcttggtttactttatttacttacctttttactttgattttctaactttattcaaattaattcaaaaacttgtgctattaattggataaatgtcttaactccctcctttcacttgtctttagatgccgcgctacaagcctgagtatttgtttggtgttgagggatttgtccaggagttgcgtacgatgtcttttgtcattggatttgggactgcccctttttatgcccagattcctcatgatcgtcatgaagagaagtgccgagtcaaagtcaccttgaacagtaatagcgaagatattccctcagtgatgttcgaagctggaggaagaaactacatccatgcatgtcaggaggtggcaaggatcgccataggagagcttcgcgatcgctacagtgatcagttggccgacacggagtatcgctaccatcctcgccaaccccagggaagtgaccgtggcagataccttgagactgaaggaattgagaatgatgctaccacaaggcatttggttgagatgctgtgggctatggatgaaagccttgcggagactgtgttagcagctcaagatcgtgaagaccggaatcgtggtaagatttgcaagttagaggacaaggtggatcgtttggagaaggaattagctgcgttgaagggagaagcaccgccgcagaaggccaggattcgtcttaccgcaaggaagagagctttatttgttcctcactatcaattggcgccaaaggtttgtgtggtggagaaagaagttaccccagctctagcggatcctccggtcatcatcataagtgacgatgaagaagaagaatccaagcgcacccattccaagattgagtgggtagcaactcaagatgatgaagacgagccgaacgagccttcaatcgacctccgatgctcggaagaactagagtgacttgttaagtcgctgtcttagatcgttgtgttagcttgcttgttttaagtttggttgtgtgtgtctcgcatgtgatttacatcagtggtgggatgtaagtgcatgtgtttgtttgcttttgagtgttaggaagttggtgagtttagtggtgtgagagtcttcagttttgtaataatgaaactcagttaagatcaataaaagttaaagtaattctctgtcctaagtagtttcccccggtttctcctcttgtgccctgttcatgccagatggtgaacactcgtagcaacgggaatggccccagtaacaataacaacaacaatggagagaatcccacacttgctcaagttcttgctcaacagactcagttaatgaacatgatgatgcagcaacttcagaaccagcagaacccaagaaataaccatgcacttccccagaacacgttagcagaatttcttcgtgtgaggccgcctattttttctagtaccacagatcctgttgaagctgctgattggctgcataccatagagaataagttgaagtggcttcagtgcaccgaccaggagaaggtctcatttgcatcacacacgttgcatggcct

SEQ ID NO: 81209 - DNA, 1225 bp, Oryza sativa
ctaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcacccttcaccagcgctacccggacgagttgcagcactcgccctaccgctaccaccctcgtcgcggaggagcccgcgacttcgccaccttccgggatgctagctcggaggatgacgctaccatcgtgcacctggcacgcatggtggaggcgtacgacgcggctcgtatcgacttccatcagatggtgcgccgcggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccg

SEQ ID NO: 81210 - DNA, 10279 bp, Oryza sativa
tttgttacaaggctaaatgcaaattccagtgttaatacctgcttggcaagctccctggtgggtgttaaaataagagcacgaagtggactttctctagaattttcatcttgtgtactctcatcctcccgagacaatctcatggccttctcttgttcttcaagaaggcgctgcaagatagggaggccaaaagcaagtgttttaccagaacctgtctctgctgcaccaataacatcctgttacaacataaacatcaccacagttagaagaccaaaggcatggaacaacaataaatagtataaaaagttatctcagttgcatattctcttatttccactgaactgagaggggtccaagctggcatgattagtttatggcactttatccaggtatatgttaggcgacttttaaatgtggaatcataagaagaaatgtctaacttcgactaaataaagtaggctatcaagttaataaccaaagcaacaaatggtgcataagcaggtgaataatgaaatagaagttcatcattttcccatataaaagcttggccaatggcctacaagttagcacttgacgaaccttgccttgatgagccgctgcaggaaagcaagccttttgtattggtgttggttctttgaatccaagcctgcgcaccgctgtaataagaagagggtgcagtctaagctctcgccatgcatagacttcatcctctcccaaaatcagcccatcattgttatcttgttccatgtcattgccatcttgcatatctgtgagcacacaacagtgttaagtagactcgcaatgctgatccgacaaatttagtaacaatgactgctacaaacccagacagaagaaatgctgaaacttcagtacgtgagataccagataaaatgctcctaaaagcctttaagtgaaagcaattagcaccttccacattgtcatcggagacatcttccttgctctccattgtttactgcatttccttcacctttctcttcttcctgctcctcctcttctttttcaccctcttctcacccttctctccctcctcctcacattcaactaccaaatcaccatcaccaggtaaagcatagtcatcgtcacctcgcttccgcttcttcctcttcttcttcttctgatcctttcctgccttcctgtcaatttctcctagatcctccacggcaccgccaaagattccgaagtccgcctcgtcgatctcctcaagctccaggaaccctaccgcccaatcaaccaaacacctcctcgtcagagaccaaacgcattaactgaaccaaggatccaatacacgataaattcaaacccttacctccttccttgcctccggcgagtacgaggaaggggtcctcgaccatcgtgccggccgaggaggtcgaggcggcggcggcagcggcggctctcctaggtttcttcgcgccacgactcttctttcccttgcgtacctggctggtctcctgaggcggagtggagggatccgaggactgcagctgcggaggcggtggcggcggcggcgctgcggccatcggagacggaagcggcgggttggggggaggcggtggcggtgtgggcggcagcaggagggggaagaagaggcgagggttttggttttggacttgtttcctacatgggcctttttgggcctaatggctaacgggtcaacccgttgtggctcgacgaaaaaaaagcccgagctgaaacggccctccctccccaagttggatcgttattcttgggtaagcctgggccgttcgatggagcttccgtggcccagatcgcgtagggctgaggggcggagagccggagaccatgttgcacgcaagaccctgcacgagcataattttacgctttgcacctcgtggacttggatcggccagttttggataacaatcatccaaacccgtatcgttttctgcaacttagaccacgatatctagagttaagtgaaatttacttcaaattttgtaacaccagcactaagtatagcttaggtagttagtgatgaaacatgttaagttatatacttggcacatatcctcgtatttatggctaattttttagtggtcgaaagtaaggcgttacagtaactttgccaagatcaatatatgtcggagcaattttggaggtgctcgtagccgtaaggatagaaaagtattcctggtttggggcgttttcaatgaagtttccatagccaagatcgagtaagtgcaaacattcgatattgttttttacatgacaccctatttgacatgatttttttttcgcaccctcttgagttggatctcttattcgaaaagagattttgtggccatcgtctaccatatgtctgtatgactttgccattgacatgctccactttatgggaacctatgttctatctgtggcgcgtattctcgacttggttttgcattgactagtgtcgaaattgtgccctcaagattgcaatgtcttcaacaaacgttgagcatagcgtggccctaggggtatgcggttatgggcctctctcgaagctctcaccccttatgggtagtgcgacgctgtcatgtcagaaatagttatagcttgcaatttaatgtgttagtgtcttgatgcgccctagcaaactaactagagtcttttgggttcggcgccaagccgccaacaatctgctccctccgtccaaaaaaaaagccaacctagacaccgataaagacattacatagtacaacgaatgtcttatttttttgggttggctttttttggatggaggaagtacatcagcaggttgtagggttggctagttagaaaatgctatacatcacatttcgagaaaaaaaacaaggggttttttataatatcattatttgttttgtgattaatgttttatctccatctccaacgaatctctaggacttctacgggtttgtcgagtggttagattgcaggattaaggttggggtaggtgtttaagatgtggttacgaagagaaggggcggtgggctgtcgggatggacggcagaggaatggtgtgataagggagagagaaatatgcctgagagtagagggtgttcccccagctaatcctgggttagacaccttacccatattaaccgtggaccgggccaaatcaaatcttcacccacgtagcagcccacgcccccgcatcgatccaccgaaaaactaccccgccgcacgtacggatcgaccgacgcgaggtgaggtgggcacctggcgcgactcccgcgacgtcgactgccacatcccaccgcgagtccgcgaccccacacacacacaaaagaaaaccgcgctgtctgctaccacaacccactgacgagcgggtccccccgcccgcgtcgccctcaggagccccacccgccatcgacagagtacgagacgagaccgtaccgccgcgcgtctcatgtgccacgaccgaatggagacgcgaaaaagaggaaaaaaaggaaggcagcaaaagctggccaagggaggcgaggccagcgcagtgagaggaagaagagccattttaaaaccttcccccttctccctcccccgatcctcctccgcccccacgaatccccatcccgcattcgcctccgccccccccggcgcgaggagcggcggcggcggcgagccacgaaccctagccgtctccttcgccgtccctctctctccagccgttgcgggaggaggaggaggaggcgcggttgctgttggtggcggctgtcgtccctgacgcggagttctctcgctagggttttttttttgtgtgtgtgtgtggggggggggggggggatgcgcggcatgggggggcggtaccacatggagatgcccaccgggatgagggagctggaccgcgtgcagcagcagatcgccagccacccctacgccttcgaggtgagcgcgcccccccttctaggtctctgggtggggttttgggtctgattcgtgggaggccgcggtgtttggtgtgtggttggtcgcaggtgtgctcctacttcttgcaggggtactacaacgtgctcgcgaacagcccggagctggcgtgccaattctacacggattacagcaccgccgtgaggctggactgccagacgatgaaatcctcgttcggggagactgttgaggtatggaacgaagctagcatattcttctctgctgtattttcttgcttagcgtcagtaaattaatcacctttgtgctggcccttgcgattttcttttttcgcgagatattcaatgcaaagataatgtttgttcgttggaccaaatgtgtgctatgctgttatgtttttttttactgggattagaatatgctgtgatgtttttattattgggatgatttttggttcatggtgagatttcatcttcaatcgttgtgtatggttggtgaacaaatgtgccattgagttttgacgacaaacaagcagtggctgttgtgtccagtaagaattagtgttacgaaaacttaccacttaccggcagcagtttttttttctttttctttggtatgtctgatagtctgagtatgtttctctatacatgttttgcggcagggttggtttgtactattgatgtggcaacttctgaggttgtttatttagtccaggcgttagctggctgtttattaattcaccagctgggaaaaaaatactgtggacatgggataccatagatcagagcattgtggattggggtgatggagtccctttgtattatctgtgcattttattagttatgcagggtccttgcttgatgattgtacctgtttggtgcctaactgctcaatgcccttttatgttttatttcattgatcactttcttgaaaactggggtttaaattatgaaatccactatatgtaggttattttgcttgcattgtttctgtttacaaaatatcactatggtataatttaacttgtgttatcatccttgcaaacatcggcaggaaatcaatgacatgatcatatccatgaatgtacacaagattgaggttaagacagctaatttcgtgcagtcatggggtggggctctccagatgttggttactggcctagtgcaattaaaggactaccctgttcgcaagagatttgctcagactatgcttcttgctcctcagaataatggatattatgtattcagtgacatctttaagcttatctgtgatgaatatgattactatgaaggggctgattacagtcacactgacaacattctccagatggatgctcataataccatgactgaaacaggtattattttccaacggcgctttaatgaatttcagatctaaacaatctgcatatgttcatgatcttctcctacttttttttgggccatgttttttattacatgataatgttttgcaatgtatgttaataaattaagcccatttcagtgcttgttttcttttgtaaaagtaagttttcttatattctgtgaagtaaggtatgcacgccacaaacgtcttctttgatatattctctagagtccagataatagaaaacctcatcactagttcaccagattcttctgttttttgtcgctaagtttaatccactggctacattctcattgagtacataatatgaagcatctgaatagtgtgcttctccacataaactcctcagttatcttgtttccaaatatttgttgtgtgtgtgtatgtgttttgcattgatgttgttagaaaatttctccaatggtaaccgtgattatagtgataatgtttactttttattgttggttgattctttagcgtctgattgtatgcctgaagaacttgaggcaaaggaagctttagctcctgctgatattgaggaaaggggtcctgcttttatgcctgaaaatcatgaagttcagcagcaagatcctttggaatatggggttgtgatcgacgatgattctccttctgaagagcttactccttcgttccccagttctactgacagtaaacaggatgcacctcttggccccattgtccatccttctgtaactacccctgaggaagagcctatgggagaaccagccaaacaaacatacgcttcagtggtaagcaggcatatgctgccttttagtcaagttgaattcctaatttctttctttggttgatgttgaactctttggactgaatggaattttgtcagctgcgaacaaaaggacaccctagccatcaggctattcactccattcctctcaacaaggccacggcaagtagtgtggagtcacaactgaatggacatatgactaagcaggtgcagcctgtgcatgaaaaagccaacctggacacccgttatgatgctagcggccctgaggatgaaggtttggcttttgtatacaactttgctaatgcttctgatcattttattatgatcttttttgaaattgttttgttattactactagcctactaggtataggaaccaatattggactaaattcacctagcccttctctatttcaactaccctctgcctttttagcactctaaatagaattttaatctaatttttggtagttattcacactttcctgttttttaatgtaaacacaatcccatttttggattgttggaactcaatttctttacctaaccatcaattgccaaccctgattcaacatttaaacaaccctttcctttattggtgtaattgacacttcctgttctggatgcaagatcaaattccttttatgggtagtttgtgagtcgaaatattttatcaacgccctttttagtggccagcttatgagttaagtaaattcttacgtcgatagttgttgctagcacacgagcgcatattcggtggttgtttataattattattttctttcgcagtattttttggggctgatgtgttgtcatggatgctaattcttgcttattgcttatttcaagagttgttacatgctaaacaaattactttttaattgtgataatacactattagttttgtgagtgtcttgtccatagtcattcggcttgatatatctaacttttatatgcaattggtatgcactgcttttgtgggtacagtattctattgtctgtcttcctgtagccttgactgattttttgaacttgtgtaacaaaggcactatgcacacttagtttttattctcgtgtcaaatatatttggttgtctatttttgtttgcactaaatggtatgcactgtttatccaaaaattgctgttggaaataatctttcctgattttctgctgtggacctgactgctgaattatttctcttgtcttagaagagtttttgtcagtttatatcgggaacctttctccatctacttcagtctttgatcttgagaaggtattccaggcttttggaagaattaaacctgacggggttgctatacggagccgcaaggtttcttgccttctatgttgtgctctcctccccccccccccccccaattttttctttgttatttgcttcctaatttcatgtatttgtgtgtaggaggctggaattttctttggctttgttgagtacgaagacatgtctggtatccataatgctttgagggtgagtttctcttagttcagcatatgaaagtaacctgaatacagaagaggaaaaaagagagaagataaatggtgccttgagacacttaataggccgtgcctgctatactctatagaatatctttttatgctaatctgaacaatgcatagaacatgctacagtgtctgcataaagggaatcctataacaatagttttctggagctgtaatattctacagcggaaggagtaatattatgctaatggctgagaactgttgagtggtggaccaacgaatgcttgttttgcaaatagtccaaagcctatggtcaagcatatagtagatgcattgttaaaacaaacgtcttgatttctcagttttgtttaatgcatgatgtttagagttcatagagcaatgaaggttagtgtgctgtaatggtaattaatctgtatgatcttacattagttctgaatgctatcttgttttgattaatatttgtacatcaggcatctccaatagagctgaatggccgcttaatacatgttgaagagaggaggcaaatctatcggggaggtggagcaagtaagtatcgatctggattttctcatccatatagttaagcagttttttattgttttgtttagactattttttgtaccgataatctagacaaccatttgtattaatgctgaggtagcggcagtaagaaagtagggttatagtagaatgtgccctgactagtgatgtttaagcctgaatttgttgaatgaggttcctgaaacctcatctttcttgagggtatatatggacttctcattctctgacgcacattatctttttactactgtttagtgcgctatagaacatcacctccaagacattgttattactagtatgaaatattttacttgctcccaaagaaacatgataaatcatctgtaatgtacatatgcccagtaactgagttttttagtaagccatgtctgtctgtttcctgtgttacccctttgctaggactgttaattctagtttcttgctctgcaggacgggggagaggaagacctgctgacttctctaggggtcaatcgggtgggcggtatgatggggattatgctactcggtcaaagggaaatgggtaccaaagaagggtttgacgccagtacgatggctaaagtcaaatttctcacctgctctgctggtgaatggttgtacccccttggtgatctcgacatggtgcggtccggccatatttttgtcacaacaaagcgtaatattaggtggtagtcatttttggatgggcatctgttaccattttgttgctggtttttgccgtcgtttggtcagaacaaaacctcagctgcatcgacctggaaagatttcataatgttatcgctgaattggtgtccgttgagaacaccattgaaaagttctagtctcagtgatatgttttaggaattgtccttttgctgccatgtcttgtttcacaccggcagcggcaggagcgattcctgcttgcaaatagcttgataaaccttttacattagcttataaaatctcatgttatctcttagactcttaacatagtatgttggttcactgcttcattctaatttgtgcgtggagcagtgccacttggcacgagctcgtgcactgggcggcgaacaatcacatggccggtgtccatctaccgcctagtcgcacgcacaggtctcactcgctagctgccttgatgcatgaagccatgcgctgacgactgatgcatgcgcccatctccgtgccattctccggcgtcctatagccaggaatgggcgagactcttcttttgcctcgcggtagaaccagtaatgggcgatactcttcttttgccgggcgaaacattgagattccaccgcgaggcaaaagcaaacaactttggggtagatgcaaaatacattcatcggttttgattcgtgaaaggaaaaagagaacttcatgatatagttacatccaacttccaaccgcggtattatttattcttcggtttgtaagcaccagcgcatttagtagtagaaagcacagcgcatttagcacgttgtcagcccgtctcgcacggatcaaacggccacggaagccagctgcctcacatgccccggctgcgccgccacggccacgtcctgctcgccttctccgaggtcgtcgttgtcgtcgtcgtcctgttcccacaggaagctggcgtacgcggcgaggacattgctgccaattccagaaaccaaagacaaaaaaaaaaaaaaacacgccaccacggttagcgctaagccatctgatcagtgtaatactccgaaatgtactcacagcgccgcggggctcgcgggtggctaccgagtaccgacctgttgtgcggcgcggcctgcacggacttgtggaagtaggtgagggatctgtccagatcgcggtgcacctcccacaccagcttggcgtactgcgacatgatctcgccgtcgctgggatccgccagcatggcgcgcgagtagtactcctccgccctcctcgcgtcgcccttcacctgatcgatcatccagtgatgatagcaatcaaaatttatgaatccacgagtttacgagaaccattgatcacacggtgtttcacagcattataccaggtgtgccgtgcttgatcgatgggtttttagtacagatatatacctcgtgcaggaactgcgcgtattgcgcaggaacagcgcgtcgcccggctgctcgtccatcatcctcttgtactgcgcgtcagcgccgccaccttctc

SEQ ID NO: 81211 - DNA, 919 bp, Oryza sativa
attgatgtacaaaatattattgtgcggccttgtccatggacactcaatatataatacaggtaggcatccttatcatcatcactacacctgtaaatcaaacaaaaaaataatgtgacaatttaatttttccatggaaaagtaaaagctagaaaaacgacagttaaaaaccccaaaaaatctaaaagcagaaaatacatactcaataaaagactcttcaagtttctcaggtaagatagaagccttcgtcagatcaactatttctgcgttaggtttcatacgggcctgcttcgaaagtgcttcaatagaactcaaatcagtagatgcagacgcttttgcagtaactaggcctcgcttcaactttttccgaaaattagctgagagagcaagtgttgctgagaatacaaatgtctgtctcttctttatttgcaatataggcacagtttcgcaacttggcgtggtcccaacagtttgttcatcagaaccgttagtcactggtaacatctcaatgatagattgcagttcatggaaatggcctcgctctatcattctatcagcctcgtccaacacgaagaatgataatgaatgtaactgggtacagaaacaagcaatgttacaattaacactatatcttcagcataaaattatcagaaaataaaaaccacaatgagaagaaggttataataaattttatttgtataatagaagtgtatgttctacttctatctttcttacaaaagtggggctttgctatgaactaacaaggcaaacgaaaggcacaagaaatgatgagcatggataggaatcctggtggtcaagggtggaaaaccttatgcaagaaaataataagtactgaaaaaagttcgcctaaaaaataaattggattcaacatggcttcaaatgccttagtaggatccctatc

SEQ ID NO: 81212 - DNA, 2156 bp, Oryza sativa
ggttgatgatataagttatattttcctttaaaaatggtcccagtgtcccacatgtcatagacttgtattagttttacagtatttatttgattggtgttataactatggctaaccatactatttcttcgtatggccccacatcatagacttggatttttagttaactttggctaagtcatggctagcatattctatgtcaggcatgtcttacttaaagtgtagtttggaaaaggtagtaagcaatcaatcatctgctaagagtacgaaaggcggtgctaggacccatatgagacactatcaggttgcgctaaaaaggaataagtatatttgtctccctcatctcctgaccctgaccctagatgaatcgtctttctcaagtctcaatcgtagaactggtataacacctcccacatattcaaaaaccggtgtaaattgactcctcggtggtttcaaaagtgatttcgtcctatgtggcacttatgagacccacatgttagtgaagaaaaataaaaaattaacagtcccacatgccagtcatcttaatctccttttctttttcctcccctctctcggtgacaccggttagcattgttggggtaacagtggcgaggttttggggaagagaacatggagccacacgagcgcgaggcaggggagggacaaacgggcgggaggacacgatcactaccatgacatccctctctactgctgggcttgtctccatggtgtcatcaccaagaggcgttacattaagatgggtggcacgcgggagagaaactcgccggctggctgcaaggcgtgggcttctggggacttggccagctctagtgcgtgcgggaggagaagctcgtcggcgaccacgcacgtggggaggacttgactggctccagcacgcgtgggaggataagctcattgcccagctacacacgtggggaggacctcacggactacacgtgtggttccaatccttcctcctactactctcctgcccctccctcccccactcactcctcagtgctcctctcccttttgtcgaagccattttcgctcaccttcacaaccgccgcctagagagggagagaatgggagagagaggggacataaaagggtgaataaaaagaaaacggatgttaggacaactaatttgtgaagctattattttctctcagtgacatgtggatcttatgagtgtcaggtggaccaaaccgtttataagcaagagagcagatgaaatagaaaaagtagacttattccgtgtaaaaatgtgggatcgtttacagcgagaaaaaaaatgcaccagccgggaatcgaacccgggtctgtaccgtggcagggtactattctaccactagaccactggtgcgcttgatgtccttttttgaagaaaagttttattgaacttatcaataaatcctgaaaaccggggccattactctcatcggaatgatcaacgtacgtttggatgcattcagggcctatacggtttggaggaaattcatgggaattttgaaggaatttaactggtgactgtaaaattttctaaaaatttcatgcgtttcgaaggagcgtatcaacgagatccgccccagattaatgcaacttgggaggtgcagtgagcttccacattgccttcacaccggaacatcatttgcactctaagataggtcatccataagctcgtaattactctcgaaaatctatttcgagagtgtcctatcagcgtgagctaggggatcgaacagagtactaaaatcttcttccgagtgagctacacagcgtccgcagcgaatataaaagatactcacgtgtgactagcaacatgcctgttatgctctccagaccttgcaggcataacttgcatatgtgatggacaacgcacattttcgtcatgtcttgcaatgacagcatatctcattggctgataagcaatcaatcgataatgaccttttatgccagttgatgaataaaacacatggatatacaaaatatcgtgcctaaacccacaaaacagagaattagcaccgaaggcaattagaacaaggctctacaagattgcgcaacctcccgccgataccactgtcgtctaaagatagaaacgcaaccactgttgcaggcgacttccttctgttttcttgagtctaagggcagaatattca

SEQ ID NO: 81213 - DNA, 4642 bp, Oryza sativa
gggcccgcccgtcgtcgcggacctctccaagctccgtcgtgtggctcccaagctcgtcgccgaggtcctcagcactcgcccgccaccgccgccgccgctcgcgttcccgttcttcctgtgggcggcgcggcagaaggttcccggtgttccacgtgcacgcgagagagagaggaggaagggagataagaggggaaagagagggtgacgtggagacctgacatgtgggtcccacgctgactcagccgccacgtagaccaaaaccagggttaaaaccaccaaaaagacctcgggtgtccggttttatgtagttaaaggacccagcatatctggttttgcggttcgaggacgttttcgtgtcactatgacaagttgagggaccttcggtgtactttttcccactgccaaatgtaccaaacccgcacaaaagcggcccaattcctacgtgaaccttttatcagcacaaaccgaatgctgaaacataaagtaaaaaagagtgaattgtactttcaatcatttgcattcttttcactttgaattagctattgttattatttttgtactataggccatctaaacggaattagttatcaacatcctcaagcacattagcatcctcataccgaatattttatctatttacgtacaactcacatctttatccgagaaatgttatatgtggttagataaaagagtttaggtgatccaaaacaccaaaaataaaaagagaaaagcctagtcgaaagtaaaaatataagataaaagtggtcaaatttcgataagaaaaaggtgaccaagacgcaatttacttatataaaaatcatcaaacgttctaagcacaggggaaaaggctctaaaatgtgtcacacaatgaaacaactgattaatttctattggcaacggccactctacatgtaaactgagtacagattattgctagttaaaacccaaataacttgaaaccaaacactgttcttcttcctttcatggaacagagaggccgatgtcgcgccctttggacgacacgtcgggacggtatctcttccacggcttgtagtccttctccccgagcatcttctccacctcctcgaactgcagtcccttggtctccggcacggtgaagaagacgacgacgagcgcgaagaaggagacggcgcagaagaggaagaaggtggccgacgtgcccagcgccttggtgaggctcaggaacgtctgcgtgacgatgaggttggacacccagttggccaccgccgcgatgccgccgcagacgcccctgaaccgcagcgggtagatctccgagttgacgatccatggcacggtgcccatgcccggggagtaggagacgatgtacgcgccgagcgccaccagcgccagccacccgaagttgttggggcacccttccgtgtagaactcccggttccccgcgtggcacgtccgccgcgacgcttcgcccgccgccaggcacgcgccggggaggagctgctcgatcgtccagaaagctcacttctcatatcaatggcaagaacagcaagaacaacatcaagagacaagaatgttagtaccttgtttcctccgtgggcgcagaagccgcaggtggactgggccttgaggcagttcatgcagttccagcgggcgctcgggctgtactccgggcacgtctggttggcgaacacccgcgtctccaggtcgctgaccggcggcgcgtggtgcgcggcgccgaggaacgtgccgccgagcacggcgagccacaggacgatgccgacgaggctgatgatcatcaggcgacggcggccggccctgtccacgaagaacatgctgacgatggacccgatggcgttgaggcccgaggtgatgagggacagcgccatggccgtgttgttcgacgcgaagccggccagctggacgatcgtcgggctgtagtacatgacggtgttgatgccgacgaactgctgggcgacctgcgcgatgacgccggccatgagcccacggcggacgaccttgctgctcagtgccttcgtcagcttgccaaccagactctgctcgccgatggagccctccagttgtttctcatgttcaattgatcggcgcatcgaatcgatctcttcttcaacctcagccgcggggtaaatcttccttaatatggcttcagcctcctctttcctatcctgtgcagaattcagtaatttccagcacaatcttttagcttgacagagtcaaatttgctacaaaatttacttgtgatttgtgcatatgtaacaatgtacttcccttgtacatctacgtttccatgtaacaatgaactaaacacgtatgtacatttttttttctttaagcaaagcatctgtacataaatactgacctgtctgtatagccaccttggtgattcaggtagcatacacatcaatatgaactgaataaaagcaggaagacctgcaatgccaagcatccacctccatgttccctttacctgacagagtcattgagatatgattactgctgcaccttgaaaaagacatggtacagcacgagctttcagtgtacacaggtgagtaaccttagtgaaggccagattaatgaggtatgccatgaactgccctccggtaataagaagtccatttgtgctcacaagtgcacctctgattctagctggagaggcttcagaaatgtacaaaggtgctgtcatggaagccattccaaccccaagaccaacaaagatcctcccaataatgatgacaaacggtgttggggcaagggccatgatcaaggcacctgcgaggaacagggaatcggcgatcaagatggaaggcttccttccaaacttgtcgttcatccagccaccaaatcctgctccaactatggctccagctacagccatactcactatcgtttcctgcatttcagatcagggcaaatcccatcagattttgtcaacacggaatgctgtattctgaagaaaagcagttgtactacggaaagtgaaaagttaaatcaaagtgagaatcaggagaagccaaatgtaccctaagtacagtgctcttttcgaccgcagtaaaatcatctcgaatatacagaagtgctccagatatgacacctagcaaaacagtagattaattaaaaagaatcgaaatttgtcatctgtgttgcatttccaaagtggagctaaatgtttggaaacataaacaacattatgatacttaatagactacagagatacttaaaaagtaaataaatggacaattgaaaaggacataatagcaaaacttgaactttgacaaaattcagtaaattatttttgttgtagcctatgccatgtaacagtacctgtatcatatccgaaaagaagaccaccgatgccggcagagaaaacaagctgaagaatgtaaggctggctccaggtcagccgcagacattccttaaattcagccttatcagctagagttgcacccccttccattgcattcaagggcttttgcgcacccaacgtaggttcagattagattggtcacgcaggaatgaaacataaattgtcctgtattattacacagaattaaaatgctacagaattaaatagaagatttgtcaatgtaggacctataataatactatgaatcgcaacaacgaagaagtgccatagattaagaaacccagcaaactatttattctgttcagtaacagaagtttcataatacgaatgatggttcactgtttcaaacatcatgattgctatacttgtttggatcacatcatataaaactgtgagcggcatcaatcgattataaaatcagggaagatagagatgaatctcgatacctacgatgtaggacagaaaaatctcctcagaatgtgcctttccaaaccttcaggacagaagaagcatggtgtgtttctcgacaggagtccctttcttttataggatggcgcaaccaacatttacaacggaagaacagccttaaaaccacaatccctaaacgtaacgacaatccaaaatcgcgtgtttcatcgcagggaggaacgcggataagtctcaccccgactcgcctaacataaacaacgaaatctcaacgataagatctacagaagaaaccgactcaaccgatctcccgctaaaaaagaatcctttcaccggaaaggagccacaaaccccgagaaccccagataattcccgaccttgcgatccgtgaggacgccgcggcgccacgagtaggaagaacaagaagaagaactggcagtgtgctgagacggaaaacttcacctcaccgagaaacagaaacggggagagaaaccccaggctgccgggagcccgggacgagagccgcgcgagcccagcacagcacacgaaacacactccttccccaccccaccgcgcctccaccacggacgacgagcaaagtggcaggcgcgctgcggcagccgggcgattttactgaggacgctcccctcccttcccgtccacccgcgcgtggcgtggcaattcaatgcgggggcttaggctggcacgcgcacgctcgagtgacgctttgccgattgccagtgtgagtatatccgatagatagagagaccgacgcgcgcggtggccctcgcggaatcgccgaatcgagtcgtggtgataactgtaactgctcgatccctttgactcgccggattc

SEQ ID NO: 81214 - DNA, 7480 bp, Oryza sativa
cccccccccccccccccccccgattttgcttgccagactcggttaattaatgaggcacttgaatggtttttgagttttcaaagtacttaatctagtgatgcttttgttgacctccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaaacaatccacttgatagtaatgcttgtttgtaattctagatttgtgcctacgcttcttgggatcaatatatgtatcttccatttccaatttgacaatatcatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgaggtgcaaatagaagacaaaatcaaaagattggaagtactccaaaagattcgatgcttgatctctaattttccaatcatttttgtctttttccacaatttctagcactttgactattgtagcaaacatgccaaccaaacttttgagagttttatagtgggaactccatcgagtatccccaggtctctgaagacattgctcttgattcaacccggttctagtttgaagttgcccacaacccaatgccttactcatttctttaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctgtctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaactttcaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgacccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaacaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatggccaggaactgcaggtctctgccttttaagcttgataccatcaaaatgatcaatgtactggactagatatataaatcgattgatgtatttggtttcggagtgctagatttttcgtcattcatacatagaacatgaattgatttacgtgaaacaatttatgtaagtcttctgttccagattactactatgtttgaaaactttgaactgattagttgagcaaaagaaaatttacctgtggatgggtcatgcagggcgagaggaggaggaggagggcgtgtgctccatggggaccaccagccacagaacggggcactcctggagcgttggatcagctgcgagggacaatccgacggccgagatgcgtccagtgcaggtatttaagcgcaatgctgcttctccttgcgcggtttgctgcacaaccactttctgcttctccctccctcacaggctcacgcattctcatctcaagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttct

SEQ ID NO: 81215 - DNA, 967 bp, Oryza sativa
ggcacttttcttcatgacgatcatgactaatctgggcataaaaaggagcattcccaacaggaatgacaaaggacatcgtacgcaactactggacaaaaccttcaactcaaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaattctccacaccatcagcctcattgtagaactctttctctgatgaatgattgcacggtgagtatatgacatactcagc

SEQ ID NO: 81216 - DNA, 625 bp, Oryza sativa
ccacaataaaccacaattcaaagtgcccaggtgatatgatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataatagggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctacagcgtctacacgaccaacggaaaagaaaaggctcaaactgtcacgtcctgataaattcatcccaaaataaaaatcattttcaaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaa

SEQ ID NO: 81217 - DNA, 10915 bp, Oryza sativa
acggacgttccgaaaggctcgctacaaaggctctacagcggacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccccccacgctgatcttcccgggtcagaggtgctgacgagggagtggcagccgaacggcgagcaacagccgccgctcgccgcgccctccgctttgacgacacggagccggtggtagcagcgccagaggtcttggtggcggaggaccgcccaccaacacctaggtgctgccgtgccgtcatgaccaagttggctacgtcatccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccaacgacatgaccagtgtcagaccggtcacaaatcggtcattcttgtccaccacgcgtcagtttatcaatcttgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcacccccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcgccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaagactaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcagtcacagtattttgcagaactgtccctttttttttcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatataagctttactgacacatatcataacaccaaatttcaaagtgagataagaagaggaaacgagcgcataaagtgtactgtacaagaatgatcgatttcctttagatatggcactgcttcggcgaatcaaaacttaaacaattgccaacaaagaatgaagaacagaagaaaaaaagcaagaccaccctaacagtacagtggggcacggaacaccatcacagagaagtgaaaaacgggttacagacaaaaaatgcacaatatctgggtaagggagaaggaagccaaatcaagattcag

SEQ ID NO: 81218 - DNA, 15164 bp, Oryza sativa
atgtaaatatagtacaatagtagtgtaattaaattctagcttatatgtaactacactgtaaccgatgtgtaactttcatgtaattttgaaaaccgttagatttgctttaagattcgtgcaaatggagaagaagaaaatcacaacgcacaagtaaagggatttggtcccatgatttccgcttcgtgaaaatagcatgttatggtaagatttttaaaagttacatgtaagttacgatgtaaatacactgtatttacacctgtcaattctttatgcgaaaatttgtcgataaatgtatagcaaaattgatatggatagtcatagtgtaattatattataataattacaatataatttatatgtaactttaaaaatctcgcagtaacacgaaatttctaagaagcagacgtctcaggacgaaatgccctcacacatatgcacgatatgattatttccttcactgtttgcatgaatcttgaaacaaatattgtggctagaaattatgtaaaagttacatgcaagtaacattgtaattatatacaacttagatataattacactacaattaaactatatttatatttgataaatttttaggagaaaatttatcagcaaatgtatagcaaagtcaaaataaaaaaatgatctggacgacgtgaacttgctgaaatttacgagctactgtatcaatttaccactaacgttcagtacttcagtctaccatgatatgaacaggagccaggagggccaaacaaatcacaaatgtatgtggaagtggtcaagtaaataagccaacttgcagggtaaggcgtgacagcgtgaggatatgatgaatccgaatcgaaagaacagtcagtgtaaccatagactcaggattgcagtgggctttgcagaaatgcatgaacatggaaagatgggcaataaccggcgagtagcatcttttcacaattatttgcaagcacgcaagcaggtccaaaatccagaagaacttctgcaccttcatgtacatgaaatgaaattggcttcacactctaaatcttacacattcttacaaggtggacaacaaacaaggacttggcacacttgaaaattttcaaacgcttaaatgaagagaaacaagctcatgcagaggatttcttcagtgctctatccagcctgacattgaagggagttgagtgccagtttacccttttgtcctgcagcaacccactgaagcatcagtacatcattcaaaaatctgaagaaacatatgacttgagtgttgaatgcacctctctgtatttgcttgtcgtattggggattccattggttcctgaatctgatcttgaagaacagtgtgcattgtcttgcttggtgctactccagtaacttcccaccgtacccaagatcgcctcttcacggttatggctgggagaccttcgtggagatgatgtagctgatgattgcttaaggtcatcgaccgtcaaagcacccaggacaggcctttcatctcggtttacagttgaaatggaacaaggagatccactttgcaccttgtctactgttgagttatctgaagaaaccaaccaagtagagaggctcgcatccacagaaacttccttcttgatagaattttcaggggttgcacctacctttggcactgaatttacattctccttattcgactttttagctggtgctgcttgggcttttacttccttccactgtgacatattctgaaccggattcagcacaggacggacatactggcctctgtcgcgatgattgtttctctgaattagagggctttgttcctctacagaggtactactgctcttaggtgcagggctgctgacttcattgtcattctgctgatctttgtacatttgcaatgagaaaagagactcatgggactcctgcttgatatcttcagtgtacagttcatccttgtctactaaatcaatcttgcagtctacaaaatcctcctcctcctcatcactatcatcaccgtagttgtcgtcctcaccatactcatcttcttcttcttcgctgtctgagcaattccggtaacggtgattctccgggagcagcacatccttttgcatgtgttttccatcttcattttctaccatactgacaggctctggtggttcctcctcttggtcagccggtgcagtgttttcatatgccgtaacattcatgtcgaacgttactttcttcttgccactgctgcggctctcttgtccgcccacctccctatgcatcaagaaagacggcatgttaacaggcacacaagccgaatcattcatacactaatcatttcgttaacctacctgagttctggatcaggagtgcaaacaactgcttccgccaaaggtggtgagtgtgccaccggggagagtggcggtgttacttgcttctccggcagcaaagagcttgctggcgatgccttctgctcactgcaaacagattaacagtaagaaatacaacatcgaatacaaggtgaaggtacagccatagaaatacggaactaaacgtatatggcatttgggaattaggcaattaacagttataagcaggctgccgagcattaggacatgttcatatccatgtcagtcaatactacggtgctgcttctctgaggcgtttcagcaaacacccgagctgcaattctctccctaccagccattctcacgcattcgcataagcattcgagagcaacagcgaaaattcacaggcacgcaaagacgaccacagtggaggctacacgcacctcagctcctttccgggccttgcgccagtgaccacctcctccgcagcctccaccggcatgggcggcggtgccagcaacacatccttcgcctcctgcaacagtggcggcggttccacctcctccttcgcctccacatccaccgccgtcaacgccttgccgagcagagcaacctgcggggcaaatccgaaacccatcaggaactcacggaatcaccatcacccacccgagcgccctaccacaggggcgagcacccgagaccagaatctcacatggtccggccgcggcggcggggacctcgccggagactgcctccgcggctgccgccggcggcggcggtcgccgaagcaggcgaggaagcagcccatggaggcgaagatgcgggaggacgggagcagccgggtggaaggattcgatggagtggctcgattttgaatttttttccggggatttcgagaaagtattttataaattagttttggtagtggcggatagtgcggattcggtgaggaatctgaccgttgctaaccaagaattgaagaccaagagggccagggtgcggcgcgggcaggtaggtggctgcactgattgctattgtctgatttgctggtttgaattaggaataagtctatttcgccccctcagctattgcgttgatttaaaatgcaccctcaaatttcaaaaccagatttttagacatctctcaacttctaaaaccgttcaatttacccctcaattcaaacctgagtagttttgatatacatgaggctgacgtacatatctagccagtgaaaaaataatagtaattgcatggcccacatgtcattgaccataacattttcctcctctctctccacgcaccaaccttgacgggcctatttctcctctccaggcaccaactgctggtattctctgatagagcagtgactctaacttctccttattggcgcatcgccgctaggggtggaaaaaaagctcgggcttggctcgagcttggttggcttggctctgctcgtaagccaaacgagccaagcccaagaagcctccttttcagctcgttgctgaaataagccgagctgagctagctcgcgagccacttgttttggctcgcgagcctagatcattgttgtcgaggttacgggtctggcataccctctacccttcgatatacgttacgtatcgacgtggcatgcccacgcgtacgcggacatttccttcataatctaaggaaacttttcacgaaatcaacagacggaaagagtccttctcggacaaggactgggttacctacgtatcgtgctaggtctggtgtgttcgagtcctactcggagagcatcagacctatggtataaaagggatcccccggagagggcataggggatcgaatctcagagccaacacaacccacacagtctatgaagccggagcctgcgaggagccaagtcgtcgagagctagtcgaatcaactcgactacaatctcgccggatctgacaagttccatcttttcctttgtaacctgtgttttccgctatataatcccatatcaactggattagggctattacctgttaaggggcctgaaccagtataattcctgtcttttgattgcttgatgtcgtactacgtagatccttgtaccagcgtacccctatacactctatatccggtctacgggtatcacccatcgacagtggcgcgctaggtagggggacttggtactcaaggttctactactatgccatcaagcttcgtctacaacaacgtcaacacccgctccagccaaacactctcgacttcaacaatgctggtatggactcaagtcggcgaaatcgtcttcccggtttacaccacgatgccgatctcaaccggtcctccaatgactgaaaacgagaacgcagtggctacgaaccaagacggttccatgtcgaaaaacccacccattgaaacggagaacggattaccgactacattcaaactcgggaaggattctgatgcggccaagtcttgtccctccgacaaaatacacggaccggcaaagatgactcccgaagctatcaggtcttggtgtcctatctacaaaaccaagaaacatacccttcaagattgctgggtattcatcgatgtccgtgctgaaattcgcgcctgcaaagaacgtggaattcagcgtatttctccaactcgggatatctattgtcctatccacaagacaaagaatcacgatctctcgagctgcaaagttctcctcggcgccatgaagaccccatctcctaagtcatacgtccccgccagggataacggcaaggaacagggagcgactccagcctcagatcgattcgttggggtaatcgatctcgatcctcacgaaccattgttcttacatctcctcgaagactacgggtcatcgacaacaagtgcaccgcgggaggtattagttatcgatgacgttggcacgtcagctcaagccaacgcagaagcggcaaatcaatcgactactccagctcagcacatcagggctattcaaactatactgagggaaactcctttcgatcccgttctgaacgatgacctcgagcattggacagaacgattacgggagtcggtgaccaaccttagcaatgcgttcgaagaggccgctaccgcatcacactaagatcagccaccaatcgccaaccccaatggtgaagatccggagcggagggaatcgcctcgacaggctacccctccacctcgtggcactggtgatcttcgagatcaaattaacggtcgccgagaagcacggcgcacatgggacgatgcaaatcgctctcggcgtcatgtttcttcacggcgccatgatcgaggagaccgcccaaacgaggaccgagaatgcaacgatcatgaacggcgggggccagacaatactggtcatggccgtcgccgcaacgacgacgacgaaggagatcggcgccgagataacagcgagagacaacgacaagattcccgggatccaggtcgtcatcctcgtaatcgtacgccagagccaagcgacccctcgtcatcgtcatcatccgcgtcctcttcatcgtcagacagacatccacgaaggtcatgcgaccgccggcaacccaccgcccccagtgctgggtatagggctttcggtcgttccctacgtgatgtccgatggcctgagagattccgacccgggccattgaaaagtatgatgggagcactgacccagaagaattccttcaagtctactcgacagtgctttatgctgctggagcagatgacaacgcattggcgaactatttaccaactgcgttgaagggttctgcacgttcatggctgatgcatcttcctccctactcaatctcttcgtgggcagatctgtggcaacagttcgtcgccaatttccaaggaacatacaagcgccacgcgatcgaagacgacttacacgcgttaacatagaactctggggaatcattgagggaatacgttcgcgctttaataagtgcagaaacaccatttccgagattaccgacgcttctgtaattcgtgccttcaagtccagtgtcagagatcgctacactacccaggagttggcaataagacgcatcacaactactcgaagattattcgagatcgttgagcggtgtgcccacgtggatgacgcgctaagacgcaagaacgacaagccgaagaccgggggagagaagaaaccagccgcagacgcatttgagtcaaacaagaagaaaaatcgcaagaacgggaaaaggaaagctcaagcggaagtcctcgcagctaagtacgcgaaccctcccaagcgcccaaacccacagggcagcgatacaaagaaatcatggtgccccatacacaaagcggacagacattctctggaggattgccttgttttcaaaaagtcgctcgagaagcacatggcatttgaaaagggcaagcgggtacgtgttgtcgagaagaacgaggagacacctcctcatgaatcggactctgcgtacccgaactccgacctccacatctcacacatcttcgacggctccacaacgtactcctccaagcgagaatacaagaaagtggaacgtgaagtctgttcgacgtggcgggtggctgcacccaagatgaagtggtctgagcagagaatagagttctcggaggaggaccaccccaacacctctgttatcccaggtcgatatccgatcgtggtcgagcccactattcggaacgtcaaggtagcacgagttctcatcgacggtggcagctcaatcccacaaagtgagttgacaccaactgatcaacccttccatggaattactccccaatcatcatccagacctttgggcaagatcacattgcccgtgaccttcggccaagccaacaacttccgaacagagcagatcacctttgatgtcgctgaatttaatacagcttataacgccatcatcgggagaactgcacttgcgaagttcatggccgcatcccactacgcatatcaagtgctcaagatgccgggaccgaagggaacaatcactattcaggggaatgcaaagctggcggtgcagtgcgacaagcggagcctcgacatggtcgagcaaacgcccaccccacctgccatgtctgagccacccaagaaagtgagcaagctaaacaagacgccgaagccagacggcgccatcaaaatcgttccgctctctagtgctaaccccgacaagactgtcaaaatcggggctacactagatgagaaataggaactcgcgctcatcaccttcctccgcgacaatgccgacgtgttcgcttggcagccgtccgacatgccgggggtccccagggaggtgattgagcacaaactaatggtgcgacccgatgccaagccagtaaagcaaagactgcggagatttgcaccagatcgaaaacaagccatacgagaagagctcgacaaacttctcaaagctggcttcatcagagaagtacttcatccagagtggctagccaacccagtcatggtgcggaaggccaacggaaaatggagaatgtgcgtcgacttcacagacctcaacaaggcgtgccccaaggatcactttcctctccctcgaatagaccagttggtggattcaacagccggatgcgagcttttaagcttcctcgacgcttactctggctaccaccaaatcagtatggcgaaagaggacgaggagaaaacaacgttcatcacgccgttcggggtattttgctatgttaagatgcctttcggactaataactaccgggaatactttctagcgcacggtccagggcgcacttagcaaccagcttggcaacaatgtcgaggcttacgtcgatgacatcgttgtcaaaaccaagacgagcgactcattgattgatcacctgcgggaaacgttcgacaacctccgacgatatcgccttatgctcaactcagagaagtgcacattcggagtaccgtcggccaagctactcggattcctcgtttctggcagagggatagaggcaaatcccgagaagatcaaagcaatcgagaacatgaagtcgcccacaagactcaaggaggtgcagaagctaaccggatgcatggcagcattaagcagattcgtcgctaggatgggagaacgaggacagcctttcttcgccttgttgaagaaacaagacaaatttatatggacacaggaagccggagaggcatttattgcactcaagcgctacctatcaaacccccctgtactcgttgctccccaacctaatgaagaattattcctttatattgtcgccacgccatattccgttagcactatcattgtcgtcgagagagagaaagtacaacgaccagtttattactcagcgaagctctccatgatgcaaagacaagatatccacagattcaaaaactgctctacgcagtcatcatgacatcaaggaagctacgccactactttcaagccacagagtcacagttgtctcctccttcccacttggcgaagttgtgagaaacaaagacgttctcggccgcatcgcgaaatgggtagtcgagctaagccagtttgatatccactttgtgccgtgaacagccatcaaatctcaggtactcgccgacttcgtggccgattggaccatgccagataataagccagacaaccaaggcgacaatgagacatggacaatggcgttcgatggcgcactcaacagccaaggagcaggggcaggatttatcttaacatctccctccggagatcaattcaagcatgcaatccacctcaacttcagggcaaccaataacactgcagaatacgaaggactactcgccgggatacgagctgcagccgcacttggggccaagcgactaatcgtcaaagggaactctaagctagtcgcaaaccaggtgtacaaagactacaaatgctccaaccccgagttatccaagtatctctcagaagtcaggaagctagagaggaggttcgatgggatcgaggtccggcacgtctaccgcaaggacaacgtcgagccagacgatctagcacgacgcgcatccagacgagagccgctcgagcccggcacctttctcgacgtcctgacgaagccatcggtgaaggaagtaagcggtgaagttggcccgaacacccccgacatcagctcggaggtcactgaggtagaacgcgccgttgttgacatcgaaactacagacgactggcgcagcccattaatcaaattcatcagcagcgaggagttgcccgaggacgatacagaggctgagaaaataatccgcaaagcaaagatctactgtatggtcggcaacgacttatacaaaaaagcgccaaacaggatatttctcaaatgcgtctctaccgacgatggcagacaacttctcctcgacatacatgaaggcatatgcgggtcacacgccgccggtcggacattggtcagcaaagcctttcaacaagggtttttctggccaaccgcccttaaagatgcatacgacatggtccagcgatgtgaagcctgtcaattccacagcaagcacacaaagctacctgcacaagcgctccagacaatccctctgacttggttgttctcatgctgggggctagacatacttgggccattcccacgaggacacggcggctacagatttctatttgtagcgattgacaagttcaccaagtggatcgaagcagtacccaccggggagatcaaggccgataacgccatcaagttcatcagagggatattttgcagatacggactaccgcaccgcacataaccgacaatgtctctcaattcatcagcgccgatttccaggactactgcatcagcttgggagtcaaaatatgcttcgcctcggtctctcatcctcaaagcaatggacaagtcgaaagggcgaacggcatagtactacaaaggataaaaacccgcgtctacgacagactcatgtcacacgacaaaaaatgggttgaagaactcccatcagtactatgggccgtacgcactacaccgacaacgtccaataaggaaacacccttcttcctcgtgtacggttctgaagccatgctccctggcgagttacggcatcaaagcacacgagtacagaagcattccgacgagagccaggagaatcagcgagagatcgatgtaaaccttctcgagaagcatcgtgagcgagttgccatccaagcagctagctatcaacaggccctccgccgttatcatgagaaacgaatccgagtatgcatactttcgatcggcgactacgtcctcagacaagttcaaacccaagcggggcgaaacaaactctcaccaaaatgggaaggaccgtacgcgatcacacaagtcttgcggccaggcgcattcaaaatggccgacggcgacggtcgcgaactagcaaattcgtggaacattgaccaactacgtaaattctatgtatgagtcaataccgctatacctgtaagcacccttgcagtatcaataaagcctacttcttggtctcatatcacgaccaaagtgctttcacccaatgaccccttaccctaacgacgcctaacgttgaaacccgacaaggcctccgaggaacctaagggatcttcggctggggacgcccagagccgataaggtcttgtcagatccttcagagatgaaagaccatgtaagatctggtcgtgtaagagttctcgccgtgcgtattaaccaagccgtgtaatcggaaaccgagctttccaacttcacggctggggtctaggatcagagcttattcaaccaaaacaggccaagggtccaggagccttgtcacccgaggaaatccctccgacgacaaggctgggggctagggagagtgtacgacccaaacggctaactaaagtcgttaactgagaacacactcttacacacaacacccagagtaagaaaacatttcttaaagataaatttctttattcacaaaatattccttacagtttatacataaatattttgctgcattatatcttcccctaagatatttggtcgcaggatacaagcattaccaagacggccaacgccagtccattgattggaaaactttctcggccaacggcgacatcgacctcgcaaggtggtctatctccgccgggttcctccgagaacgtggaaaaacttcacgtaaaaattcgagatccagccgcgggcggtgatctcgcaggcaagccagcacgtgtcctccggcatatcggctcgctcgacgacactcttgcttcaaggcctcatcgattcgcttgccaatgccatcgagttgggcacaggccccgttgagccacgagatgtacccggccgccaattcctcaggatcaccgcagattacccgaagctcccggcacaccctggccatcgaagtgcagcaactcttcaagtaagacgagaaccacacctcgcggcctcggagcgtttccacagcttgctctttctttacggctagcattgccctcttgagttccgtcacttcaaatttcgtcttccagtataggatacgacgatcttgggtcgcaagggcatcctcgagatctactaaacgtaacgaccgctaagacaacccggaaacccccaaaaacagcatcaaggttgataggctactcacttgaggcagttgtcgtcatctcgacttccacatcaagagttgggtcctcggcgtcatgtgagacgtgcggttcaaactcgagtaccagaattatcgccagtgactcgggttgcccgcgctactggacatcctcgttattagcatctctacaatttacaaaaaaaacttccgagatcaacattgaacaaggatggtaatcacatgcacgaaggcaaccagagttcaagatttacaaatgacaaaaatacaagaggccctactcttcaaaaagggggaggacagactccccccggtcactaacttcttccatcacctccctacgcgtgtcgcttgccgccccctgatccaagatctcacgcagatcgagttcagggcgcgacaaccttacacacgcaaggacgtgacacgccccggtgaagataccgttggacgtctcctccgcgatcctggccgtatgcttggaggggatttcccccatcgccgtcgccagctccacaagagaagaagtcaacgagaactcatcggggttcaccggggtcgtggactcgacgccgcactccctggcgagctggtggaggccggtgtaggtcacccgcagcgaaccacgaatctcggagagattgtctcccagttccgatatgcggtcctcgagccctttgcgttggcgctcgttcccggccaccagctccctcattttcgtgaggtcctcgtgggcctcagccagttcccgcaccaaccgctcggcgcgcgcgtttgccgccgtcgtctccgccctcacctctgagatctcgcggccaatgccgcgagcaccagcttcgagaaggtgccccattttgacttggagctcctcccaggtgagggcggcctctggcagactacgacccccagcaggatcactgacggggccggtcggcgtcgcctcccgactcccgaccacgggaacgacatctgttgatgccgtggcaggggatgcgctggatgttcccccggccttggcccgagcagctttcgcccgcgcctccctgtaaaccgccacgaatcaaaactccactcgagcagaagacgcgagaatctaaaagtttcttcacttacttctcgccgatcgtcacaatgcgctgacgtcgtgcaggcggcggagacgtgtcggaagcctgcgagacaaccgacacagagtgagaacaaaccttcctcgtcatataaccggatgataaggtgaaaattaccgagggagtctccgtcttgcggcggtgtccgagcacagacgagaatttcctcgccttactcggagcttggccaccactagtagtggcagcgtcggacgcctccttgacgaccttctctttcagagatgccgccacctgatgattcgcgagtggaccgacgacatcagtcaaaggaagggcctacgctaaatcatgtcataagctgattttgagcaaaagaaggcagacgcttatcgaattaactcacattgattgcttcgtcgcgctccgccgctcccttttcacaaaggggcgcggggatgtcgctcaccgtggtcgggccgctgatcatcacctgaccaacacgccgctccacggtttccctgctcagacctgtcaagaagaaattagtttttgataggtcagaggggaacgcgagtacaagcatatcgaagtaaatgcgagaaagataccccgaggagaaacccgggtcgcgtcatctggcccggaatagttataggccgggtgggcccgagcctggagcggctggattcgcctaccgacgaagtctgcaacgacttcatatcccgataaaccccgttctcgaagattatcgatgatgtcgataaacgattggagagagggggtcaaggggggcttggcggtctagactggaatcttgtccggttgttcctcgggaacagcgaggaccggatttgaatccttgatctcaaggtaaaaccacatgttccgccatttgctgcgaaaagagggacactggaaggggacataacgcaacttcatgccatcacgaagtcggaacccgacgcaactagatatcctattggattccatccagcgcaactcgtaataaaagcggaacagatcaagaaagggttctaccccaatgtaggcctcgcagagatgcacacagacgctaaggaaagtaatggaattagagtccaagtgcagaagagaaagcccacagaaattcaagaccagtagaaggaattcagagggtggagggagaaatccgcagacaacataatcttcgatcgcaaccatgcgacctaagacgggctgaggatcagtacctcctgcttccctctccgtagttccacggctaggaagggcgccatcctcctggagcttcttcagggtcgcgctggtggaagccgacttgccgagatccatcacagctgcaagatcaccggagatgaacctaaagctgacgaagctagggttctgtacggcgacggagaaggcgaggaatgctaacgggcggtgtgtgtttgacggagtcagcggactccaaaatgcgcacccaaaatccctttaaatagacgcacccccgacggtgcaaattccaagggactgagagaaatcctcgccggaaatttctaggtccgttatgcgcggcagtttttgacttcagttcaaaattcactcgtgactgttgggcttcaaacgacatgttcgattacaagtcatctccgaggtcctcacacctggaatgatagcgttctcgacacccgaagtcgcgaatggtcacacgagttcattttgagcagaagtcgggggctactgtcagggttacgggtctggcataccctctacccttcgatatacattacgtatcgacgtggcatgcccacgcgtacgcggacatttccttcataatctaaggaaacttttcacgaaatcaacagacaggaagagtccttctcggacgaggactgggttacctacgtatcatgctaggtctggtgtgttcgagtcctactcggagagcatcagacctatggtataaaagggaccccccggggagggcattggggatcgaatctcagagccaacacaacccacacagtctacgaagtcggagcctgcgaggagccaagtcgtcgagagctagtcgaatcaactcgactacaatctcgccggatctgacaagttccatcttttcctttgtaacctgtgttttccgctatataatcccatatcaactggattagggctattacctgtcaaggggcctgaaccagtataattcctgtcttttgattgcttgatgtcgtactacgtagatccttgtaccagcgtacccctg

SEQ ID NO: 81219 - DNA, 4430 bp, Oryza sativa
aaacagtaaaaaagcaatatgttgtgaatcctactcaaatattttacctggattactgactgaggcaaattattgatctggctttctgaagcaccagcatgctggtggttattttcatctaatgcaagcagtgcatcataatcatttctgcaaggaaacttcctttagttaaaaaaaatatcaaattttccaatcaaataaaactcgttaatatcagcaaaatggtatcacggtatatacttccctatcattactgtatactagcactattacttttcacaggcatagaagaaagtcacccagcaaaacaagtaaataaagattatcaaagaaatattcaagttggatgacaacttatatgaaccagctatgatattcggtgaaaagcacagcaggtaaagcaatggaagtaacaacaggagaaagtcacttacagatcaatattaggttgaatatgtgcagcagggtatctggaaagagctctctgcaaaaatgttggctagaagctgttaattatctttcggaatcatttcaataaaagaaccaccaactgtaaatgtgatgaaaggctttacttaatctgaagtaatctactacacaacaatgtataaggggcagcctctcaatcatacacacaacccaaccgttaggtaacacaaaaggggatcttgtttcctttgtaaaggacaggaaatgcatgaggggatcaaatactacaaagagatgaaatcaaccagtttgataaaatatgaaatttattgaatctactgaaaagctcaaacagagctaaagtacaaaacgacggttgaaatcagtgtcagttttgagccataaaataaacgctttattggctatagaaggacatataaaaaacctaaatatttgcccttccaaatttcagtgtatgtcacaaataaaaaaaaacatagaacaactttcatagcgtccttaagctatttggcacattttacaataggttaagaactagaatttagtttatactgtaatgcacatgacatggaagcaaagcaagataaatgacagttgactttttaaaccaaaagatttttcctgttcagaagtagtatcaagttttataggcaataatattgttacaggcaagagaaagaaataccactcccaaagttattagggtagcatacctggtaaattattcttctgttgtttgagtcatatcgaaccctattagcatgctgaggaacagttgaacgcaatacccttggacctctctaacaaaaaggaacaaggaaaagagaaaacatgtcaatgtcaacagattagtgtattgttaaacaacacattcaaggaactctgtcataaaacaaagcccatcatttggatcaaccacaagaaaaggctggtttgttatgggcagcatgaactgtcataacttgtgcaaactgaaggattcctgtaatttcattttcggcaactgtgatctcacatagtaaagacaacagcagtgtgtgctatagaaagctaacagatgtgtggatggcatactactgacgaatggagcaacaactatgagacccgaccctcattcacacaggcacgctgtgatatggagaaagtaaagatgaacagcaaggtgctcttactgtagtgctttggaaccgcctcgcagttctagatgtcggctgcgcattatcttcatgttgaagtgacattgctatgatcgcatcaatctgctttattaaaataaaatatcattgtacagctcgcaaaagtattttgagagagagagagagagagtcaggaattacacctcttctgtgggaacaacatgaggagtttcattgtaaagctgctcctgaagttggcgagccaataactcatcagactccaactgttctcttatgttgggatccactgaggtccgattgctgctaccaatcccactcaaactaggccttacttcaggagagcatatgtcatcaatatctactacaggaatatgatgacggtgagtggtatgatttctagcagctgttgagtctgatgatgcaactctaggttgatcaacatcaacagagctagagctttcaccaggatggtaagaacttgcgatgcgcttcctctttctgctactgatccttattgttctattaacaaaactagcagtctgcaatgtttttgctccaccaattgagttattgttgtctcctccctcaattgagttattgctgtctcctgctgcagatgctcgatccagattagactgttcagaagatccagattctcttccacaactattggtcatcttacctgatagtggcatgggtatattactagtattattgtgcgttgttctccaaccttgctcagaacctataccggtgtgatcattgtttgcaacggaagaagaatctcccatggatcttggacaaaccctaacaatagtgaaagtgcaggtaaaggttctagacatgcaataatctaaacatagcaacaaattaatcatgcatttttgtaagtccaacaatggagcaaaactagtttagtcatactgtatgattttaaaggaaggttattttgctgaaaaaaaaagatttgtaaaaagaattagcatctcctgcttacaattttcaaaagttcacaaattgtaaccacatgcacaagaattttgtaaacttaaattcaaccaataaaattactaccctaaaagccagaatttaccttatcgcaaattcacagttcttttaaacaaaaacatttcctccatatcttgtactcatattgatacatcctagatataaatgaaatgaactgacaatgcccataggaaaaaagagacaggacatacctcctcatataagcctctccagactgcttagcacccacgacatcatgggaaatttcttttcctttattcttgttaccttcagaaaaaatactgttcacttgatttgcagccagtggaattaccgtctccccagctctgcctattgccgactttctccctgaccttttttccatgtcagttgcagtgtttccctgccttcttattataggtgaactatcagtaagatctatcacatttcccttcccagaagcatcaacctgagtatctggatagtgtaagagtccacttgtagagcatatttctcgcttttcatcaaccttcagacttcttttggctatgttggagggagaaatacaaccattccgcaccagctttctttggcccacatgcctttgaggaacaatgcttggtgtagagcttgaaattcctgttgtgcccttgtcagtgatctcttcccctttgccctctctaggactcgatactgaacagacattagcacctactacttccttcggcttcttaaaggtgatagtccccattctgtttcgtggttttcccaccgtagtagtaggaagacctgatcctaaacagagaaagtcagcattgcagctattggcatcccgtgcactaatatccccttttctgatttggcaactacggtccctttctccagagcccctgcaatttatattgtttgaaatattcatgctctgatccaaaccagatttttttggcaccttttcattctcaacagatgtctctatcgtccgacctgattttagcaaggatgatcttgcttcaggatcttctgccactggcagcaatcgtgccaactcggcttgtttaaaaatatcgccagcatctaaaggtgcaggcgacacactacttgcattgcctctacttgattgaccctggatggagttatttgtgatcttaaatttaattcttcgcgatggtaatggagttccagctgcttttgcaatacctctcctagcagctgggctagatacagggcatgttgactgctgtattcggtcaggggtgtccggaacctcaaagatgtgatcagggtttatgtcaaccatggtatcccaccgaaactatttcagttacagatagcttgcctcctctcctttacatgtcaatttatgattaaaattctccaacacttcctacaagatacagagatgttatgaaaagagctgccttacaacaagaaccagtaagtaagatttgttttagaaagaacaaataaacttagcaggaaaatttggtctgcagtaaaaaagaaaagaaaaggggaactgtttctgtagtaacatgcagcaggtgcttggcaccagaacccacaagatgatggccaacatggaggtggatgctggaatccttaatctggttggtgaaggaacgaggtcatgaagtgtaagtaacaatgatggtctggaccattttcactggattcacaagctgctcccaaatatattgccaaagaaagaaatgtagaagtaaacaacaaactggactggatcaagtgaatactttcttcaaagagcatgcttccttgaatactcaattctagcttccagatataattattcaagtg

SEQ ID NO: 81220 - DNA, 739 bp, Oryza sativa
caagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacggccagaaacccatcaggttggcgctgaagtttaggataaattatctgaagcttaacaaatgtcatgctaaccatcttctttcctgaaaccagtggtggaatcccacattgcttcccccaattcggtcctggtaccatgcagcaggtttgtgaaacccattttctgttgtagccatttagataggaaagaaactaatatatttaaattctcatcagagcatatgactaaacagactttgatacagtcaagtgaatgatatcatatttcagattgatgtcacatttaatatatacatcaatctggaaaatgcatgtagtaacatgttaagcagggaacccaagttagcctgaaatgaactacctgcagcctgccaaca

SEQ ID NO: 81221 - DNA, 2407 bp, Oryza sativa
tcatgtggctgccatcgctgtcgcctgcaggggcgtctgatgcagatgtaccggtgcatcatcttcagatatcaggccatcttttaccggcatgggagtgttgtcgcatttctcgttggaccgaggaactgtcaaagctgcattgtcaagaaaataaaccaagacaaaccagtataaggttctgaatatgcaaacttctacgtatcaaattgtcttgactctttctcattccacaaaaaataaaaatcttagtccaacttggctaaatgtcaccattaagaaaatgtaaccacatatgtaccactatccaaattattttagaacactcaaagaattccaagtagttgtaatgttagggtcggaatcgtctccacgaagaaacgcaactacgcggatgtggcaaccgggccacgcagcgtcgaaggagatcacgcgagctgaaaactgacgtggcatgccggaatagggataatgatccgattgcttacatttagagaagagtttgttatccctttttattagctaattcaattcaattgtaagcctacttaagggccacgaaatcatgaataaaccaagcaagattcaatctatagtcccatctccaattctctactctctcatcccctgcttttgctttcgtcgccaatcatgggccggacgtcgaagaggctgccaaagcctcgacctccggtatttaattcatatcccattcggtcattagccggtgctcataacacgtattaagatagaaagagaatatcaaaattacccacaaggaaattatatgagcatatttgtcagctatatactatcctttttaacactgctggatgacaggtacttcctccgtttcacaatgtaagtcattctagcattttctatattcatattgatgtgaacctcatcttaataaatctagatagatatatatgtcttgatttattaatatcaatatgaatgtgggaaatgctagaatgacttacattgaaacggagggagtatatcgcaaagagagcggatataaaaaaacatcaaattcctttaaacaagagggcgcatgatctatttccttataatggtatattcaaataaagaagtgaacctcatcttgagatgattaaatcgggagaaaattatttgaagtaccatacctgccgcctcttcattaggcactggatgctcacttgttgaggtgtcccaagaggaggatgcaaatggcgctgagcttgatgcaaaggaagaaagatgagatgaaggcgatgagagctggtttcctggaatctgttgtaccatacctctagttgcacttgactacatcaagaaacaaggacatggacaattagttagtatgatattacaaaattttcgtgaaaacataaatctaggcaataaggagaatcccatttaaatttataacttgctggcctctagggagttttttaatagaaggaacactctagtattttctctatgaagtgttaagaactactgaaaaaagtatgattcatgttctggtacccaattagatcacctcattagaaaagggatcttcaattcgagcacaactatacaacaaagtttccgttcgtcatcattttcagttggtagtgagaaactggttcaaattggcatacaactttctcaatcaccagtaactcaaatctatcaaagataaattaagtattgacataaggaaatttcaaaggaaacactaagcaaattgtttttatttctttaataaaatgtaagtttacctcagtgacaacttcaggctcctcaattctatcctcatttaggtgtgagatggaggccaaatctttacttggattattccttaaaagttcaatctcagcaggttcctcataagtgatctctgaaatttcactgtttcttgatctgacctgctcagctttctccgaccgttggcaggactgggaacttctggtacttagagaaaaggattgtactatacaatcctgacacccagaaacatcaagctgaagatttttaaggttttgaagtgattcaggtagtgctttaagtccaagacattgtgacaaattcagagactctaaattattaagcttgtcaaagcacgatggcaaatattcaagcctagagcagttcgagagattcaaaaaccgaagagaggtaaggcattcaaaggattccagcagtttaagatcagaacaatatgaaaggtttaggcttttcagatatgcaagttggccaaatgattgtggtaatacctcaagtttcaaacattttgacagatttaaatactgaagtgaatatatgttgccaaaaaagtcgggcaacatttggaattcaaaaccacttaagttaagatctaccaaagaacagaggctagcaaatgattccaaaaatctgataggtaatgctg

SEQ ID NO: 81222 - DNA, 1193 bp, Oryza sativa
cagcatagtaccagaacttcgattgttccggccaattagcggtggccggttcgatacccctctcaagcaagctaacctccatctcctcccacttcggcatcgcgatgctttagccgcctgaccccaagtggtgatggtacttcttcttggcggtattttctttgtttctttccatcatcgcctgcccttgttcacctgtcttatatgcaacgaactcgtcccagtgatcccttagctttgggaatgtgtcgaagttcggtgtctgccccttgaggatatatttctagtacagatctcccttgaagctctgaaattgttctgccattttcttcagagtccaccttttcactttgtcctctgtacccgcgggaagggtgaatgtctcgagcattgtgtccatagcatctctttctccgaatctgggacaaagctctcatgatctccgcgtgcccttgttctgcgccagtacaccgtactgacaggcacgttatcccgcacaacccaaccgctgtgacgtacatagttcttggcggcttctgccggggcactaggtcgtccgtcttcgtccacttccgttatgatgtgctgaccctcaagcttcttcgcggcacctcgttgcccgcgtgccctcttctgtccaatggagggttgacttccactagcctcctcctcctggttcccctccacatccctttccgcgtgcccctcctggttcccctccgcattcctctccacgttccctttctcgttcaaatactggtttggatcctcgttcccctcttcttcgttccagtactggctgcttccctccgcgattgtatcgtacaatatctgttcctcatcgcgatcagccatctgttcatacaagagtggtcgtatattagaaccctacacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtattttagaaccctacacaatcttatacgctaagtctaattacaaatctaataatcttatactcaaactcaaatagtgatatat

SEQ ID NO: 81223 - DNA, 32814 bp, Oryza sativa
agcatcgagtaaacaaagccccaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaatgatcacggccaggtaaaatcttagcaaatttcggattccgaaacgccttaaaattcgagaagagaacgaggcgccgttctacttgatcaatacgtaaggaagacgggcagattgcatcaggaacagcaaaaagaataagaagagggcatttggtttatacaaattcagaaactgacacctccgcaacacaccaactgcaaaacaggagccaaaaaaaaaaacaaagcagagaagagaaacgaattcatggcgtctaacttctcgcgcacgcattggtcgcgccaggaaccgtcaagatcaacgtgctccgatgggagagaggcgaacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgagagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattgggctcttttaagtaaaactggttccagcttaaagtaaaagtaaaaaaattggtccctgtttttcgttacaaattgctgaaaagagctgggtcactgaatttgtatactgaaggaatgagagaaatgagtaggttacagaaaactaaagcatataagggtaggttactgaaatgattaggcgatgcagacaaactttgatacaaaaccagcataactgtactcctttgttcgtcaaaaaatgacctattattattgtgtgtggttttaagaaacaaatgtcatcctattataccataattgctctctacgtcgacgaacaaaacacgaacaagtgatcgataacagatatagaccagagtacttactgatgagcattctgtatcaggatctgtttctgcaacatgaagagcccatgtgcgtatccattccaaaccagtagaaacatcctgatttccttctataagagatgatgcaacatacgacggatgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcatacctagatctgatcatatcaagaagagctggggcaacagctgatgcttctggatgcattgccatgcacttcatacagacaccaagcatgtatatcaatttacctaggacaacaaagtcccgattgagcaagtcaacaccatgtgatcttttatcatatccttgcataacagggagcataaaagcagcagcatataaaggaaatctgttttttgaccactctgtctgcaaatctttagcttttccaagaccccatttacgagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcagcctcagtcataacatcaataatcaaaatgcgctgacttacatccacgcttgatgagtacagcaacttggtgagaacatctaatgattcaaatgtgcaggttaccagcaaggcaactaatgccttctgtctcttttcttcagcagaatcttcctctccttccattgccacgtcagaacatcgaacatgcacaagtgctctaacaagatcacctgagttgtggcgtagttcatcaggtgatgctctcacaagcttttcggcagaactcagagcgttttcaaccttgggtaaaaaagaagggaggatgatcaggattttacaataatttgctctggaaagtacaggtagcactagatagaaacttacaccgtctggatcatcaggttttcgtagtgcagcagcaagatcttttaattgggtgaatttcttctgcaaatctgagtcatcgtctgacagatcatatggctccagggatgaatcactggaggcatcaatgttcattatttcctcatcacattcttcctcttcgaaatgcccattcacagcagaaccagacgtttcacaagaatctagtgatttgatctcaatgatttttgccctgttctctgaagtatcatgtttaatagcctttgcccttctctcaccagcatgtttcttgttctcaggcaaagatggtttcagtttgcttataagttctacatcctttgaaggggctgtgatttccttcggagataaaaccccaaagtcccactcaacattctcacaacagttatcatcaaggtatagaggattgtttggatcaacaactttagaaaatgtcaatgcaatagcactggccatcttccggattaaatcaattggactctctaacctacctacagcaaaagagcattcagtattaccataataataatatgataagctaatgcagggggggtggggggggatactcacagcttacaccttcaagaatattgttcaatacatctttagttgtttctaattctctttttgacatcttctccaaacacaacccaattgctgcagtgatgtctgagtgttgtttaaggggaacaagtcaaatgataatttgcaaataaaaagtgtgtaatgtaatacagttttgagtgcctcaaaggatacaagcttgttgctccactgagtatgcctggacaaactctttcttggaccaaacactgactaaagtttgcagtgtaccaaggaagctcgatgtcctttgcttctgtgtttctatgcctgaatttggtggcaattcaaagacagcatagtgaagaatccatctcagacaacatagagggaatgttttccaacgcaaaaatttgtcaacaaacattgccctgaagaaagcacagagaattaaaggatgaaagaaaagaaaagaaaagacacgttgaagattatttgatcaatcgctgcatgccaattatacgctgaatagacacccataatataagcccatgctgaaagttaagtaaacatacatggcaccctgtttgtcgttcataggaatgaagtaacaaagacatacagggtatctgaagactatcattcaccttacctaaaacatccactaactgaaaaaaataaacctcagaagtactttttccttcacagataaatgtagcatgccagacacagatgaaccaatgtggataaactaaaaaacaagcacgtcaagtgttgcatagtattaaaatgcgcacatgtactatctcattctcacctcaaaaacagttttgtgcatgaagctctgattaaacaaagtccacagaatccagtatgcctcctcatcgcttgtatgttgtgatgcaagttggcgcaacatctcttccgccaacctttcaacagaatgctggtctctaatagcctcaaccacattaaaccaaaattgggaaacatgcttgatcttgtcaggacttatggttttatgatcagattccatacatctctttaagtgactacggatcctaggaatcagctcagcaactaaaatgcctgaaaagagcaagatatattatcagaaatacaacaaatagtagggaaaaggatggctacatagattacaaacaagaagttgttaatgactagaacagtgtgctaggatgatcagccatgacatgaggcactgctatcctgggtgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattgctaaaccattactgcaccaactagaactgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatagccgcttgttcagttgcaacaagaagctgatcgacaacacacttgaagaatgaccttggtttccatcaaggacttacagtttggaggaacaaacatagtgcaaataaatacatattagctgagaaaaagctaacagaataaaaggaaaggaaaaaaataacaaagatgtttgtgtttgtgtgtgtcgtgtttggggcggtgggggtgaggatacgatgatgtcagtgcaggtgaagctcccattcttgttttatctggaacagatgcaagtagttgagcaacccttgaaatgaaagctgctctgcctgggttcaagttgtcatcatcgtgcttgctgcttacagtaaactctgcaataatctggctgacccccttattctcgaccaaacatagaattaacagcctgaaatggggggaaataatgacacaccaagctcaaaacatagttatcgggtgagaaaaaaggaagataccagataggaacagacccatgaattttcagatgaagtgtgcatgctagattgtttgatttcctaatgactcgagcataaaatagacttaagaatacaaagcagacgattggacaaatacatgatattagtacagacccatgtagtcgaagtgttgaaacttgaaattttgtcctacaaggtttgggtgtaatatttgaagttttgaactcacagggaattgtcaaaaagaaggatgtgctatagacttatagtaaaagcaaacaaagttggaccaataaaagattcaggtgtaaacttaatagaattgatagattgttcatgaataacctttcaatatttgaacacataatgttatgatcttccttagagcctcctttgtgagacaaagcaggaacaagagcttgaatgacttcagttggaggtcctttgacaaaaaacgaatcatatatttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcggagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttggagtccgtactacagctgactataaatctgtagcccactgcacttctctatcctcttttatctttttaaaatatgtctatagctggcttagagcaggtacaatagcataccattagttagctataaacatatttttatgagataaaaaatgaaaaagaatagcagcgggctacagatctgtagccagctgcagcacggactccaaaacacagtgtgtgtatgactggggccatatattaatagtatagtaagcaactattgtatgaatgagctattagattggctatggatgaattggagctagtagtggactatactattaaacttactcttatagtatgctattgtacctgctataaaactaacttgcttcttttcctcgatacagcaattaactaacttttctcagtagtcgaattatgcatcaaaagcggaaggagcgagtataaccaactgccaaatacgaagcatgagtgcatgattctctataagattcgaaaacaagctcgaactttcgaacgctttcattacaaccaagaaacatttcgatttcatattattgacatcatgtgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagaaacggcttcgcaagatggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccattgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagaatccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaagggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgcccagcgcctctcggagatggccgggactctccaacggctccccgaggagctcgagaggacgattaagtcatcctcgagggaccttgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgacccgggtgcatcggagtgagcctccaggtccccgccaatctttaaatagttttttcttcttttctttcttccgaagccttcgggcctcctttttgtatagattaacttactctgcaatcaaaataaagaaatttctgtgtcaatttcattttactgtgtgtatgagaacgaggatgatctgtgccatggtccttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttcaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggggccgtcctgggggtcgggggctcctggcatcgtcggacaagcgggcaaagggccaactctggtcgtcgggggccttaggccaccgttcggctcgggggcctcttctccctgctctctcccgggtcgagtcggcacagggttaacctcgaggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgtacacgcacttatcggggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatccgctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttaaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtcccttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgttttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatggaacacatcatgcacgttgcccaaggaggcgggcagctccaactggtaagcgacttctccgcgccgagcaatgatacggaaaggacccacataccgaggtgcgagcttcccttttgtctggaacctatgtactcctcgcaatggcgtgacccgaaggtacacaaaatcatccactgcgaattccaggtcacggcgacggttatctgcataacttttctgccgggactgggccacctttagattatcccgaatggttctaactttagcttcagcttctctcaggatatcagtcccgaacacttggctttctccaacttggtcccacaatagcggtgtccggcatttgcgcccgtacaacgcttcataaggtgccatttgtatgctggcttgataactgttattgtaggagaactcggcataggggagactcttatcccaggtcttcccgaaatctaggacacatgcgcgaagcatatcttctaggatctgatttagacgctcggtctatccatctgtctgcgggtggtacgcggtgctgaaatttaatcgggtaccaaactcttcttggagcttcttccaaaagtgagaggtgaattggcttcccctatcagatacgattttcttgggaacgccatggagactcacgatcctagcgaagtagagctccgctagtttgttccctccataggtggtcttcacaggaataaatcgagctaccttggttaatcgatccacaactacccatatagaatcatatccaccttgggtctttggaagtccagtgatgaaatccatcccaatttcatcccatttccattcgggtacttggagtggttggagaagtccggccggtcgttggtgctctgccttgacacgctggcacacatcacacagggccacgaactctgcaatttcccgcttcatgctaacccaccagtatttctccttcaagtctaagtacatcttggtactgccagggtggattgaataaggactttcgtgagcttcctgaagtatcagctgtttaagttctctgctatctggaacgcatacccgatttccattccatagggttccgtgttcatcctctgtgaaaccagcggctttaccctgtttcatattcttgaggagtccatgcatgtccggatcattcttctgagcctcgcggatttgatcgagcaaggtgggcttggcttccaacgcagccaaaaatccacgaccaactatgtttaggttcagggcttccatctgttggttaagttcgggtggaatgccacggacgttaagagtgttgcaatggctctttcgacttagagcgtcggcaaccacgttggccttaccaggatgatagtgaattcccacatcataatccttgatgagttctaaccatctcctttgccgaagattcagatccgactgagtgaagatgtatttcagactcttatggtcggtatagatttcacagcgattcccaatgagatagtgccgccagatttttagagcatgaactactgcggctaattccaagtcatgtgtagggtagttgccttcatgaggtcgtagctgacgtgaggcataggctaccacatgaccatcctgcatgagcacgcaccccaatccttggcgcgaagcatcacaatacaccatgaagtccttgcgggtatccggcaagattaacactggcgaggaaaccagcttttccttgagagtttgaaacgccttctcgcattgcgggctccacacaaatttctcttctttcttcaacaactgtgtcatgggtcgagcgattttggagaagttctcgatgaatctccgatagtatcctgccaaacctaagaaactgcggacttgggtaactgtcttgggttgcttccaatcggtgacggcggtcactgtttcgggatccacagcaactccttttgcagatatcacgtgccctaagaatttgacttcggacaaccagaactcacacttgctaagcttggcatacaattgatgttcccgcaactttcccaacaccagacggagatggtgctgatggtcttcttctggttgtgagtatatcagaatgtcatcaatgaaaaccacaacaaacttatccaagtattccatgaacactttattcattaagttcatgaagaaggcaggagcattggtcaaaccgaacgacatcaccgtgaattcatacagcccgtatcgcgtggtgaatgcagtcttcggaatatcttcttcacgaatacgtaattggtgatatccggaacggagatcaatcttggagaatacagtggcacctttgagctgatcgaacagatcatcgatccggggaagagggtacttgtttttgatggtgacttcattgagagctctgtagtcaacgcacatcctcttcgtcttgtctttcttctctacaaaaatcacaggagcaccccatggggaagtactcggacgtatgtaccccttttctttcaactcttccagctgtttctttacttcggctagttcatttgctgccatacggtagggtcgcttgtgcagaggagtggttcctggagcaagatctattcggaactcaatctctcgcttaggcggcataccgggtagttcttccggaaacacgtctccgaactctctgacgatgggaatttctgacagttctatctgatgaagttctgaacttctgacagaggctgggggtgcaaagaaaacaaccggttgttctggccctcggtacagagtaacagtgcgtctcgcgcaatccactactccttggaattgtgccaaccaattcatcccaagaatcacatccaagttcttggtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatcgcacagatataaacgagtgggaagctccagagtcaaacaaaattgtagcagggatggaatgaacgaggaacgtaccaacgatgacgtctggagttgtcagcacgtcctcggccgtcacatgattcacacggccccgaatgacattgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctctcctcggcccagccggcccagtccgcagccgcgcgcgcgcgttcggccgctgacaggtggggcccacccgtcagtcgtcgtcttcctcgggccgaaaccctagtttcgcgccgccgagctgccgtcgccgccgctttccaaatccggccgcctctttccttctccggccgaatcaatagaggggaaatgatctccgggatctcctctaccttttctcctttggaatctttggttaaatcgctttggaaagctttggaatcgagttcgattcggatcggttttccctctttccaagccgcgagtttccttcgccgttgccgtcgccgtgggccttcgccgccgcctccgagcccctttaaaaggacccccggtgtctcctctacccgtcgcagccctcgccttcgcctctcgtcgccggagtagctctagcgccgtgtgccctagcttcgccgtcgccgccgccgcttcagccgtgctccgccgtcgctccagctgtcgccgccgctcgggaagaccgccgtcgtcatcgccaagtcgccgccgtcctcgtccgccccttcgcagccgtcggaacccgctggagcttcgtcgccgtcgacaacccgaaggtagccgccgcttccttctcgtcgccgtcgccgtccgttgcttctccgccgtcgttttggtcgtcggtgtgttcgccgtgccgtccgctacccgttggtgtcctccgttcgtgccgtagcgccgccgttcgccggtgagcgtgcgccgcccgagccgtctgccgagccgagccgccgccgccgtcggtgacgtcattgctggcgtcatcaaggccgtccgccgtgaaccgccgtggactcgatcaatctcagccgtccgatttggatcggatcaatctcggccgtccgttcgcgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattattgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacagacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggcgcacgagtcccttgctgattctgctgctgctgcggctgtgggacgcgcaccacgaattgaggtcggggcgctgggcgaggttgctgctgctgctgctgctgctgctgcgaggaggatccccctgggtagggattggtgtagcgaaccctctggttagcaccctgttgattgcggaaattcgccaagcggcgcttgtgcgattccaactccttgtgcttggcttccaagcggatgctcttgtccaccagtcgttgaaaatcaggatagtccccagagactagacggacggacagctcagggtccattcctgccaagaacttctcttgcttctcctcatcttcccgcacatcctctggggcgtaacgggccaggttgttgaactcatgcaaatactccatcacggagcggttgccttgcttcaactctcggaattcccttttcttaagagccacgactccagcgggcacatgggttctccggaaagcggcggtgaagcgagcccaagtaatcggctgtccctctggctgcgtagcctggaagtggtcccaccagagagatgcgggtccctgcagctgatgggcggcgaagacgactttctcctcatcgctgcactgcaccgtgtctaactttttccccacggcatgcaaccaatccaaagcatccacggggttgttggagctggagaaggtaggtgggcggatgcggaggaactcggcgagtttagagtgttggggaggtggtggtggagcattctgttgtggcgggttttggaggtggtggaggaaagcggtcatcatgttggcttgctgggcgaggatttgggtgagaatggcgttggtgtctggtggtggtggcggaggcggaggaggaggtggaggtgggttgccctggtggttgtggttgctgccttcaggttggttgccatcaccggtagcagcatttctcctggtcgtcaccatctgaaaaccccacacagaaccagcaaacagagagagagaagctaacaattaaaactatccacccacgactaccataattcttaaatttattactgctattaaattggttcattaaagttcaagttgcttaggcaaataaaataagacaggctccgacatagttacaccacacaccggcataaccatgccccacacgactccaaaaaagacaaacgagaaagaacacacgcgcaagcctactaactgctcgtctactgctgcgacgggccagggcggaaggtgagcaacagcgcaccctccgtgctaccaacgccggaggcttccccctcctggggaaccacgggcgcaggctcggcacgaggggtctcgacgaagcaggtccacgccagggactgacggacaagctcaggcctggaggtgctcttgcgggcggtgatcttctggctgcggcagacacggcgacgcttggggcggcagatctctccctgggcgatcttgagctgatgcagctgcgcctccactgcgtcgaggtccttcttgagctgcaggttctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagccagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaaggatttttatttttgaaaatattgctaaggcttgggatctacggctcgtcctagggtcaagggaggctctgataccaacttgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcgaagactagggcgacgaccacaggcgcttgacggcaggcacgagctacacaccaaagccttcatcttcaaggagctcctcttctgggcttgggaaaaattgagcaagactgagtacaaccaccgtactcaacaaga

SEQ ID NO: 81224 - DNA, 4010 bp, Oryza sativa
gtgtgtttttttaagctctcatactctttggtgtgcgcaaaccttttcctgttcagcccaatggctaacaagcaaaagcgcaccaagctctctccgagtgttagcggtgacgacgggaagccgaacccacgccgtcgagctggtactccaccgccccctccacgccaaagtcctaggcggaagaaggcgctcgaaagggtcgaaggatccgcgacttcgacatccacgggtgatgaagaagggcgccgagatggggagcgtcgcctcttcgtctacggcgacggtagcacgccccagggcgcgctccaagctgcgggcgcgctcttacgtcacccgcccgtcgtccctgacccggagtctccagcccaacgttgctggacgacgtagccaacttggtcatgacggcacggcagcacctaggtgttggtgggcggtcctccgccactgtcacgtcccaaatcgactctaaaatacatcctcgaaattgtgcaaagaataattaaaattcatgtgaaagcctccaacaattaaaatgtgcaaagataaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaatccctaaaagtcttctttccccccccttttcccttcttgggccggctcggcccaactcccccccctctctctctctcctccccgcggcccatcggctcctccccgcgcgcgcgccgctgacgggtgggcccgcccgccaccctcgctgacgggtgggtcccgcctgtcatcttcctcctcgcgccgcgccgccgcccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggtgtcttcaatggagccgagatctccgcggccgtttcctccctctccggccgcgctctccccctctcggcgctatatatttgctccccgtgcctctctcctccgtttccgccgctcgccgctcgctctcgccgtcggattcgtgctagcgccgtcctcctctctctccgccgtcgccgccaaccttcggttcgccgccgtcgtcgctccggacttcctcccgactcggcgccacctccatcggcttcgccgcgttgtcgtcgaccccgtccgccccttcgtttcgcccgccgaccgccggagctccgtcgccctcgtcatcccgaaccgcgccgccgcgttcctccgctccgttcgtcgtctccgccgtcctcgtcgtcccggggtgagccgaggaccgtccttcgctttccctcttctctccgctctctcgggcgccgctccgccgcgccggtggtcgccggcggtgaccatcggggagcgggtgcgccgcctcccgtcggccgtgccggcgaggccgccttcggccgcctcccgcggctgccaggtggggcccggccgtcagccgcccgcgcccgcgggtgcggctgacttgtgggacccacggcgccgaccgccgccagccgcgtgctcccggtccaccgtggaccgagaggctgacgcgtgggccccactcccgtggacccggtccgcgcgccctctctctcggctgacgcaaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttgggggcttttgaatagagggggcggtgtgaatccaattccacaataaaccaacaattccaaagtgcccaggtgatatgaatatttcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctgcagcgtctacacgaccaacggaaaagaaaaggctcaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggttgaccgcccggccccaactggcaaccgcgggaggcggcccaaggcggcctcgccgg

SEQ ID NO: 81225 - DNA, 2234 bp, Oryza sativa
cagtatcactattgagatcataatacatactgatcagtgtgtgaatttcagtttaagtatgtagattagtacacgtcgaacacagcgtgacgctcagtatcagcagaaagattagtagctggacaaacacatgtaattagaccagaagcttattaagacctttccatactgaagcaacaaaaccatcaaaacaccagcacatcctgcatccagccgctaagaacacagcgcaagatatattaacacagataatatcaagcaagtaacagatgcagccagtaatctcacaagagccaacatgagactccgatattaaccattgacacgtgaaacacattaaggtttgataaataaaaagatctccagctggagtgtgacaccacatagtctctgaggactgtctgggactctgggtttatttattgaccaacattacagataagaaagcgcacagcacaaacaaactcgaagcactcatgacgcgaactggaaatactcatgacgaacgaaatactgaaaagacgataaggcgaagtaggcgatgattgggaggagattcggcgcatcactcttcctcagattcagaatccgcgctctggagccactccacgaacggcttggcattcttcaccacctgggactccttgccaccagcaacagattcattataccactgagttatcacttcttcatccaggacgtccccatcatacagggccttgagaacaatcggcacctccttcacagcttcggggcttgacttggcgccgaaggccaccagcgcttgcagcaggaccatctgggaggcttcatcaggcacagcagcagcgaggaatttcttcttcttcacaacctccttggcgaatcctttgccgaggccgccaaagagtgcatcaaaaagagcattcatagcatcctggggtggcagcgctgaggaagtcatcagacccttgagctgaacagcattggcacccttgctcaagttatccttcatctccttgaccagatcatcataaggactgcttttagcctcttcaaccacatgttttgtacttccgttggaggcaccctccttgtgtgaggcctcatgcttcttcttcttctcaggttcttcagtggacagcattaccatctcagcagttgcagcgctcagttgttcctgcatgcgctgttttgcagcctccaacgaagtgtcagtctgccactggacatcatcatcatcatcctcatctgcagccacattgtcaccatcatggctgcgagttggtgaatttgaatgatcctcatcagagccagcagcagccttcttcttcccagcaccacttttagaggaggtactttccttggatgcacctttcttctttgcttccttctttagcttcttcatctcctcatcagcagcctcaccttcctttagacgctccttctcagctctcctcattgccttcttgtctttcccagcacccttcttctgttcaggtggattcttcaggataaaagttgtgagcttgtccctcatgtcaacatctgacacaaaaccacaggcagcacacttcagtgtaatcatctgggtcttggagattaggacctcagtctcagggttgccacatccatagcattggacatacttcttgatgaagttctcaaggagaccagccagcttagcagtatcatgtgccccattaaccaaggaaataccagtcttctcatcaaatttagactgtgcaccaagctcacatccaaagtactttgttgtgtaggaagcaggcctggctagggcttttgctatatccaccatgttcacaatgttagtcttgatgccattgccacggccttctattttggtgatcatcctgggcatcttatacctgtagaaggcatcatcacggtttgaagcaccaatgttttgcagagccatcttggattaattttctttcgctgagataatatcagaagcaccaagagccaaaaggaacagtagtcttgtatccttgaaatgaatcagcagaaaccagtgcgcagcagggccttccaagcgagagcttgtgcctttttctcgttgtccgagaatattctccaagcaatccaactgatcccaagtaaagcaagtcttgttcagacataaaagaagcttcaacttttagaccctccactttgtcagattgcagcgaaactgatgttgcctcctgcatcacacgtcaacatcagattcttcattcaggggctgcaggaat

SEQ ID NO: 81226 - DNA, 3295 bp, Oryza sativa
gtggtggcgacgggaggagcggagaagaaggcgggaaagagaacacgaggtaaaaattgaaatgcgtgcgtaatttacgaaattgaagacagtgtgtgctttgatttgtaatggttttgtgtaaatttgaaatgaattcttctgggacaacgaaatgaaatcgcattaataataagctggtttgagatcagaagagcgagaaattaagctgcattcgttttgtaaaatgctgctatatcaatgattcaacagcaatggttatctcaatgtctgacaggctaacagcactaagatcaaatgatcattgatcaatggtaccttgtctatttcatatcagaaagtgagatacatttctgaataaatataagtatgtatcaacttttgagcgcttctttttcgaacatggagatattctcctattcctgcaacaattaaactgtaaaatatgaaattcatgtgaaaattcatcgaaatttctagatttcaaacaaatgccttagcattcaggtgagagcaggaatatgggagagaacagaaatacagaagatcgagaaaagaatcaaaagaaaatatgcgtggagatatcctccagccgaggcctttcagtcgttcaaaaggcatatcccagaataaatttgttcggaagggacaattgcattttgtgcctccctgaaggccacaaaaacatgctacgcgaagcatcaaggatcttctctacagacttggcctaggctcatgtgtgtgcttttgttaaagagacggagtagcatgccggtattgcacatttgctgatttgcacagttgctgtggttcatgagatgaaaagaaaagataactgaactgctctaacttacctacacatctatatttttaattgaattcggttggtaagaacttccagcttaaaaataatatgaacgcggtcaatctcgattgaaacatgcaagttcacttcctccgcctgatcacccggcgccatcgcccgacctcgccagcgcatgaaaaaggccaagagtgtcagcaaggcccaccataccccccctcctccgccttcttagctgtcctccttaagtcaacaacgctacccccatctcgtcgtcttccttgtcttcggcaactccctctcctcctaaccactctttttactttgccctcaccgctaatacaggtccaccgtttgccgcacatcacgcgtggaggcggatctgtagggtggttcgggtggtccctggatcataaaaaaaatcacaaccaacccctctactatatataatttcagaaaaaaaagaagaaaagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggtactaatctctgtgcccctgacctgtactggttcaagtcgatctcctgtgcgtgcgaaggattgatccctggtggtggtgtctgtgttttttggggggcgttcttggatggatgcaggcgctctaggagggtggtggccatggccagcgtggggcagaaggtgtacgcgcccggcgtggcggtctccgagggcaatggcgggctgccaaagatcgacctcaagtccccgcatgggaggtaattctaggtttggttgatttggggtttctttttattttaaggtgaaatatttggggtggataacttgtgtgagattcttggagggattgtggtagtttggtttgtgagtaggaatgttagatgtatggtgccaaaggtggaggaacttggttgtgtttgtttgcttgttttttttttttttttttgtagagatgggataaatatttgcactgcattg

SEQ ID NO: 81227 - DNA, 844 bp, Oryza sativa
attcctgcagcccacaggcccattcctgcaggtagtaggtattttagttcaaataaatatataccagtacaactacctgcaaaactatcatatcaaacaaaatattctccataagcaacagcaacatcatcctgaaatgttaacatacagggtgtgtttagttcacgctaaaattggaagtttgattgaaattggaacgatgtgacggaaaagttagaagtttgtgtgtgtaggaaagttttgatgtgatggaaaagttggaagattgaagaaaaagttgggaactaaaccaggccacagtatggttttcaatagcacaatacgagcaattaaatctataagcatacatgtagaatttccatgaaaatcataaggtttgcactgataaaaaaaagaaatgtgatactgtgataaaagatcggacatgagtagatcatttgatcacgatgcaggcatagtgaccagtgccatgaattcacccagctatatgacatctggaacgaatagtagcatacatgcaagggattagctatggtccctacctgctcaaccaaacagatcaagtcatacacccacccagcgctctcagacacaccagaagaaaccacactaaaagtgggatctggatcaatttgcgcaaggaaagccttctacaggacaggcatgtacctagcaggtaggggaggagaactgataagtagtacctcgtggcagggatgaccgctggatctagccagccaggtgagagcaggctgggaaactcccaggccgctgcacagggacgtctaagcagggagaggctctcagcttcttctccttcctcaccttggctgcctgcctggtt

SEQ ID NO: 81228 - DNA, 1270 bp, Oryza sativa
tgatactcccatgcaaagcaatcaacatactctttaagtagctcgattatcttaaccttataatcgcactctcatatttttgtttacaaaagtcggccttggtttggttccatcacctatgtctactgcctccaacggatcggccgatgtaaacccttgtccaagcttctccacttcatcaaaatcttcaatagtttcaccaatatcgttctttgtagaccgatatttttgcaccctcttttgtaaccactctaaattagcctctttactcattatacaaatttatatggcttagccgtgctacactagccagctttacagagataggtacaaattttccatcggagatactaataaaatcatagctagaaagattcctccccgataagcattgaatattcccatgacgccactcaaaagtagcatcggccattgcaacctcggctgatgtatccgcttgaacaatttcaacatcatcgccgtcccattgaattaaacattgatgcaaggtagaaggcacacaacaattggcatggatccaacaacgacccaaaataacattgtagttaccttgcacatcgacgatgaagaaagcggttggtacgtcttgttccccacggtaagttctgccgaaaagataccctccgcctccgttggttcaccattgaagccattgagaatcatgttggtcttcttcaactcatcatctccacgcccaacttcttgaacaacgagtacggcatcaaattcacggcggcacctccatccactagcatcctagagaccgacttcccatctatatgacctttgagatagagaggcttcatatgacggtttgactcatcggcttctcaaaaaccgcatctttaggacctagtgaaaattgagcaacctcagcttcatccatagcacaaaactccataggcaacatacacgccatgttgacctccatgtcttcctttggagatgcttcatctttagtaactgattgttcttccttttcctcttgcaaaacaactggttcttccttctctacgaatttactcctccataccggtggtggtcacaactcattgaacctcctatctctttgttcttcggcctttttctctcttatctcttgagcccgaagacgttgcaaccttctccttggagtagccgtcaaatcctcaggcatccacctaggtttctgctttgttccaggaggtaaatagaaacccctgttaagtctatttgaagacgaggaagcccctacattgcttcctgcaaa

SEQ ID NO: 81229 - DNA, 629 bp, Oryza sativa
ggtgagttaatcatagcccaagttaactgctgcctaaatgagtctaccatactacttagatacttgtgatatcatatcaccaaaagctttgcaatggattttaaaataaatgtgctattttgttctatccttacatgtggaaaacttgcaacattgttcacactagtaatatgaaatctgcggagaatgtgacgatatacaaatgatccttaaaaaaatggtttgaaatggatgcgatgggtaaaggccttgtcatcacaaccaactccttttgtcaggggtctctggaagattattggtttgtgcgaaaaaaaaaaaattaaatttgggttggtccattaaaaaaaaaaaaaaaaaccccccttttgggagttcaatatgttgctctagataaataatgtcaggcaagactcgatggaatttagtacatcatatgcatggtatctaaattttagctatagggagcaatcagtgtgtgtctcactggtgttctaggattgattatcttctagagtcagaaagcaaatgtactctactgaactacagaatatctgactggcaaaattttgacaacaggcaggagtgttgtctggtgatgtgagcgacattgttcttcttgatgtaacacc

SEQ ID NO: 81230 - DNA, 647 bp, Oryza sativa
tgctatgactattgagccgacagctaacttagccgaagcattgttcagcatttggtacaagtagccgaggaggattttgcctaaaggaaattgtttctttgcttccaaagcttcggctacaaactgccagttggttgtaggaccacagcttaatctacaaaagagaaatttctctagccacatgagcaaaaaggccacatgttctcgaggggtgacagaaccctgacccatgtatgctgttacatagcctgaccaacctcctatactcttggtcttaaagtcatattggttttttgtgttcagactcatggggttagccgatgaagtgacatccagacccgtgatcataatgatgtctatgagagttggggtcatcggttcttggttgaataagaaggcgttgatggtgttggaccagaaataggaggcggctgccattagaggttcatccttggctgagtttgctatggttaggttaagtgcttggccgattccaatttcgtcccaatgaactcttttgctagccgatatgcgcttgaacccatgtaatccaacttttctcgggtgaagttttttctagagatggccaagatttaaaggtattcttccaatgacctagatctggattggatagtctgaaaggaatc

SEQ ID NO: 81231 - DNA, 637 bp, Oryza sativa
ttaacgccgtttactttttaaacatgtttttaacgccgtttactttttaaacatgtttgattgtttgccttattcaaaaaccttttataaatcttatcctgcggccggccggctggatgaatgccgggcctagctcgtcgccggcgactgatgtttttcttcttctccggtggcaggttcgcttgggtcggactactccggcctggggatcagcatgttcaacgggtcgcagccggggacggcgccgccggcgccgttctcgttcaccgtcaagaagtccggcgccgccgcctcctcccttatgccggccggcggcggcgtgctgctccacctcctcctcgtgctggtctcctccttcatgataggatgaacagcagagcacagctagtagcaataatagagagacaggcagagatttcttttcccatattgaggagacgttttctttttcctatttacacccctttttcagtaggaattttgtttcattcatgtgatcatcagtgtatgttaataatttcatagaaataaaatacttagcagtagaagatcttgtgcacatcagtagataataatgctgcgctaactatcacaccaggcaccagccatactcttcaaaagatctgaccaccatcag

SEQ ID NO: 81232 - DNA, 621 bp, Oryza sativa
tctctaaaattataaccgtcgagttagtagtttatttaaaatattattttccatgtttgtttctagtgtttatttcttgtttaattcggttgcaatgtgcatctcaccttccgaacaattctttttgatccaaattcaattctatcccgagtagaaaaccatttaaagcctacaacaattcaaatactatttattttaattttccccatattttctttttctctaattttaccttaattctctttttccatctattttattttcttttctattctttcctttttctttcccctctctctctgttttcttttccttcttctcttctcctgctgcctcgcgccaaacccgtgccgccttgcgcccagctcgtgccagcccacgcatgatgccacacactcgcacgcgcacacacgaggacgaacgacagaagaatgccgccgtgacacctccagtttcccgcctccgtatctccttcgtccctccactaaaaggctcaagacctgtcacaccctaaaaatcctaaatatataaattgttgtttaaatggaattattagaaatgattttaaaagcctagacgagaagatctattttttttaaataataaatcccaatataaaat

SEQ ID NO: 81233 - DNA, 541 bp, Oryza sativa
actacgacactttatgcgtaatttctgtgtgctgatcgatgaaccaactgctgtctccgcgttactctacgcatgcatgcttttatataaacatgcatatggcgcgcaattgttttcgacgattactatatcgcatgattcttctgcatctcctgaaactagcatgggttctgaggcgcctgaccctgccgttgctgcatccgtgcctctcgtccgcctgaaccacgtatgctttcagtgcacgtcggtggaaaagtacgtcgacttataccgccgagtgcttggcttcgagctcatcaagcggccggagtccctgaacttcaatggagcttggtgagtaattaattaacctacattacccctgaagcgttcagcacaaaaggaccgatcaagatgtaatctgcaatgcatgcaacttcgtagttagaaatttgaaccagttgtcgagctgcatacacaatgcctgatcatttcagtgtgaaatgctgcttgttacaggctatacaagtacgggatgggaatacatctgctgcagcggggc

SEQ ID NO: 81234 - DNA, 3258 bp, Oryza sativa
cttctgggtgaggcatcacaaccagcacctcgatgccccgcctaggccactggcccacctcgaggccacccgctgactagcaccccaaccatctctctaagccaaagaacacctccgacttcctcactcccgatccaccccttgccccttcccacaacctaccttgaaactctataaccacttcggagctcattgaaactagaaaaggaaatcgtggagaagttctggaggttagaattttgagctattgttcatctagaatatgccaagtgatgtatagcaattctgtatgaacatgtgtaacacggacggtagccgagcccaaggtggtcgattcaaccctcctgtcgatctttcagaattaaaaaaagtatgcgattgattaaatttcaagtagaagagaggaaattcatatgggttatttaattacataacttcagagcttgtttggtaaggctccacctttagagttgaagcccaaccaaccaaacgacttcagctctacccaaaaagaaattagtggtgaagcctaaccaaacgcttttagctcaacccaaaaggagcaggtcaggctacaacaatttgataagatgaattacagaggtggagcctaaggcccctaaagcctaagggcatgtttggtagggctccaattcctaaatctaactctaggagtaaattttagaatggagatgtggtatggcctccaccctagcttctagttaacatttttagatcattctagcccattactctctttttaggttggaactgaaaccatttggtttaacttcagctccagatgtgaagctggaattataaaccctaccaagcatgccattagtttaactttttgaaaagaactagttgaagctagtggttttgctatttgtttcaaagaatcctatgttttaggacaaaatgtttcaataaatcccaattttatgtaaaatattcatatttcattattatatatgattgttttcatataaattcacattagttgactcaaaatatgtgccccccttctctactttgtcattgtccttactttcatgccacactattattgcaaaaactcaacataatccaaactaataatgacatgataacatgttacatatacatatatacacaaataataaaactatcggtaaccaatgcttgttaaaaagaagcaagcgtgtataaatactttaaaaaatatcaatacatttcttttacatttattatggataaaatatatcagccaaatgaatgacataagcttgtacatggagtcttacggaacattttacccaaaacatggggtctcatgaaacaaatcacaaaacctgatgttttagttatgtatgccccaaaacctagggttttgtgaaattcactcaaattttttcaaggcgtggttgttttttattcgttgccaaattctttaggtgtttgagcttatagtgttctcttgcaaaagtttgtagcaaaactattttttgcagcaaaccaaataaatgttaatccctaataatattttactcactccatctcaaaatataacaacctaattttaggatgaagcctattaagattcatagtacttggtgtataattgagtgctaagttgctatatatttaaacggagtgagtaactatcatatttcgagtttaggttgcaaaacataattaccatattgcccagcgaggtttcatgtgactcccttttgtttatttttttagataatagaatataatgtcccggcctttactcaaacagagctacagccaattattacatagaagcattcaagaacatagtgtagatctaattaaatagaacaaaccgtaacaaaaataaagaatcgaaactaacataaggagatcacaattattgaagactcccttttgtttataaaaggtaacttttatatatgaatttaaacataggttttgtctaatcatataatggataaaagttgtttttttcttttttaagggagagagtaggaaagaagactcgaactgtcgccgtctttagttccaaaataattcttcaaacttcgaactttttcatcacatcaaaacttttctacacacacaaacttccaactttttcatcacatcgtttcaattttaaccaaacttctaattttggtgtgaactaaacacagcctacatcaagcgacaaagaaagcgggctgggccacatgatgcagagccccataaatgattgaaaaggagcgtgcctttgtcttctggcccatttttgtctcttcgataggctattgagtgacaagcaatattatgtggattgtcttacagccactcaaaattttccagttccttttctcctctcaaaacaaaacaattttatgtttttagcatttctgatagtggagacggcattagctaggcaacctctgtggacgttgttttcatcccctttcgacccggcaataagatgcgatgatacagttgtgtcatcatgtgattggtagagggacaattttaaatgaaaagaacagaggccattcattctataccacaaaaacgcatactctgttttttttagagcaacaaaaggtcactgggcggctggaatgaggtcattcaatgcttgaactctatgaaatatgaataatatactgtagaggccttcgacatgtcctctaagttttacgaattctatctagatctaaatatatggtactatgatgtatcatatctattcagatttgtagtcacatcatatcctagatttattatttatggaacagaggggataaccgtaatcttgctcaatcaattgagacatactcattccattaaaaaaaccaacctagtattgaaggtgacattctctagcacacgaaagattcattgtactagaaaatgtcacctctaatgctagattcagtggcggacgcaggattaaaataaagatggggcgaagttgctcgtctcaataagaacaactgttgtaatcatataaacatatagtataatcaataaattaatgcaaataaaaaaaatatattaaaataaagtaacattttttgcgccatacataattcatcatacctaaaaagatactagtaaacatatcaatttgcaaatatgagtcaattcataaagcatggttgatagatatcttttaaaaaataaatatatgagaagatatcgcatacccagaataaaatgattattattttgcttagaagggagagagagaaaaacattaggcatctagtaggggacggggatgag

SEQ ID NO: 81235 - DNA, 835 bp, Oryza sativa
gacttctagaaagtaaaaaaaataaacccgttgataatcatattagatttttaaaatctcaatgacaataaaacggagaagcagcgggcggggtgtataagagtatagttgcagagccgccgacggttgacaggacttctagaaaataaaaaataaattccaactatagttatgtttgatttttttaatcacaatgataataaagagtagacagcggacgggctatagaggggcatagtggcattgttttatgggacttctaaaaattataaaaagtaaaattataagtccaatttttaaaggctcggaacttctaagaagtaaaaaaacaatgataatcatgttcaattttaaaatcgtaatgacaataaagaatggaggcagcgggtgagccgtaaaggagtacaatggcaaagccgctaacggtttggcgggacttctagaaagtaaaaatgaacccaaacgataatcatgttcgatttttaaaatctcaatgataataaagagaagagacagtggacgggccgtagagtagtataatggcaacgtttgacgggacatctggaaattataaaaacgaaacccaacatgacaataaactctaaaaactataaaatctaatttttaaaggttacaagaagaatgaataaaaatagtaatagatcgagcaaacaaataaagaaggagataacataaggggtagcaactggtgtaacttttaaaaattatataattagaaacacgaggatgctaagatttggtctttcaaattcttaaaacaatgagatagctatttaataaattttaagtaaaatcatactaaaagaatatatga

SEQ ID NO: 81236 - DNA, 17762 bp, Oryza sativa
atatatatatatatatatatatatatgaatgtggataatgttagaaactcttataatatgaaacggatgaagtaatattttagagaaaaaaaatgaaaactaaaactacacgtctaaccgagggagtaatatataagcaggcattttattcgcgatttcgcatcggtttcttcgtcaactgatccaattaattcatcgatcgtccctgaattcaaacagtacttacattatatagtttggcaagtaacacggaaattaacgtcagctctagcagctatatatatataacattctacctgttcagacaaacattcaatcgtgctcgattgacctcactaattcatccctgtaaccagctaccacttcaattttcccgcgcaaacgccttaataattagatcgagtacgataatctgacgttcttgtgctaaccaaattataaggggacgatcagcctaagtaggagtaggcgagtagctatcatccgagacaatggggttcgcgtacaggatcgcgagcgcgtcggagtacctggcgatcaccgggtacggcatcgccgacgtgaagctggcgaagaaggcgtgggtggcgccggggcagcggtgcacccgcttcgatatctccccggtgaactacaccttcgaggtgcaggccatgagcgccgagaagctccccttcatcctcccggccgtcttcaccatcggcccccgcgccgacgacgacgactgcctcctccgctacgccaagctcatctccccgcacgacaagctctcccaccacgtcaacgagctcgtcaagggcgtcatcgagggtgagacccgcgtgctggccgcctccatgaccatggaggagatcttccagggcaccaagtccttcaagcaggccgtcttcgagaacgtccagctggagctcaaccagttcggcctcatcatctacaacgccaacgtcaagcagctcgtcgacgtcgccggccacgagtacttctcctacctcggccagaagacgcagcaggaggcggtgaaccaggcgaaggtggacgtcgcggaggcgcggatgaagggggaggtcggcgccaaggagagggacgggatgacgcggcagaacgccgccaaggtggacgccgagacgaaggtgtacacggtgaagcggcagggcgagggggcgaaggaggaggcgagggtgaaggcggaggtgaaggtgttcgagaacgagagggaggcggaggtggccgaagcgaacgctgacctggcgatgaagaaggccgggtggcaacgacaggcgatggtggctgaagtggaggccgccaaggcggtcgccattcgtgaagccgagctgcaggtggaggtggaacggactaacgcctctaggcagactgagaagctcaaggccgagcatctcagcaaggctgtcgtcgactacgagatgaaggtccacccatctaaccatataccaccttcagtttttaatatattataccattgactttttataaacgtttgaacatttattttgttcaaatatttttacaggtatgaaaaaattaagttatgcttaaatagcatttgacaataaattaagttataataaaataaataataattacataattttttaatataacgaataatcaaatgtatctcaaaaagttaacgtcatatattaaaaaaaagaacagtgtgagtacaatcaaaactttaaaactacattgactatgaatgcatgttttagtttattaaaaaaactttcacaatacaatattgcttgatgacctataaatagtcaaatgtcgtataattttgaccggtgaaagagggaggtaaacttttttttttctcttgaggggatgttgaaataaaattttaaaaaattctctggatttttctcctcgagagaaatagaatatatgaatttttttattaatgtgcatatttttggttaatatgaaaaaaagaggggatatccttttgagggacaaataaactttctcgctgaaatagtacataaatctcgattactttgatgtgtacatttacactatgccatgtgattaaaaagggatttgctaaccgttattcaacaaaaaaaaattggagaacaaatcttactaattttggaccatcttatgggcatatcttaaagatttatacaccaaacttcttaagctccggcaactcgttgcaatggggcgatgaccccacctagttaggatttagagcagggaaagaggaaagaggggcaattccatggcttatagggagaacagggcaccgtcggcctagcggatgcatggtatgagcgattaggaggaggaggttggcgacgacaaggccaccaatggggctatgtattgcaagcagcggggggcatcaactggtgaactgttaggaggcggcagttgagagcagctagaccaccatcggcaacaggccagtggtggcatcacgtatttcttgacgatgttgacaacgaaaaaggcgatgggagggagggcgggtgggcagcgtgggaagtgaatcggtcgctggtagcggtggatgggttaggggaggtagcggtggatgggttagaggagctgcggtagccaggggcggatccagcatgggggcggcgaggtctcgaacccccactaaatttttttaccatatgtagataagagtgaggattgtaactctatctagtttgcttagatcctattgctatttctttctggattcgctactggcggtagcttatgtgtaaagaggtggatggatcccaagtcccaaccactgaaactaaattgggtggctcaaaaattcaagcgatagagcttcaaaatttgtcaaaggttatataggtagttgcctaaaaagaattgttgtacatacatgacaaatctgattggaaagtgtgttttgtgcagggttcaaattttcggaccgtaatttttgaagtttcgggtctatcggacccaatacaaaattaattattccacccaagttttttttatcgttttcatattatttttgtgaatttggaaaattttgttaaaaattcaaattatttcaaaccgaaactactgcaatttccaaaatttgggaaaattcggtcttatgggtaccccgatagaaataggcaaaataaaaatttgaacactggttttgcgcatggcttatgcgtgtatgtaggtgcaagaagcgaactgggagctgtacaaccggcagaaggcggcggaggctctgctgtacgagcaggagaagcaggcggaggcgcggcgcgcgtcggcggacgcggccttcttcgcgcggcagcgcgaggccgaggcggagctctacgccaagcagaaggaggccgagggcctggtggccatgggcgacgcccagagcgcctacctctccgccatgctcggcgcgctcggcggcagctacgccgcgctccgggactacctcatggtcagctccggcgtgtaccaggagatggcgcgcatcaacgccgacgccatcagggggctggagcccaagatcagcgtgtggagcaacggcgccggcgccggcggcgaggtcggcgaaggcggtggcgcgatgaaggaggtggccggggtgtacaagatgctgccgccgctgctgacgacggtgcacgagcagaccgggatgctgccgccggcgtggatgggcactctgactggcggcgccccctcgtcgaccagttgaccttgacgcgttttcgatatttcccgtactatgtgtctatgtgtatattgctgtgtaactgtatatatatactcccttcgtctcataaaaaccgtgacacattctagtaatagtactacgaatttgaacatacatctgtccagattcgttgtattatgatgtgtcatatccatttgttttttgtcagaaggagggagtatgcatgctgtgtgtgccatgtgtcctcttcagtatgccttggatatgtatgcttgtatttcatcagaagaacaaatgtatgtactgattgtgtgaagatttacatgagtatataactgcatatatattttgatatttccaaagacaataatcgaaagagaccgtcagcgagttgaagcccttgccaccaaggcccatcgctgctagatctggcattaattagtgggatgcaggacaagtattttctacatggcactcttggccttattgctcagaattaataataccgatgctgaatgcatgcagcaacagtatatatatacgataataattaacttcttcttatacattgatggagttgtcatcgtcgtggttgagtgtcggctggcgatgggcgacgacgacgtcgatctgctgctcgtcgtgcactagtacatcatgttgctcgggaggcggctggcgcgtgatcccggcgtgcgtgcacagtgcccagaggcaggtgatgaggtcggcgccccatgaggccaacgccttggcatggccctgcacgtcgttggacggcgcgaggtagatgacgaggtgcacccagaggcgcgccagctcgtcccacgcctcgtcggcgggcttctccctgagccagtggaacagctttacacctctccgcaccgtcgggtcttggaacgaattctcccactggtcgcctgatatggcggtcttggcgatcttcttcttcctgcaccggcggctcggcgggcacgcgcggcagccgcaccgcctggacgcatgatccaggcagctcctcgttttctcgtagcagctggacacccacgtctcttcgtcgggcagtagctcggggagttgcaccaccagatgcatgcactacttggacagcaccgacgcgatctggcattctttcttctgcttgtccatcgtcgtcgtcgtctcgagcagctccgtcgccaggtgccacgccaggatggcctcggtggtggtcatctggttggaatcgatgcctgatggaaggttgatggctccagtgctgcgattgataatgtgacatgaacacaaggcttggatgatctgcgcagtggcactcgccggcagggtaacctgggaagtccttgcaaaatgcttgtcgattggaccacaggcgtcaagaatggatacctggcagattgtcatcttgtttttggatgaagaaagtaaacaagagcgtatgtagatgaccacggaatagattttctgtagccaccgtctactgggccggtcgtaggagcacagcatgcggactatgttccaatcggagaacacaaacgaggtcaggaagtcatgagcctcgatgagaatgaccgtgagcacaagcaacatggtcaaggagaggatgagggacggggaattcacaggggttcttccccagcccatgattcggcaatataatggtgctgcatccttgttgacgattagtatgtcaactacggcatcgatgaaaaaatacaagaagataatggaggacaagaagttggtgcagaaaaggataggttgggacatcaccacaggggcagccgcttgctggtagtagttcttgaggagctcaagctccattagaagcacttggaaaggcctttggagttgatcatgggatgagttgctgcctgggctagagaagttgagtttgaggaggccgtcgagcatcatggcgcgagccatgtcggagccgacctccaccatcgggtagtgctcgaactggcgccggagcatcttgaaaagagagaaagataggcataagtcctcaaggaaatcccctatcttgccatggaagatgttcttgtgtttttcgcgcatctcccatattgttttcacagtgaccaagggccattccttgttggagtcgctgttggagtagtcatcgggttcggcgatacagagatgtaaatgcttctgctcgttttcgttgcagtaggtggcttggtgttggtggccaccgccggcgacgacgacgcgccttcccatcaccacgaatttgcagttggacatgtcgttggccggcacggcgctccggccatcgccgtcgcggttgtacttgtccatgactttcgtcatgtagcctgcaataacaagagggttcctcgccgtgtggaaggagtagctggcgaaccacctgttcacagcgcttagcacgagcttcacaaagcacaggaaccagagcacagcgaaggtgatgctcagggatttatcatctggcaatttggagcatatgaggtagccgatccacactaggtgactagtgtgtcgtaggcgtaatccatgagcgtgaaccgtccgatccccctattgaaggaggagccatcggttggcagcagcatcccctgcaccttcttgcggatgatctcggcgaggagcatccacaggagtatcaggaggagctcggttttgctccggttttcgctctgtgaaaaggctgaggagaggagaggaacgaactggaagaagacgaagttgagcacaaaacgcacgatccgggtaaggtcgtaccggtaaaggaacatgccaccgcaggtaggcagccgcctgaaggagaggcgtagaaagccggtgctgtagatgatggagcccatgagagccatgagcaccaccatgaacgtcagcttcatgttcatcaacaaggcttcatgttggtcggcctgagtaatatatactatgggtgttgccggtgttgttccgggaagaggataaaactccatcgcaccatgtcttgttgaaagctcgcaaaccgggagggaggccaatgccaaccctatgatgaaatggcaatgtgctcatgctggtctgtgcatgcatgatcatatgctatgtgtatgttctagctaatggctatcgcatttgcatgcaaacaaatactcgcatgcatacgcgtatatatagtccccggcaatataaatatatattcatcgacaagatactggcctcctcattccttgcttagtttaatgatgcactcaacgaacgtgctaggcatcgtatatgcagatccggcaatttatgctgcaggccgggatttcacctagctggcttctattccttttctctacaggctatatatgcatgatctgtatcgatgctttaatcgttgttacaacgaaaggaacgcgtcgtatgaggtctgttacgtagttcttattccatttagagatggttctctttgtaacagttgagacgataaaagactaataattaatgcatcaaaacatttttttattacttattattattattcttttcttggtattcatgtagcaaaatttcttttatatgcgctaactatctttttctcctactcacttctatttctatatcaacaaaaagagctcgctattaattacagttgtacatgctctaatccccatttcatttattaaggcttataagttcactctccccctacctttattttttcttaaatcgactttgcatgctctctatatgctattataaaagcgaagtcatcctcctctcttcatgtaaaatctcatgctaaaaagccatattacccaaaaaaaaccatctctcccaaaaccagtttcccaaacaaaaccaacgacctaccaaataaaataaaagactattaattagtttttttatttttctctatacactgttgcaacacattttgtattttttttctccatacagtactgttgcaacacacgggcatcgcactctataaaaaaaatatacaggagttccttgctcattgtacctgcaaaggacctttcaacatatacctttccatgttcgtgattacatttgcatctatacttggaaaataagtgcaggagttcgttactcagtatagcagcaaaggaggacatttgaattcaacctcggaggcagatgcttgtgcatgctcgtgcatattagaattaaatacttatctatcatcgtaagcaactaaaagaaagctagctctgctttactccatatacttgtatatatactactttgctggcccataaagtaatggtaaattaatgcggtataaacatctacctcaatctcaaaatacaaagagttttagacttggacacaaatatgaagaaagtagataaaattaaataggaaaagattagaattggttgagaagatgaagcacgcaaagaaattgaatgatacaaaattgtaattagttgagaagagaataaagatgaggaagttgttatattttataggaaaaagtacgaattacccccctcaactatcgcggtcgattgaattacacccctcaactgaaataccagacattatataccctcaactatttataccggacaaataacccccctcaacgctgttttgagtggttttgacttgagcttgcttacgtggcgccaacgtagcaatccagtcagcgaaaaaaataaaaaattccctgggtcccacctgtcattccctagtggttatctctcgcgcacaggccacgcactatagatggccataaggcccgaggcccgaaggcccggcccacggcacgaccttttggcccggcccaagcatagcacggcccgacttgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacgatggaccgtcgtgccttcaggccggcccggcacagcccgagtcatgttgggccatgtgtgcggcccgtgggccggcacggcacggcccggtgcgtcggtcgggccgtgccggcccgacaagccttggcccaggcacggccgggcctgggccgtgccgggcggcccacatggccatctataccacgcactcgggcggccggctgtggagcacgcggaggtggaggcggactgggcgaccggcggcggaggcgaagaacgcccgcgcggcggccagcggcggcgcacgcgcgtgcggcagaggaggcggagcacgcgcgtgcggctagctgcggagcctgcggaggaggaatcgcggaatccggccgagaaagagcatgcacactgcccgagatgtcatgcccctctcgctctgtttttactccactgccgtgtgtgtgtcacaggcaacacgcgtgcaaaagatcaaacacctacgaggcgagctcatctctatccatccatctcaacctcgcggaggcagcggcgccggcggcgatggggttgtgccagtggaggctggagaggcaggaggcggtgtcgaggtgcaaggcgaggcgggacatggcggcggagcatgtggtctacctccgggcgctgcgtgccatgggcgtcgccctgctgcagttcgccagtgtcgatgcagaccatccgaggcagattccgcgatctcgggtggctagctgcggagctccggataggcaaccgtcgccgcgtcctctgcgcgctcgccacgctgccctcgcctccacctccaggccgctgccggcacgcgccgccctcacctctgcctccatgccaccgtcggtagcgccgccgtgctgtgtcgcctcgtcttcccccgccgccgcatgcttcagaagaggagggagaagagcgccggtcgcgtcgcaccctttcgccggccgccgcgtgctttagaagggatggagaagagagaggtgggtggggattctgacgagtgggccctagcgattctttttagaaaaggatgactggactgccacgtgtgttatttgaaccctaaaccgcttgtaacagtgctaagggggggtgttttatctggtattgaaagtttagggtgagcaatgtctggttttcgagttcaaagtgtaatttggtcgatcacgatagtttaggaggtaattcatacttataataatttttaaatactaaaaatttattatatttcgagatggatagagtacttaatgggagaagaaaggaacagaatcagttttcattatagttgcctgcagggaggcgggtgctttaaaaaccaagagctcggtttaggccagatggacaagtcaacacagcggaactctaaggtgacgcagcgctggaacccaaggctattcctattgcaagtttcataagagtttagatgtcacataagctaaattgatgatacgtcaagaaatttatgaagagagaaggaatgagtttcatctagaaaggatgattttcatctagatgaaacttggtttacacactatctatgcagtgaaattagaatgaaaccccacttcaacttgatcattttatccttataccttggaaacgaaaataaaaccacattaatcaaatagtttcataatatcattcaataaataaaaattgtggatagcatatgaaatcacgaaatgaagctatgcatcaaagatcgacatttgtttcattcatcaatccgaagctcttttaattatgtagcactcttgaaaaccccaaaataaaactctccactaggaatagtctaagtggcgcaaaaggttaaacgtgaatatctccttgatcaagttctgtagtaaaggcagaacctaaatattgttacaactaagtattttaatttctttttccttccactttaaccctgtacatggctttgattatttctaactcatagatactccctccatcctaaaatataagttgtttatgtttcagagaaagtcaatgtttgactaacaaataaatatttcatctgtcttaaaatatattaatttaggatcagatagaatatatcctaatattattaatctagatagacccgtagaatatgtcctatccagttctaaagttactatatttaagaacatgataagtatgttatagttgtgcatgttatatcgttagatatatctgaaaatatatttatataataaaatttcatggttattaataatatattagaaataaatgattaaagatgatgtaaaaggctaatacgtctaggggtgggcattcaatctgatcaaagaatttagcctcggtcttcgatctttggttttttggacagctatagataaattgcacagtaaaatagtcaagaccgagcaatttggtcctggtcatgatcacaattttaggagataaaaaaacacacatattactaacaattttcagtcatccaaaatatcacacacaaatcacacaaatttcaataaactcagtgtcacaccctaccctgacaccacctaacagtgatgccagaggggatgcatcataggagatcggtgtgaatagactcccatagaaccgcgatgccggtaccaatcctaagacacgactgctggtacctgcggttaactcgagaggaatcattgcaattaataatataaataattatacctttaagaggtcacatcttcgaaacggctccgagagtgtaaccgacaaactagacccaatccacaagcaacggcttgggattagatagatggatagagaggtggatggatccaaaccatttggacttaattgggtggctcaaaaatttgaatgatagagctttgaaatctgtcaaaggttatataggtatagaaacaaaggtattgtacatgcatgagggtgtgtcgttcggccctatcgttcttcaccctaatgtctcagtctagtctcccgataaaaatctagtttaaggatgtctggaatatataaccacagtgatgttatatatgttgttgccttcttggaggcatcgcattggagattctgttttctggttgagaaagccaatgactacatacaacttgaaagtcgctagaaagaaacaactatgcagattctgaccaattattgtaacaccttgatctgacactaccgtacaacgacacttgatagggacatgttgcaggagaaggatgcaagccacttcctacaatacccgatattagtaccagtcttaggacatgttagaactcatgatgatagttatgaattattgcgatccttaacataaacattaaacttatttatgttaacttaacataagttgcagcacgagacgaccagagaatgcagctgacaacaaataaggaaccagcaacagcgaaaggagcgagctaactcccaactccctaaacaatagctaggaacctggacgaaacactaaatcttcttcacatcacttcaagcagggatgtggtttgtgaaagggcatgtagtctagtggttacaagagtctcagaagcaccttaggtcctgggttctcgactctctatgggagcgaattttacaggatctaacgacattgtgctttcagtggtaggcgacgtacccatcgacagcgagacacctgtggtgacttcgtcaatctcaaggatttgccggcccagttttcgaagatgctcatacgggtagggtttgcatgcgtgcgttcataggggtggttgcgttgtactgtgtaattcaaaaaaaagagacgcctgtggtaatttcgtcaatctcaaggatttgccagcccagtcttcgaagatactcataggggtggtgagtgtgcgtgcattgtgagtttctacgttccagtcttcgaagatgctcataagggtaggttttgtcggtccagtcttcgaagatgctcatagaggtagggtttgcgtgcgtacgttcatagaggtggtaagtgtgcgagcgttgtaagtttctgcattgtactgtgtaattttaaaaaaaaagcagggatgtggttaccaatacgttacctggatacggcttccaggccgcgtatccgtatcaggtacatgacggatacgggatacgtatcagatacgtattccgtacgtatctagcgatttgatgcagagccgccgtcctccgtctcccatcccgatgcatctcgcacgcgccctagcgagatgtcgccaccacacgctgggtacaggcatgcgtcgccgccgcgcccggcagcacaacaccttctctgcaaacaggcacagccgcacagcacctccgccgcgagtttagaggccgggtggcagccggccagggccgtcaccgcccaaggcaagcacagcaccggcagcatcgaagcaccgttgcagctttttatttgtttccctcactacttgagataaatccactcctctagtgtttcatgcttgatctgcaatgtctttattattttaggataagtagtcaaggactattgtttttgttagatccaacctccaaatgctactgtgcagtctgtactagtgcatctagcaattctaggggtagtgcggaatgttgatgcacatcaatcaaagagcaactgtgttgattgaactattaaatttgcgttttgtatgctatttgtagtcttgcactttattacacaccaattttttagggggcttaaatcgcttcgtcaactatagcagagttggagaagatggccatggaatgaactgcaactgcactaatcctagtattatattgccattttcttaaaagaatccttaattttttgtatttctaatatatatataaatatataaatgtattcccgtatccttgttttttggaaaataccgtatccatgtatcgacgtatcgaggtagcataggttaccatgggagatcgagccaaggagtaaaaaaaaaagtaaaagtaacagcgacggtgtaaatgtcctacaataactagagaaggggaaaaaaaggaaaaggagaatagatgggctaagttggctggtttgtttgggcttgacccattgcagcgaggagagagagttgagagtaggccctgtttctttgggccaagctaagctagcatgcacgcacgcaagatcaggccggtcagcaagctagcagcaactcaatgcagcagcagcggcatacagtgcaaaatattagtacaccttggagggagtggattctctcgagggaatatctccttattatttgcatgttatctaaataattataaaaaaaattcaactaaatagattaatatgtaatagatcactccacaaacatgaaagttaaaattcaacttctgcaagttgcaaaaaaagatattaaactatggctagtaaacgtatattcacattcaaatttatttttttcgttgtaacttatagaagttaaatttgaccttacatgtttatgtagtgatttaattatcatatattaatctatcttattggtttttttcaaatattttcataaccatttagaacacatgcaaataatgagggatgtcccttcaagagtttagaatagcttcccccaccatggaagattgaagaagagatgaagtggcttataaggatgagtgcctgaactttgtcaactttgacttaaataagtttatgtaaaacgaggatgaaaacactgagttaaaagtatagatggccatatggcccgtggcccgcggcccggcccaaagcacggctgtttggcccggcccaagcacggcacgacccgactggggtcgtgctcgtgccgtcccggcccgacagccgggccgtgcttgggccgcaccttcggcacgctgggccagcacggcacggcctggtcaaataaaaaaatatagggatgcaaaatagacttaaataatcgtataatgcaaggcccaagacaagaggtatacaaaatagacttattttccagccatttaaacacagtccacagagttgagggaccaaaaatagactttttctgtgaggagtatacagaatagacttattctccagccatttaaacacaacccacagagttgagggaccaaaaatagactttttctgtgaggaagcacgatgacccatcgtgccttctggccggcccggcatggcccgagtagtattgggccatgcctgggctgtgtatgccgccattaggctggcacggcatggcccggtgcgtcggtcgggccgtgccgacccgacaagcctcagcccaggtatggccgggcttgggccgtgccgtgccgggtggcctacatggccatctatagttaaaagtatatagttgtggttcaattcaactcatcaccgttttcggaactctaaaaacaggtgaacattctttttataaaatcacaattaaataatttaatggtgtaggatatcagttatggcgaaaatgtttgtcagggttatggataaggcataccctctatcctacgacttatgaaatataccgataagatataccttcacgtatacggatcgtttccgtacacgccattaggaactcgtctcaagttatggaaaatatctctgagttaagaaattgccgaagtcctactcggaaagggtaaaatctctgttatatcgtgtcggtttacatatccctaagtcttacatgagggtcaaggtattacacggtataaaagggacccctagggggaggcgaagggcatcgcatctcatcgaccacacacccaccaaagtttacgaaatcggagtgcacggagccaagtcaccgggagatctcgtcgaatccctcgactacgatctcgtcggtaccatctgtttcgactactctctttgtaatatgttcttatcgtcatcaatctcatataaactggactagggctattacctgacaaggggcctgaaccagtataatccttatcttttgtttgcttgatgtcgtactacgtagaccctcgttccaacataccccaataattaactcatccggtccgcgagtatcccacgtcgacagtggtgcgccaagtagggggacttggtgctcaaggatctaccagtatgacttcaggacttcccgacaacagtgtcatcgccagcgtcgatcaaggagtttctacctcgacaccgctagtgtggacttaggtcggatctattgtctttctggtctataccgttacaccaatctcggctggcccaatcatcattgggaacgagagaggtacggcaacgactgagagaaacgacgccccgccgacaattcctcccactcaggtggagaacggaacatcgacggccccaacatctgggaggaaccctcaggcggctgaaattcacccttcatgtgaaagatcaaagccgacaaggatgaccaccctaagaccgagatcttggtgtcctgtgcataagacaaccaagcatactctcgaggactgtccggtgatactccacgtacaagctgaactctacgcctgttgggaacgagggattcaacacacttcaccaacgggaaccacctactgtccgatccacagatctagatctcatgatttcacaaattgcagaatctttctctggaccctcaaaccagcgcatcatcgtgtccaacaaccatgagttcaaaccccgtgcgttgccaaggaaccagatgtggcaccgattccagataggtttgtgggatctgtcggtacaaacgagccatccgtgttgcacctccttgaaggcaacgaaccctcctcgcagtcacctagggatgtaaacgtggtcgacaacactaagacaagtgcgtccgcagcagcgagaatgcccgctcatcagttgcggaacttggacgcgatattgagagaaagtcctttcgatccagtaacaaacccagacgccagccaattggcagagcgactacgggaaactgtgacgaacctcaatgccgcgtttgccgaagcagcaggcggcccagagccgcacaggaacggagagcgacccaccaaggacgcggatggagaagacctcgccggaagacatgccaccggtgatcattcccctcgagaaagacatgatcctacaccaccacgccgtgaagatagcgatcttcgcgagcatctgaacagacgccagcagagtaggagggatcgtaacgaagacgaccatcgtcgccatcactctccttctcgtcgggaggacggtactccacatcgacaacatcatcatcgctctccctcgcggcgagaaagagacgacggccgaggaaataccccaaatgaagatcgagatcatcggccccataatgatcgatgcgataacgacaacaaccgaggtcaggagaataatcgccgaagacaggagagggacggcgacaaccgacgtgatcgaaactcccaatctccttatccgagtcgagatcgaggacgcgatcatcgctcgagaagccaagctcctgagccaagtgacccctcatcctcgtcttcgtcgtcctcttcggatcggcctccaagacgatgtcgcgaccacgggccacaccctatcccaggaaacggatgcagggcgttcacaccagcgctccgcaatgtgcgatggcccgagaagttcctaccgggatcgattgagaaatatgatggaggtacagacccagaagaatttctgcaagtctactccacagttctctatgccgctggtgcagacgacaacactctggctaattatttgctagccgcgttgaaaggttctgctcgttcatggttcgtccatctctcgccgaactcaatttcttcgtgggaagatttgtggtagcagttcatcgccaacttccaagggacatacaagcgccacgcgattgaagacgacctacacgctctaacttagaacccgagcgagtcattgcgggactatattcggcactttaacaagtgcaaaaatacgatccccgagatcaccgatgcttctgtcatccgagcattcagatcaggcgtccgagatcggtacaccacccaggagttggcgacgcgccgaatcacgtctgcccgaaagctattcgagatcatcgata

SEQ ID NO: 81237 - DNA, 41549 bp, Oryza sativa
gcaaatctcgagaagatcaaggcgatcgagaacatgaagtcgcccacaaggctcaaggaggtccagcggttgacaggatgcatggcttcgctaagccgattcatcgcaaggatgggagaacgaggacaacctttcttcgccctgctcaagaagcaggaccaattcgagtggaaccaagaagccgagaacgcatttatcgcgctcaagcgctacttgtcaaacccccttgtactcgttgctccacacatcaatgaagaattattcctgtatatcgctaccacgccttattctgtgagtacggttatcgtcgtagagagggaaaaagaacaacatcccgtgtactacgtaagcgaggccctccacgacgcaaaaattagatacccacagatccaaaaactgctctatgcggtggttatgacatcgagaaagctacgccactacttccaggctcacaaggtcaccgtcgtctcctccttccctttgggtgaagtcattaggaataaagatgtggtcggctgaattgccaaatgggtagttgagctaagccaattcgatatccactttgtgcctagaacaaccattaagtcacaggtcctcgccaattttgtagccatctggactatcccagaggatagcccagccgcccaaacggacaacgaaacctggatcatggcatttgacggagcactgaatagccaaggagcaggcaccggcttgacatcccccacaggagatcaattcaagcatgcaatccatctaaacttccgggcaacaaataacacggccgagtacgaaggactactcgcagggataaaagcagcagccgcgcttggcgtcaagcgactaatcgtgaagggagactctgaattggtcgcaaaccaagtacacaaagactacaaatgctccaaccccgagttagccaaatatctcgccgaggttagaaaactagaacgcaagttcaacgacatcgaagttcgacatgtctaccgaaaagacaatgtcgaaccagacgaccttgcacgacgcgcttccaggcgagaaccactcgagcccggaacgtttttggacgttctgacaaaaccatccatcaaggacacgcacgacgaaagcaccacagccaataccagcatctcgcagggagctgcagaggtcacaattcacaaacgtcgttgcgaacatagagacaacagacgactggcgcaccccgctaatcagattcttggagtcagacgagctgccggatgacgacacagaggtagagaaactatcccgtcaggccaagatatattgtatgatcagcaacgatttatacaagaaggccccaaacggaatcctcctcaagtgcgtatcatccgacgacggaaaaactcttctccttgacatccacgaaggcatttgcggatcacacgccggcgcacgtactctcgtcggaaaagctttcagacaaggctttttctggccaactactcttaaagacgcatgtgaactagtgcaacgatttgaagcttgtcaattctttagaaaacacaccaaattgccagcacaagcgctccagactatccctttgacatggccattctcatgctgggggctcgacatactcgggccattcccacgaggacaagggggctacaaattcctgttcgtgccgatcgacaatttcactaagtggattgaagcaaagccgacaagagaaattaaagccgaaaatgccataaaatttatcaaggggatattctgtagatatgggttgcctcaccgcatccttaccgacaacgggtcccaattcaccaacggtgatttccaagattactgcatcgaacttggagtcaagatctgcttcgcctcagtgtcccatcctcagagcaactgtaacatcctgaaaatttcgattctgaaatatggaattaaaaattcggaataatcaaaaatctttttaaacctttttacatgctaggatttattatgcatttgtgtgttttttatgttgtgtgccaaagatctcgattaaatcttatctccgaaagggacgccctcagtccaacgtcctttccttcccttaacttcacggtctgatttattaagtgcttcggtactaaacaaatcatagatctggatatataacccgaaaatcttcccttatatcgcaacacgacatatcttcctcaattcttaccctacggttatttcaaaccattctattaattcaacttgatatccccttcgaatgtctacgatcggtcgacatatttatttatcgtacgtcgattcgaatatcctcaaatttattcctactgcgacgattggatttctatgccacatgtcgtccctaaaatccttccttcactaccatcggtcgttcgtacgaacactctcaaaataaaataatcctatgaataaaataatcctacgacgaccgatgaattcgttcgtcaggcgttaagcctaaattcctatttggcaatgcaggttccataaataccaaacctcgtattgcagtccaaacattcaatccttgtgcataacggaatttctataccgaacacaaccatacactccatagtaccatacaagcacagtccgatatacagagccaaataaatgtccagattatacattccaaaatataaatacagtccaaattacaagttccattaatacatatgtcattccaattcaatccctgcaatatgcaaaagttcctattgcaaccaggccacctcccttccctgtcagcccagctcatctcacagaaagtctgttttgcctccctaacctcagagctacagccaccaagcaaccttctcagccaaagtctgttttccctccccagccgaaccagctgcctgcacagaagctgttcgatgaattgcctacaagccgcaacagggtttagcaccaactattgccggctcacaacaggattttgcaccaaaatatgcggccattcaataacatgggtcccttccacacagcaaaccatgcacccatgctcccggttcacaaaattcattcccaaaatacaaacaacacaatgaggaagatccacaacaccaagttcacaccgaaaatggcagagccaagtgcaaggggccatgcatacctggtactgtggcgatgtcgacattcagagctgctccccgcctaccctcacattgcctcccatacacaggcagccagcaaacctatatgaaccccaccaaagacagcagcagctcggctcctctccatttcttctccacctccacgctcgagctctgccactgcgctcctcagtcccgtgcacaagctgccatccctccatttgctccgccgcggccggctccggctgggcctcagttgagcaagaggacggataggccgccgcaccattgatcacccgagaacgactaactttaacatctaacccttagactcactaaccagctaaccctttactttctgtttcactgactcttccactttccgtttcgctaacttctaactccctaactcttaccttgcactaacccgctgacatttatcccctaacactgtgtgttcgcttgttaccgacgatcgaacacgtggtgtgcgaggacgaacagcaagcctaggatgatccgcgagccgatcgtcgacgcccgtcgaccacgcacggtgtgccgctactcggctgccgcagtgtgagcatctgctccttcccttccttgccctccttcccattgtcgtcccttagtgttgtcgatcgccttctctctgtttttccattcgcttgtcgctgtcccggcgcggtgccaccatcgtgcgctccgtcgccacctccttgcgtggccgacgcgtagccggtccgcgcaccgtcccccatccgacgcgcccggccgcgccgtcgccaggccgtcgcctgcgcctacacgcccggccgctgccccaccgacgtcttggcctcgcccaggacgccgccgagtggccgcgctgtcagccgcgccatacgcgcggcatcatcgtcgcgcccaccattcacgagtccggccgacgccgcctccgtagcgcgcgccgaccccgacatcctcccgccccgccgccgagcttcttcctcggtctcctctccattacccaccgctgccgccctctcaaccatccccaccgctgccggtctccatctccccaccgccggccttccctccctccctcaccaccggccaaccgtgccaggccgccgccgtcacccagccgccggcccctcctcccccactgcgctaggccgccgccacacgccgcctcttggccgccggccctccccacttccccgccgcccagccgccatgtcgccttccctccgggcgccgccggacaccgtcgcccacggccgcgccgccccgtcgcctagcgccctagccaggccgcctccccatcgccgccctcgctccctctctctcagtcgcgcgtgaggagaaaacgagaggagagatcgagaaggagagaagagaaacggataagagagagacaaaaagaaggaataaggggagatgacacttacatatgggacccatgcgggccccacctcatataatccctcatgcacagtaatgacactcctaatccctctcaaataatcccagtgacacgtggacccatcccggattaattcctgttaaaccatcttttagagatatgagtcacttacatgtggaccccatgttctagatctttcattcctccatataagtctacattagatccctctactccctcggccaaacccagagaacccatgtaccacagaagtctataaattatcccccagagcccaccatcggcctactcatacactaaagtccataagacatcccatgtgcaacccagagccctctctgaaagtctataacccgtccccaacccgaggagcaactccccttcggtttataaactcttccaacttcgaaaacccatatctttccaaccgtaactccgattgactccattcaacttccataatctctctaaaattgagatctatttaatggaaccattagttgcattgaatgttgctttattttacttcttttaggattgtgtgtggtttctttggccgtttatcgagcgtgattattctgggtattcttcggtcgtggatattctaattatctaactgttgcggatatcttgaagtcattagaaccaatagcaaggcaagtcactacgctcccatccttgaacatatcgatcctatgtttacaaatgtgttgttttacaaataaattgcatgctatttataaattgcgtacctatgcttgattatgcctacccttgatattgattacctttatacatgttgtatgcctttgattacctgagtcatttatttatatgcggtcaattattgatgatgcttagtaatgctatggtagacatacgtacactccatatttatgctagatgattatggatgtgagatcactcgatgtgagtgattgatgatttgtgggtggagacatgagcaccacccgccatacacaaaccttctgcgaaaaccaaaacttaatacaacaaaactatttcaactgggacgacacgaatagaatatgggtggttctgggaacggtaagccgctgaccccggtcagttaaggaccaagtcaagaagctaagcaggaaacgaaccgagtacgaccacacttcttgagtggggttagacccggtggactaggttattctcgtggggtggcaccccagacatggtaggttctggacattggtatggaaatgtggaagtatgtggtttaatgacgtcaaaactatatatatgtataatgtaatctctgatctcgggagcgccaggactcccctcacaaccggctcgaggtaggaatgtggcaccgggggtgcaatggggattcatagtccttggagcgggtgccgccatgcaagggtaactgaaaaaccgggccgtgacaagtctcatgtgttgggtgcgtcacggagtgtgggattaaaagcgtacatccactgcagtgtgagtaaattaaactattcgaaaagccgtgctcgtggttaatgagcgctaggacctgtactacccttgactagactcatagattttaatactacttagagtagatatgagagacatgagaaacttgcccaaagagtgggaaggttagtatagtagagttggtataggatgaaatgtgagggtaaaccgaaccaagcggggcttggagaggtggatgaaccctggataattacaacttcaacaataatgttgtttttcagttaaaactgctaggtcaataggtttgtgaaatgaattgtgaaaactagctttatgcaaataaaccaagccatacttgaacctctgtgtgcattagattcattttgtagtagtggcttgctgagtacgtatgtactcacccttgcttaattaaatcttttagaaaggagttggagtcgattatattcatgccatgctactatcaagtgcgtgtcgaagatgatggattagggaccataggttcaccagtcgttgcttgtggagttcgatggaccaccgctgcttcgcttccgctgttctatctagtactttggtattttgtattgtaagtgaccatgtttggtctatttcgggacccaatgaggttacccttgtattattattgtagaaacacctgtaaacgatgtcagttgtgatattatactatgctatgtgtgtaccatctactgatacaaggagtggtactatataacacatgggattaccggtgtatataaccgtacacgcgtacaaagtacacgcgtacagaagtatactgacgaggaacaggacgaaaggcgaagcgacaatgtgaatcttctcgaggaacatcgtgaacgagttgccattcgagcagccgcataccaacaggccctacgccgatatcatgagaaacgcattagagctcgcacactcaccatcggcgattacgtcctccgacgagttcaaaaccaggcaggacgcaacaaactcttgcctaagtgggaaggaccatacacggtggtacaagtactgcgaccaggcgcgttcaaaattgtagatggcgatggccgcgagttatccaactcctggaacattgatcagttacgtaaattctatgtataaaatcaatgtatcccaaatatgtgcaaatccattacccaaaggtattttgattttctcatgaaatatagcagtgccttacccagagatcccttaccacgataacacctactcttgaaatcgaacctactgaccctttacgccgtttcgacaagcctccgagaaacctacgggaattttggctggggacgcccagagcagataaggtcttgtcggatttgaagagccgaacgaccatgtaagacctggtcatgtaagagtgctcaaaaggtgtattagctaagccgtgtaatcggaaattggtttttccaacttcacagctagggcctaggcaaaatcgcaattttagataggcaagttacgagtcatcgagccttcccctccgagagcagacctcaccgaggacaaggctaggggctagggagagtaccttactcaataatgggcaaaaggcagcctataaaaagagtagtactcgttcacagcataacctgtttaagcattttcactagataggtttctgctttaattacaaaaccttaataaagataacagtatattacaaattcttgctagatgtttcttttacagggactaaagcctaccacgacggctattgccagttgatggaagcaaaaacctcctcggctagaggagcaagggatcgtgccagtcggtcgacctcgtccgccgataaccgcgaacggcgaaaacccccacgcaggaacccgagatccatctgcgagcggcgatcttgaatacaggtgaggacatgacctccagcgtaacggctggcgcgacgacattcctcttagaggctgatgtcgatctgctgtcctatgccctcaagctgagcacatgcccccctcatccaggacaagtagcccgccgtactctcctcgggctccgcgcgattaacctttagctgacgacaaacgtcggccatggcactgtagcagctcttaaggtacgagttcagccaaacctcgcagcctcggagagcctccacggcctggtccttcttcacgaccacgagcgaccgctcgagttcggcgacctcgaacttcgtcctccagtacgcgatacgcctatctcgttcagcgaggacgtcgtcgagatctacaaaggggagaggatgtaagggatgctgccttttaaacaaaacaacaagtttaaaagatgaacttctctatgacatcgcacccgagttctcgcgagggaatgcgaccacacccgggttagacgggccagaggtcatacccacctccccatcgttaacaatggcaggggcaggcgcatcgctcgaggaaggtaggtcgatcctcgcgacatcaggacatccgccttgctggacgtcctcagaatctacgcagctacgaaagacaaagaaacgcggcaaatcaacaaatggtgcgaagtaaaggaagtcgctctgcccataagacaacaaaagtgtttgtacaaaaatcacaatacaagacggagaaagtttactccttgtaaaggggaggatgctttccccgagatccgacacgctggacatcacgttctcccgcgtggcatcgacagcccccttcgacaagatctccttgaggtcgacgccagggagagctagcttcacgcacgcgaggacgtaacatgcccccgtgtggattccattggagatctcctccgcaacatgggcagcgtgccgcgatgggatggcctccatctcgcccgccagctccgacaacgccgatgtcagggacgtctcgtcgggatgtgtcgggatggaggactccatgccgcacgacaacgccagttgatgcaggctggtgaagctcctgcggagggagtcacggagggagaagaggatgtcatgtgtatcgttcatcttcttctctaggccctggcgttgcatctcgttgccggccacgatttccttcatcttctgaagatcttcatgggcaacctcgagttgcgcctccagttgaaccacccttccgtccgctgccgtcccgcgggccaccacatggtccatctgggctcccaccgcccgagaagtgctctcgagaaggcggtggcattcggccactatatcggaccaattggccactccgggcggcgacgcggccacaggagcggtggtaggccccacggactcaacgacaacaggggcgacctccacgcggggaatgatagcggctggagatccactcatcgccgtctcactcccgctttgcacggagaccgccaatgctttcctgtcaatggagtgggtcaagaggatataatcagcaaagatcaacaatgcgacaatggagtgggtcaagagtttcacttacttgccggcgggcagctttaacaccctcctcttcagaggaggagcgaggctgcccaagtcctgcgtaagatggcgaactatgacctcattctagcatatcaagaaaaaagggcgacaacggtgcgctttacctcggagccggcaaacttctgccgagaactagaaggagcgctcgacctcgcccagggctttcgcttggtcccgctgcctcctgcgacggcgggaacagaggaaatgttggcaacctcgtcggcgaccttgtccttgagcgaggcgaaggcctggtggtcaacaagaagaccgacaacatccgtcaatggcaaggcctacaggagttgaagttactttggctcttaaaaagaataaaaacacaaggtcccccggttctcgcttacattgatagcggccgccttctcggctgccaacttgtcgcagagcggggccggcggttcgtcggccgtggaggcagcgctgatcaagacctccttcacccgctgcatcacgagaaagacctgaaataaatatacaagaggatgagttaggcttcggcctcaaagtcatcatcaaaaacaggaggaagatcacaatataaagacgaataccccgcgaagagattcgagttatatcctccgctcccgtgtagtcgaatgcggggtgagcacgggcctgcagaggctagatccgacggctaacgaaatctttaacgacttcgtagccggttagcccttgttcccgaaggtcactcacggcatcgacaaaggcttggagggagggtgtaattgggggtttcgaggtccagtcctcggaacgctccggttggacctcgggcacgacaagaactgggtcgagttcttttatctcgaggtagaaccatctcgatctccattggctccgagatgagtggcattggagagggatgtacttcgccttcatgccatcacgaaggcggaatccgcaacatcccgaaacccgattgggctccatccaccggagttcatagaaaagcggaaaaggtctaagaaaggcactaccccgatgtaggcctcgcaaagatgaacgaatatgctcaagaaagcgatggaattggggttcaggtgcaagaaagaaaggccgtagaagttcaagaccaacaaaagaaattcggaaggaggaggcagaaaaccgcatcggatgaaatcttttacagctaccatacgacctaagacaggagaaggattggtacctcctgcctccctcgccatgatctgtttcggagggacggcctcctcggtgtgcagcttcttcaatgcagcagcgtcggaggaagactggtaaaggtctgccattggaagaagatcaccggaagaggatcgccggtgaagggtgttgaggattggggaaacgtagagtctgaggaagccggggaatagtaagggttttctggcaagcggacttgaaatggatctcaaaattccattaaataggagcactacctggcggttcgtatttcgaggaaaggggagagattgccgctgaaaattcctaaggcccgttggagaccgttgttcagacttcaatttaaattcaaaatccgcatcgatgggttccctgtaagtgttgtcgatagctccgtgtctctacggttaaacaaccgagattgacctagcgagtacgacaacgcactatcgggagaagtcgcatgcgataacatgaattcatttaagttgaagtcgggggccactgtcaaggttatggataaggcataccctctatcctacaacttatgaaatataccgataaggtataccttcacgtatacggatcgtttccatatacgccgttaggaactcgtctcaagttatggaaaatatctctatgagttaagaaattgccgaagttctactcggaaagggtaaaatctttggtatatcatgtcggtttacatatccctaagtcttacttgagggtcaaggtattacacggtataaaagggacccctagggggaggcgaagggcatcgcatctcatcgaccacacacccaccaaagtttacaaagccggaatgcatggagccaagtcgtcgggagatcttgtcgaatcccttgactacgatctcgttggtaccatctgtttcaaatactctctttgtaatatgttcttatcgtcatcaatctcatataaactggactagggctattacctgacaaggggcctgaagcagtataatccgtatcttttgtttgcttgatgtcgtactacgtagaccctcgttccaacgtacttcaatacttaactcatccggtccgcgagtatccatcgtcaacaatgctaggttgcaatgggagaagcatagaaagtcataattcattggtgtatgataggaattatgccaaaatgctcgatacctttatatcataatataactagcatggtggcccgcacagattgcgcggctagcatcgttatgttttttctcatataacagcttaaatatttttcatattttttttattaaaatatatttaaaatagcaacataattttgaattttgtactgtattgacagtgattaattattttctaatttcgaattttacttatttctaaattatattcctatatggactctagactcttctcctaatcatgcttatttttaaaattttgaattttagttatttataaattgtatttatatatggactctaaactctacttttattatttttcttaattttgactttcaatttgttctaaattcctatataaactctagactcatctttcaatattcctattttttaattctgaatttccgttgtttttaattatatttctatatggactctaaattcatcttttaatattctttatgttttaattcctaatttcaatttttctaaattataacctgtatggggtatagaatcttctttcaatattgcttttttttaattccaattttagttatttttaaattgtatttctatagggactctgacttctaggtttagttttcttattttttttaattccaaattttaattagttctaaattgtataccggtatggactttagtctccttttcctatattccttatttataattccgaatttcatttgttttaaaattgtattcctatatgaactctattttttttcttttttcccgattaatatgagaatttctagtaaggtagcccgcgcagattgcgtggcttagcatcttttttattttcttattttatttttaaaatatagtaaaatgggaacatgatttaaaattatggtctaacttgaccaaactaaccaatgtgtaatatttttattgtgttatatatacatgaaaattattaatcatttttttagttttatagttatttgtaaattatatttttatatgtactctatactcgtcgtgtaatattcgttattttttaaattccgaatttacattttatgtttttttacttctacatggtttcgaaagagaattgttaggaacagtttttaaattaaaaagagattcttttgatgatagaaatggttgtcagttgtcactggcttttgcagccgatgtgttttaggccattttacatctcgtcacctcgaacgcttgaacacctgtatgaattactaaatataggttaaaaaaataactaattgtacatattgcaactaatcatctcgtcacctcgaacgcttgaacacatgtatgaagtattaaatataggctaaaaaaataactaattgcacagattgcaactaatttgcgagacgaatcttttaagcctaattgctctatgattcgataatgtggtgctacagtaaacatttgttaatgacgtattaattagacttataaaaaaagtctgtgtcatttgctacagtaaaaagaaaaaaaaaacatcacagccacgcaccacacaataaaaatcatgggcatttcatggttgtgtcgactgtcgagagagtctcgagacacagagacagcggaaaaaaaaaaaagagaaggatgcgtagctactctgccataaccacttgctgctcctcacccaggtcgtcggtcgctgctctcctccctcagctcgcctctcgttgctcgtgcttgccccgctcgtctcttgctggtctttgttcgtgcttgcctcagctcgtgtccatggcggcccccagatcggaggatggtgggtggagagaaagaagaggaaggatggagaggaagaagaggaagattgagcacgtggccacgccgtcaaatcgaaaatatcctctctttctccatctagctcccagatccggccggcgtggtgggggaagggaaggaggccggcggcacggtggaagatggggaggaggcctcaccttcgtccggcatgccagtggcgaggagagcgcctctcgtcaccgtccgcctctcgtcgccgtccgcctctcgttgccgggagccggatccgccccgccccgcctcggcgccgtccgggccaggtgcgccgaggaccgcggtggccgtgagattgtatagtatgattaggggtttttttttttttttaccgattgtccgattccgtttccagtgtatagtatgattaggttttcctttttttttttaccgattgtctcatttcgagtttcttaatgctttttttctttcttcagtttttaactaatcctaatctagttctattttttttatttttttagattaatgtgagaatttctagaccgtgagagcgaatgtggatgctcatttttctagggagtaactatatttatggcgccatatttttcaccaaaatatagtcagcatgtatttacattgcaagtctctaaattacatatataattttagtgtatttgtaatgtaagttctaaaattacatgtgtaagtctataaatttcatatgtaattttagtatatttacaatgtaagtcctaaattacatatgtaagtctttaaattacatatgtaattttttcatgaaaacacatgctgacgtgatgagaaatttaaatttaattgtttggcttcacgctgcaacacacaaagacgttcaatgcactggtatttcaatcgtagcacgaatctcaagggagatcaattggacagaaattcgactgtgattagctggaaaatgtgtcgacataattatagcaacaccgtttttctattactttataatagattttgtttcgactctagccgatcaattgcacgggtcatcttgtgctagatagatggaacaaaagcctcatgtacatatgcaataagcccctcagcttattaaaaaaaaatgcatcatatcatgctttatttacattgaagcaactcagattttatacaaggaagtcaatacaaaagcacacgaaaataacacatgctcacactcacacgcggggccaaatcaatcaaacaagcactgtaccatgcatgcaatcccccattacacacttggccttattgcccagagttttagagagataccgatcgatgcagcagctgcagatatatatatatacgttgatcattactagacattgctgtcgtcgacggtgagctcggccgcctgctcggaaggctggcgcgtgatcccggcgtgcgtgcacagcgtccagaggcaggtgaggaggtcgccgctgccccaggaggccagcgccttggcgtggccctgcacgtcgttggacggcgcgaggtagacgacgaggtgcacccagaagcgcgccagctcgtcccacgccttgtcgaacgccgggccccgccgccggagccggtggaacagcctggcgccgcgccgcgccgccgggtcgtcgtcgaacagctcctcccaccggctcgatcggacggccacggctatcgccttcttcctcctccggctcgtcgggcagacgacccgcctggacgcgaggtgcagggcgctcgccgtgtcgccgtacctgtcggacacccacgtctcgtcgtcggggagcagctccgggatctgcgccaccaggaacatgcagtacctcgacaacaccgacgcgatcttgcggtcgtcttctttcttctccttcttcttcttctgctgctgctggtcgtcgtcgttttcgtcggcggcggggggagggtggtcgtcgtgttcgttgtcgagaagctccgtggcgaggtggcacgccaggatgatctcggtggtggtcatggtgcggaagtcgaggccatcgatgtcggggaggctgacgatcccggtggtgcggctgacgacggcgtcagaacgcaaggcgtcgatgatccgtccggtggcgatcgccggcagcgcgacgtcggccgccctcacagttgcgtagagtttttggagtggagaggcggcgtcgaagatggacatctggtagatgaccatctccgatttgcccacagaaaacgtgaggaaccttaccctgatgacaaggaagcagagccaccgtagccacgggcgatgggcagcacggtgataggtgcagaccatgcgaacaatgttccagctggagaacacatgcacggtccagaactcgtgggtttcaatggcgatgaccgtgagcacgagcagcacggttatgtagaagtagacgttggagatggggccgtttccggtggtcgtccagacgatgatttggcaatacaccggctcaccttgacttgagatgaaaagtatgtagacgacggtgccgagcagtagacacaggaggaagagggaggagacgaagttgacgacgaaaaggataggttgggacattaccactggggcagccgcctgctggtagtagtgcaccaagagatcaagctcaagctggagcacctggaaacccctctggatttgaccttgtactcggttcagcgtgaacttgctgcagagtttctgggctttgcccacaggctcacatccctcgagcttgaggacgccgtcgagcatgacgccgcgagccatggcggagccgacctccaccatcgggtagtgctcgaagcggcgccggaacatcttgaagagggagaaggagatgcacaggtcctcgaggagctgacgcctcctgcctttgaacaggttggcgtgctgctcgtgcatgttcatcacgtcttccacggtgatcagccgccccttctccacgcagtcgtgctccgtcaggcggagatactcgtcggggtcggtgaggaggagatgcacatgcttgtgctcgttctggtcgccgccgacgcgccttgccacgccgtagccgtatccatggatcgtgaccggctcgagcaccccattatccctcctcctcattctcctcttcctcttgttgttgttgttgtcgtcatcgttgttcaccttgttgtagtggaggacaagtcgatcctcgcccatgacaacgaatttgcaggtggacaaggtgatggcgggggggcttgtggccgtctgcttctccatgagtttctgcatgtaagctgcaacgacaagagggttcctcgccgtgtgcaaggagcagctcgcgagcctcctgttcaacaggctcagcaccagcttcgccaagcacagcgaccagagcacagtgaagatgtagatcaacgtcaaccctaacaaatagtatcggaattctaacgtctccgtcctcgtctgcctcgccaagtttgcgaagatgaggtagccgacccacaccaggtggctcacctcgtaggagacatccatgagcgtgagcctcccgatgcccctcgagaaggaggagccgtcggtcggcagcagcatcccctggaccttcttgcggatgagctccacgaggatcaaccacaggagcgccgccaggagctccgattcgttccggaggacgccgtcgttgttgccgccgctgttggcctggctctgggagatggtcgccgagacgagagggacaaactggaagaaggcgaagttgagcaggaagcgcgcgatgatggagaggctgtacttctggaacccgatctggcgcacccacgggaagaagacctgcacgaagccgttgatgtagagcgtgcagcccacgatcgccatgagcaccaccatgaacagcagcttcatattctccgtccccgtccccggtcgtgggacgttgccgccgccgctcacatcgtatagacgattactgcaccattttcagtggcgaaccagaaataaaaaatatttactgcaccgtttctagtgacgaacccagaataaaaattatcagggatacaataaatactaatcatctaattattaagtgatatactccatccgtttcaaaatgtttgtcaccgttgactttttagtatacgtttgatcattcgtcttattcaaaaaattttatgaaatatgtaaaattatatgactacataaaaatatatttaacaatgaatcaaataataggaaaagaattattaattacttaaattttttgaataagacgaacggtcaaacatgtttaaaaaaatcaacggtgtcaaacatttcgaaacggagggagtactgattaacatagttctatcctgtgaccccggctaggactgtataggatcgccactcaccatgcagagaggttgaatgccggctcaatcgaatgaatcgtcccaaaaggcaacgagaacgaccccatattaattatatgctggtgaacgagcactactgcaaactaatgtcaatagctaattaattgctatcgcatttcatctgcatgcaaacaaatgatcacatgcatacctatatgtagacggcccccggcgatacagtacattatattcatcaacaagatatatatacatcaattctttgcttagtttaacggtgcactcaacgtatgttcatgctgccaggcatcgcatgccagccttctctcttttctccactggccagccaggcgcgtgtgtgatcgatgctttataatccttcctcccaagcactgcaaaaattatgcatcttaattaagaggccacaagtagtactccatgattccatgtaggttttttttattaaggctcatttaatttcatttcatttagcaacaaaaaacaagaactatactcccaatttgattttattaagaactatttggtagagctcctacttctaaatttagctaaaatgagttgggtctaaaataaagttctagagcaacctaaacacagctccacctttctagttctttttgtgagagcgctacatccagctccgctttcattatagatgaaactgaaattgtttagttgagttcaagctaaagagatgaagctggagctgtgctaaacagatcccaaggctcaaaagtagtagcaagtattcataccttcaattagacacacatatatacatattcctcctacaggaaaatcaaattacaacacaagtgcacgtgtatatcttcaattactctaacactatgctttttttttcttagggcgtgtcttgatttcatgcacctcgaattttcaaaaaatatcagttacttttcccatccaaaaattacaaacgatggatctcattactctaatacagtattacttagaagtcctttctttcaatgataaaattgttgaacaataaattagtctaacctaaacaagaatacacctacaattcatacaaatgtaagaaattacatgcaaaaataaattcaaacttgcataaaagataaatgtaaaatcatagaaaactacaaaattgtagttaaataaactaacattacacacattgtgtgtatatatatactgcaaactttatacttaacaataccaattttagtgacattgacatgaaatcttgggaaaaaaagaccttatccttaattgacctgcatattagcgtatataaatgggaaaaaagtgcagcgtttactcaatgtgtagcagcaaaggaggatacatctaattcaacctcggaggcagatgcttgggcatgcttgtgcatattagaattaaatagttgtctatcatcgtaagcaacgaaaacaaagctggcggtgaacaaagaaaaagctagctctactgctttaattaatatgcggaagagttactttcgctacttaaaaacgacttttcctagaataaccccttttatttttcaggcgggtaaaataaaaaacgctcgtgaaactgtaaccgaagatctgcaagcggttatctttacataactgtttgtaaaaataagtctatttttatcagcgattgtttgagaaggtcacttataaaaatagatttttacaaacggtcatccataaaaaatactggaatgagatgaagaaacaaaattatatttttttcttatctttatctatccaatacccactctcccaccacccaccacatcattctctctttcacaccctatctcttctagatccagtggcggggcagcaaaccggcggccgccgcacaggcgcgagcgggcttcgacgagagctctgtcggtcggtgttcacgcaggcttcggcgagggctccagcgtgggcgggctccggcggtggattcgactgtcggcagtcgcccgggcttcagctgtgggcgggctccagcggtggatcctcttgtccatggcgccaacaaggggagctcatgcatggtggtggtagatggggcggtggcgagagcgacctctaccagatctggtggaggggaggcaggcgacgtctcctccctcatggcggcagagggtgtgatggtggcgtcctctctcccatcgtggccagaggtgcgcgtgtgttaaatatgtgatccgaattttggacccacaatatattcggattagtttcctagtaggagtcctattaggtgtctttctattatcccctatatatactcttgtaagccgtacgggaaggggtgacgttcccattgtgattcccctacgtttgtaatcatctcctctatagtgatcattgccggtcggcgcccgtggttttttcccgcaagggttttccacgtaaaaattcgtgtctccgttgtgcatctatttttataacaagtggtatcagatcattggagattcgatcaacaactatcccaccatcgttctgcaattcggcgagattatccaccggcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacagatcccaaagtgaagaaaaagtagggcaagtcagtcagagccatcatcgccctgttctgtgaattcaatttcacgttgagaattgctacggccacctaagcttgtgtaccaggagattccctgatctacgctacgtgcacacagaaagtgcacccagaggttcgcgattttgctaggtttaccctaatttcttactagcaaatttcaggattaattcctatggcgagtttgaagtatgatctaccgctcctggaccgagacacaagattctcactttggcaagtgaagatgcgagccgttcttgcacagcaagacctcgatgatgcgctttctggatttgacaagaggactcaggattggtccaacgatgagaagaaaaaggatcgtaaggctatgtcatatattcatcttcatctatctaacaatattttgcaggaggtgcttaaggaggagacagccgctgggctgtggttgaagctggaacagatatgcatgactaaggatctaaccagtaagatgcacctgaagcaaaagttatttttgcataagttgcaagatgatgggtctgtaatggaccatctctccactttcaaggaaattgttgctgaccttgagtctatagaggtaaagtatgatgaagaggatttaggccttattctattgtgttcattgcctagctcatatgcaaacttcagggatactatactttatagtcatgatactctaattttgaaagaagtttatgatgctttgcatgccaaagaaaagatgaagaagatggtaccctctgaaggttcaaattcacaagcagaaggcttggttgttcggggcaggcaacaggagaagaacacaaagaaccaatcaagagataaaagctcaagtagctaccgtgggagatcaaagtctagaggcaggtataagtcatgcaaatactgcaagagagatggacatgatatctctgagtgttggaagctacaggacaaagacaagagaactggaaagtatataccaaaaggtaagaaagaagaggaaggtaaagccgcagttgttactgatgagaagtctgatacagaattgcttgttgcttatgctggttgtgcacaaactagtgaccagtggattcttgatactgcatggacctatcacatgtgccctaatagggattggtttgccacctatgaagctttgcaaggtggtactgttttgatgggtgatgatacaccatgcgaggttgcaggtattggaacagttcagatcaagatgtttgatggctatatcagaacattgtcagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatctgccaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgagaattgctagatggacaaagcatcgggaagctcaaattttgtgagcattgcatctttggcaagcataagagggtgaagttcaacacatctacacataccactgaaggtattcttgattatgtgcattctgatttatgggggcctgcttgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaaaaaggtgaaaatccttcgtactgacaatgggatggagttctgttctaagatatttaaatcatattgcaagtctgaaggcattgtgcatcactacaccgttcctcacacacctcaacaaaacggcgtagctgagcgtatgaacatggcaattatatcaaaggcccgttgtatgttgtctaatgcagatttgcctaaacagttttgggcggaagccgtttccactacttgttatcttatcaatcgatcacctagttatgccactgataagaagactccaattgaggtatggtctggttccccagctaattattcagacttaagagtatttggttgtactgcttatgctcatgttgataatggtaaattagagcctagagctattaagtgcatttttcttggttatccgtctggtgtgaaaggctataagttatggtgtcctgaaactaaaaaggttgtgattagtagaaacgttgtcttccatgaatcagttattttacatgacaaaccttctactaatgttcctgttgagagtcaggagaaagcaagtgtgcaggtggagcacttgatcagttcagggcatgcaccagaaaaagaaaatgttgctattaaccaagatgcacctgttattgaagattcagattcttctattgttcagcagtcttcaaaacgttctattgcaaaagataagcccaaaagaaatattaaacctcctcgaagatatattgaagaagcgaacatagttgcttatgctttgagtgtggcagaagaaattgaaggtaatgcagaaccttctacatattctgaggctattgtttctgatgattgcaatagatggataactgctatgcatgatgagatggagtcacttaaaaagaatcatacttgggaatttgtgaagttgccaaaggagaagaaacctatccgttgcaagtggatcttcaaaagaaaggaaggtatgtctccaagtgatgaggcaagatacaaagcaaggttagttgctaaaggttatagccagattccaggtattgatttcaatgatgtcttttcccctattatgaagcatagttcaattcgcactttactcggtattgttgcaatgcatgattatgaactagagcaaatggatgttaagactgcatttttacatggggagttagaagaggacatttatatggagcaacctgaaggttttgttgttcttggaaaagagaacctagtctgtaggttgaagaaatctctttatgggttgaagcagtcacctagacagtggtataagagatttgactctttcatgctttctcagaagtttagaagatccaattatgatagttgtgtttatctcaaagttgttgatggttcagctatatatttgcttctttatgttgatgatatgttgattgctgcaaaagacaaatcagagatagcaaagttgaaggcacaattgagtagtgaatttgggatgaaggatttgggtgcagcgaagaaaattctcggtatggaaattactagagaaagacattctggcaagttatatcttagtcagaaaggttatattaaaaaagttcttcgtcgtttcaatatgcatgatgtaaaaccagtgagtactcctttagctgcacatttcagattatcttcagattatcttcagattatgtccacagtcagattatgatattgagtacatgtctagagttccatattcaagtgcagttggttcacttatgtatgccatggtatgttctcatcctgacttatcacatgcattgagtgttgtcagtagatacatggctaatcctggcaaagagcattggaaagctgttcaatggattttcagatacctacgtggtacatctagtgcttgtttgcagtttgggagatctagagatggatttgttggttatgtggattcagattttgctggagatttggataggcgaagatcgctcacaggttatgttttcactataggaggatgtgatgttagttggaaggcaagtttgcaagcaacggttgccttatctactactgaagcagagtatatggctatttctgaagcttgtaaagaagctatttggcttagaggtttgtacactgagctttgtggagttacgtcttgcattaatatattttgtgatagtcaaagtgcaatatgccttacaaaagatcagatgttccatgagagaacaaagcacattgatgtgagatatcacattattcgaggtgtgattgttgaaggtgatgtcaaggtatgcaagataagtactcatgataacccagctgatatgatgacaaagccagtttctgctactaagtttgagctttgctcaagcttggtgggtgttacagtatagtcctagagactatttggcgcgcgataattttacctacatgaggtatctttggtgattgatgtttttatgctacaagaggaaattcgtctcaaggtggaaattgttaaatatgtgatccgaattttgggcccacaatatattcggattagtttcctagtaggagtcctattaggtgtctttctattatcccctatatatactcttgtaagccgtactggaaggggtgacgttcccattgtgattcccctacgtttgtaatcatctcctttatagtgatcattgccggtcggcgcccgtgctttttttcccgtaagggttttccacgtaaaaattcgtgtctctgttgtgcatctattttcataacagcgtgcggcattgtgggcggaggattcggctgctggaggtgtgcgggtggcagattcggccgtcggaggtgcgcaggcggcatgaggcgtcgtgggcagaggatccggccaccggaggtgcgcgggtggctagaggcgtcgtgggccgtggatccggccatcggaggtgcacgggcagcaggcggcagcgaccaatgatggcgagaggagcttcgggcgggaggcagccattaagtgcggcgagttggggccacactcccgctagttcccaaagaaggagacagtgtaccagtcggagcaggccttcctcttgcggctccaccacaagcacctcgatgagtttgatgagtagctgctcgtctaagagtatacgaagaacggcgcgctctacggccacatccacaatggcagttcgacgacggtaactcagctccctcccacgccgacagcaaccagtgatgcctacgttgatttggacaatgatttaggattttgattggggatttggaacaatgatttgggatttggggacaatgatttgtaatttgtgaaactattttgggcctggattttcaaaattctttttgctccaaaaaagatttcgcttgagggtctcttaatattgccgccagcgaaaaccgattttcatgtctaaattcgatctacacatgaagaaaaaataataaattatatttgctctttacaagtattattcattgtctgattttattattttggtttcgttagttgtaaagacttatataatctcaattaatgttttcaataatctcaattaatgttttcattttttataataactatttaagtcgcatataaataatgggtgccatgacatctaaatgtaaaaaatcattgtgttttactcatggactccacatggggtaaaatggacatctcgtccccgcgttccacattagcacatcaatgtgttacgccacgtagttaaaagggtcaaagtggtaaaatacaaggacaaaaatctgaaatatagtgacatttgaagagtacaagtcatctcctatagtggcaatttgttaaatccccctgatgactgcaggaacggcggcagcatgtcgtacacgtcggccgccgccacctgctgcaccgcgcctgcgctgctagcaccggcgttggcgccgccggcgccgctcctgatgctgatcttgggctggatgccgctcatcgcgctggcgttgacgcgcgcgacctcctcgtacacgccgccgtcgatcatgaggctgtcccggagcgcgccgtggtcgccgccgagctcctggagcatggacgccacgagctccgccttggccctgcccaccccggccagcgcctccgcctcccgctgcctcgcgtacagcctcgcgtcctcggccagcttctgctcgaagaacttggcgccggcctgcgccttgcgcgcctccgccgacttcacctgctcgaacagcgtcgcgtccgctgccatctgcctgtcgtacagcgccgcgtttgaatcttgcacctacgtacgccagcagatagaataagtaaaacttctcttaattagatgatttgacatgagcaaactcgatccaagtttgaatcatgtttgtgtggctgtgtgtatgtaaccatataaatagggagatggacttttatcccttggagaacatcccttgttttattcatgttgtttaaaaagtcactaaaagtaaaaaaatattgataaaataaattaatatatgatttgtcattttacaaacatataagttcaaattcaacctatacaattaaaaaaaataaataaattcgactatgcgaattacaccgttctatttttgttatttttgtttttacttgtataaattaaatttgaacctacatatttgtaaagtgatatattaatttttttactatttctttaggaaaattatggtttttttagtgatatgaaaaaacaagagaacatcttcttgagaaataaataaagtttccctataaatacctgtgtctcgtactggacggtggccttgctgagcttctcggccttgagcttctcggtgaggcgcagcgcgttcttgcgctccacctccagctgcagctcggcctcgcgaacgacgacggccttgaccgcctcgacctcggcaaccttggactgcttgtccagcccggccttcttcaccgctagcgccgcccgcgccgccgcgatgtccgcctccctctcgttctcgtacacctccacatcggccttcaccttgatctcctccctgcagcccacaccctgctgccgcgcggacagcaccttcgtctcggcatccaccttcgccgcgttctgaagcgtgagcccctccctctccttggcgccgatctcccccttcatccgcgcctccgcctcggccaccttcgccttgccctccacctccgcctgcctcttctgccccaggaaggagaagtagtcgttgccgggtgaatccgggtcatcgacgagctgcttgacgttggcgctgtagatgtagaggccaagctcgttgagggcaagctgcacctggtcgaacacttgttgcttgaacttctttgtgccctggaagatctcctccatggtcatggacgaggcgagcacgcgggtctcgccctcgatgacacccttcacgagatcgatgacgtggtttggtgatctgatctgggaagcagcaatgagttttgcgtacagtagtagctgcttgttccaggagcacaagtagacaaagaagaagaagaagaagggattagactgccaacttgagcagaaaattgttcaaacgaaagctggttgcatatttgaaacatcttcagcttttatagtagtgtagatatatgctaaagctgcagtcgtatatcgtcataggttttattaggttagccaatttaggtgactgacaagattagaacaaaatatatcgactaacaaagagcaaaactaggacatataatttttcatgcttgatccatgcatcgcttttttttcaatgttatacaaatgtgaaaaaagaggaaatggttcaattcgaaccactcggcaaaattgttaagctagctgaccaagaataaagcccaatgcaactagcctaaaaaactgatttaggtagcaatttatatatcttcctagtaaaggtattcccggcacctaatattgcgtcatgttgcttgtgcaaatttaattgactgacggataagagagaaaatgacaactagctaatagcaaaactaagatactttaatacttcttgcctcaataatagtttttttttcaatttttttagttggtgagcttaaaaaagaaggtattcaattataatgaacatcagagtgattttacagttattaaagaaatactgagaggtacaatattttctagtataaaatttgttctctctcaatgtctgtacaatttctcttaacatcaagaactcggcgagacatggtgagcgtaggtaaaagaaaaaaaatcatatatctacatgagctacatataatgtatgttagtagagtatttggaagtatcaattgtatcaaagggaacataccatgtccgcacatcatgcaaactactaacaaacaaataccatcgaaaactctaaaaaagtgtacatacatttttaataggattatcacctacatgtgatcagcatcatctttaaatccataatatatagatagtaataaaaaaaagacaaggttctgacatatttatagtctcaggctttttatttttattgttttggctaaaatagaatatatattttaaagttgatactttacacatgcatatataaacctatcaaaaatacatgtgtatttttctctagtttttctataatatttgttaattagtgtgcactgagtatattatttgaagcacgtgtagagttaatttaaagaaatagtagggggagtaaaaatatctgtgaatcatgcacgcataccgcttcctcgtcgcaatcctccagtctccgttgtgtgtcggccggcggcgccggtccgtccaccacagggttccgtttgatcttggggctggggccgatggtgtaggcggcggggagcctgaagggcagcttctcggagctcatggcctgcacgtcgatgtcgtagctcaccggcgtggcgtcgaacttgaggcacttctgccccgcgaacacccacgccttcttcgccagcttcacgtcgtcgatcccccagcccgtgatggccaggtactccgacgcgccggccaccacgaaacgcgccatctcgatttctcgatcgatcgtgtctcgcggcgattgagtgagttcgttgttggatcggcgcggcgccggcgaggaaaccccaagttttttttttttttttgtagcggcgcacgcacggacgcgcggcggcgatcgaggagagaattgaagggaggaggatatgatatctgatgcgatctactgatccgtacgtgacaagggcaatgaggaagggaagacgttgtacggtggagatgagatcgaaatcgaatgagatgtgtcggactcgacaacgcaaatcgaaccgatcgcgtcgtatcggctcaggcctcagggtcgcacgtggcctgcctccgaatcgtatgggctcgcccaagctgcacgatggcccaaacggtctcggtctcgctcaccgtctcaccgatcgcatatgcgcatgtggggcggcctccaaaccgtgtgggctcctacctgagccgtctcccacttgggccgtccaaacgaggccgcgtctgagcaaaacctacagacctacagtatgtcagtggggggtacggctaggggtggagaggaagctcgtggctcgtgataagctcggcttggctcggctcgtttaaatttcctaacgagcagagctggctttaaagctcgttagagataacgagccagctcgagctagctctactcgcgagccttaacgagcttttcattagccaacagctcaacaacagcaagccacaaagcccactaagccaagaccacaaagcccgtaggcgcataggcccatcagataaggacataaggtaaagactagtaaaccctagctgactgttcgctccacttccctcttccctgttcgctccgccgccaccatcgcgactcgcgtcccctctcctcttctctccactccgcgcggcgccgccagcccgccacagcgccaccatcccgtgcactgccgcctctccagatcttcctctcctcttcactccgccgcttcaccgtcaccaatccaccgtcgctccgccgccgccaatccacctccgcgccaggctccagcactctagcagtgagtgtcgtgcgcccgcgccgccgctcatcacccacgattccacgacgccgcccccacaccgtgccagtcatcatccacgtccgtggttcgccgctggttgtgtggccacgccgccggctgccatggaggagctgcctcaaccagatctcggagcaaatgcttgatttgttgttgttgatctcgtgtttagtactttagttcttcaattatcggttcagcttcagcacctctctgcacttacctgtgtatccattgcaaaaattgttgggccggtgttttaggtcattagctcgcgagccaaacgagccagctcgagctttgcaacgagtcgagccgagctggttttttaggtcgttaggataacgagctagaccgagccgagctggctcgctacccacccctaggtacggcacagaatactgatcggtatagaggctgcctgattctttcgactactctggagtacaatcttaatcctttcatcccagtttgatcattccctaaagtttgatcattccctaaacgaatggcaccaagaccaaggacactattatctgcaaccggttggatgaagatgggagtcatttcttcttcagatgcaaggaagtaaaatacatttggagagacctgaaccttgaagagactagggacaagttagctggtatgcaatcagcttgggcagtcttaaactccattttggagttggaggaagaaaagagattgctagccattgtcctaatgtatggttggtggaatgagagaaatcggaggagagagggggaaggaagaagagtagctagtgtgctggccttttcggtgcagaagcaagtcgatgaactcctaaatttggccctgcaacagcgaagggagcataaaaatagaacagttaagaagtggacacaacctgcagctgaggtgctgaagatcaatgtggatggagctttcaagcatcaactgctcctaggcggttggggttatgtaatccgggacgtgggagcacatgtgatacaggcgggagcaggaagttcatcgaggatgcaagatgcttttcacgccgaagttatggcaggagtaaagggtttacaggcagcggcgaacctgggaatggccaatatccagctggaatccgactccttgacgcttatccaggctctgagggaagaaaactttcgctatgctcctttgggcggcctgctgcttgaagcgaagaacattatcacttcgtcctttgtatcttgtcagttcagttactgtcctcgcgagtgtaataaggtagctgatgcaatcgcatccattggttgtaatagtcctctaaacactgatctcgtctgggatggtgtacctccgggtgttgaggatctggtggtcggcgattatgccgcttccttgggttaatggaaactaaagttttcctctaaaaaaaaagaccaaggatactaaaatatttatcactctcaaattaatccttatcggttagggtgtttcatcatttcatatcccgtagattgctgatgttttaaatattgcatgccattgcaccaataaaaattaatcttggttggttacatgcaacatattcaatgatgcacatttactctttgcacaaataaataaagagacacttgttagatgatgatcattttagaaaaacctcaaaaagcttaaaggatgatcaaaatgggatagatggagtcctggttttaggttcctttcactaaaccagtaaacctcctttgatcgatagaaaaaacatacaaattaattttgaagtatttcaatcaaagaattacatcatatcatatatatatcctttgaaatttttaggaaatggacaaccctatagggattttgaagaagagttagcaagaggtgcggcctgttagaaaatttcagttcaatctatatctctaatccgaaatttttaggaaatggacaaccctatagggattttgaagaagagttagcaagaggtgcggcctcttagaaaatttcagttcaatctatatctctaatccgattcctttgtttttcctgcactctattccaatgatcatttcggtgtttttcctaaaatttacattcctttgtattgcacttaaattcctatcaaaattctacgtttttttatttatatattccttcatttttttcaatcctacgtttcaaatgagccttaagttttgagttatactctatcataacataggagtttattatcactttaattttcttgcatgagaaggcctgtctattgttcccagatcgcaaagaggaaaaaaaacatctacttgattatataattttcacattaatttgctactgcctctattttttatgtctaaatttgactattgtaatgttttttttcttatttgtataaatagaaaaacatacaagccacacaaagtctttttaatggtagatttagtggtacttttttcgctttacgtaataactaagtaattgaataaatagtgtcggccaaatttgagggaaaataactgtattatatattataaaaaagaggtagtataatttacacattatttaaagagattttttatgaattaccattgacgattgtttggttctaaaaattgctattgttgaatacgagttttgactttggacgttaatgtttccttttgcttttacagtcgtccattagttttctactccctccatatatcaatataattgtaacctagtacatatgtgatatatcttataactttctgtctagattcgtagttctaagatatgttaaatttgtagattcgtagtcctaagatatgtcaaatttgtactaggttgcacttatattagtacggagggagtattaaactagatgtttatatgatactaatagaagtaacatataatagaaatagcttgtaagatagctacactttgtattttttttatctcgaaccaactattaaaaaagctataaattaattaagatgatgtggtttataacaatgtaaagtatatggatcgattgatcgtcaaaaaacaaaattaaagtgatatggctcagatcaatgagagaaggaaaagaaagaaggtatcgatggttgcacctatattgctacggagggagtattaaactagatgtatgtttatatgatattaatagaagtagcatataatcgaaataacatgaagatagctagctacactttgtattttttttatctctaatcgactattaaaaagttataaataattaaaatgatgtggtttataacaatttaaagtactagaaaaatgcccgtgcgttgcaacgggtgaaggctattttaatcttattattgttcactgtgagaattcgcttggatatatatttttcaagaaaatcatgttaggttagtatgcaagtttttcttttcaagagattaaatcatgttaagttagcatacgagtttttttcaagagatttcttatacgactccttatgtattttcaaaagcgaacgaaattaaaacccggctcaaatatagatctggatttctaaaagcgaacgaactgtatttttcaatacggttaaaaaccaactcatacacggatgacgtaccagagtaccggtaaaattatcttcaatttttataatagtagaaaagttttagtgattttggtgtcagcaatctctactacttcaaaaatttcaaaacgtttccttcgtccgtcaaaataaaaaaaaaagagcgaaaaaacaacaaaaaaaaagtccgactcccctaaaaagatggaaaaaaccgcagatccgattccccctaaaaaaggaaaaaatagcgaaaaacaactaaaaaaatccggttccactaagtggcaaaaaaaaaccgtagatccgaacgtgaaaaaatctgattcctataaaggtgaaaaaaagtaaaaaaaaagatccaattcccataaaaatagaaaaaagtctgattcgtataaaaggcgaaaattaaaaaaatctaaaaaaacatgtaaaaaagttcgtccgatttcctaagaaagtggcgaaaaatggcaagtataaactaaaaaaacacgcgtgaaaaaaaaagagcagaaaaaaaagcgtggaaaagaagtccgatttctattcgttttagtagacagtatatatctcttctccaactctaatctaatataactacttaaaaagagaagttttcattctacaactaaaaaaacatgagaaaataaaaacgattaaaaaatgcgtgagaaaaaagtcagaaaaaacgttaaaataatgttttgtcttttgtaaaaaaataaaaaatgcatgagaaaaaagtatttccatcgtccgtaaaaaaattaaataaaaacatgaaaagatgttccaattttcttattgtcttagctacaaacgatccatacaaacattgttattgacatggttacgagtgaaaaacgtatattatgattaaatatttttttcacccgttataacacacgagttttttcgctagtaaaaaataataattaaagaaaacaacactaagtatatacgtgtatctcaacccactgtaatttttcagcggaattcaattcaatgtcgtagatttcattttagtactccatccgtctcaaaataagtgcagttttgcactattcatacttaacatttgaacgttcgtcttatttgaaaattttttatgattagtatttttattgctattagatgttaaaacataaatagtactttatgtgtgactaaatattttcaattttttcacaaaattttcaaataagacggacagtcaaacgttgggtacgaatatctacggctgcacttattttgggacggaggtagtataagaaaaacagaagctggtacagtactttactgagaaaatatcgtgactgtttctagtcaaagaaccttatctctatccaccctctctcgtttactctctctctttccccgtctctctcctgtcgccagccacacatcctctcctctcctctctagttctctacgcctcctctctccctctacccacgacccgccgtcccgcggcaatgatgcctagagagtagagagcaggagcagtggtgcacaacgagctggggagcagcccggcaagctactcctcggtgtcggcggctctccttccgcgcagcgacgcctctccgtccctcgcctcctctccctcgccatggggccgcgggagggctcgatgctgatgggtggtggcaggtggcggcgccctcccttccggtgggaggggaggcggcggcggtccgacgtcccagatccgtcctcttcctgcactcacccttcctggcaagggcacggtgactcgaggcggcggcgacggcgactcggtcttccggactcctcccgccgccggctacggcatcaaccggcgacgacctccatggtaacgagctgacggcgacagcgggctgcaggtgcgacaaatgcccttcttctcctctctttctcctctactttcctctggtggcttggccgatccattggtgttggaggtcggagatgggccgatctgggaggtgcgatggtgacgccgccccctcctgttcttcctcccacaccagaagcagaagcagtgacgatggcgatgataatgaattactcgtgtgatttgttcatgtttattcatgcttttttttatcttgaggatttgtatgtgttgttcatctgttgaaataaggatatggggattattgtttgttgttcgtatattcatcttcaatttggggatgggcattgaagtactcaatgaagaaaattggatcgatttgagccggtcgtgggctttttttgtgcgattttttttgtgcggtttttttattcttcttgtttcattttctttttctctagattctatcttcgattggattttgtatcgatatttgaatttgtgcaacatccgccttatgtggtaagggcgctgtggtgcgacacgagggggaacggggagggagtcggactggaaaataacacagaaaaatcgcaaaaaaaaaaagatcgcggggagggaatcggacaacgtacgaaaaattcttggcataaacatcttaaacttttataataggtaaagatatgcatcgattgattgttcgaaaaacaaaacttaagtaatatggttcaattagagaaggaaaagaaataaggtaatatggattatctacttatggaacatttccctcaacttctctttataaaagttttgaaaaaaaataccgtttaggtgtaaaaaacgaagaagtagaagttgagaagagatagtagtatagaacacctcttaaataaataatataatccaaaactattacactccaatgccaacacgacgtactctgacacaaaactgaaaattattatactctataactctagcacgatgtacttttgacacaaaactcagaattattacaatgtaatgctataatacgacgtacttaatgacacaaaagtgttggtgtggctatcttaattagttcattagttggcgccgtcttttggcagggagcccatccacgccggcggctgcatgccggtctgctcgtgaaccgtcgacagcagcggcggcagcatcttgtacacgccggccacctgctgcatcgcgccggcgccggcctcgccggcggcgccgtccgcgccgctccagatgctgatcttgggctgcatgccgctcaccgcgctggcgttgacgcgcgccatctcctggtacatgccgccgtcgatcatgaggtagtcccggagcgcgccgtagtcgccgccgagcgcctggagcatggacgtgacgtactccaccttggccttgcccaccatggccagcgcctccgcctccttctgcttcgcgtacagcctcgcgtcctccgccagcttctgctcgaagaacatggcgtccgcctgcgccttgcgcgcctccgccgacttcacctgctcgtacagcgtcgcgtccgccgccttctgcctgttgtacagcgccgcgttcgactcttgcacctacacccccaagttaaatttggatgaaactcgttaaaattaaggccctgtttagatccacccaaaaattttacaccctactatcacatcgaacgtgtatgaagtattaaatataggtaaaaaataactaacagattgcgattaatttgtgaaacgaatcttttgatcctaattacttcatgatttgataatatagtgctacagtaaacatttgctaatgacagattaatttggtttaataaattcatctcgcggtttactgacgaattctgtaattagtatttttattagtgcccgaacatcctatacaacaccctatataatgtctgatgtgacacgccaaaacgaacttagattaaaaagtgtatgaatatatacctgtgtctcgtactggacggtggccttgctgagctgctcggccttgagcttctcggtgaggcgcagcgcgttcttgcgctccacctccatctggagctcggcctcgcgaatggcgacggccttgacggcctccacctgggcaaccttggactgcttctcccacccggccttcttcatcgcaaggccggcctgcgccgccgcgatctccgcctccctctcattctcatacacctgcacctccgccttcaccttggcctcctccctgaggccgatgccctgctgccggacagacaccaccttcgtctcggcgtccaccttcgccgcgttctgccgcgtgagcccctccctctccttggcgccaacctcccccttcatccgctcctccgccacgtccaccttcgccttgttcgccgcctcctgctgcgtcttcttccccaggtaggagaagtactcgtggccgggctcgtcgacgagctgcttcacgttggcattgtagatgtagaggccaaacttgttgagatcgagctgcacctggtcgaacacctcttgcttgaacttcttggtgccctggaagatctcctccatggtcatggaggcggccagcacgcgggtctcaccctcgatgacgcccttgacaagctgtttgacatggttcgacgcatggtcgtgcggggcgatgagcttggcgtacagtaggagctgttcatcattcattcaagcaaaacaaaaaacaatcagattatttatttttagtacaaatttcacatcaagattgatcagcaataacaaaagggcatcaaaataatcatgtttcataacatataccttttcctcgctctcaggcatgagaacgcgccgttgattcgaggcgccatcgacctcaggcgccggcgccggcgtgatcttggggccgatggtgaagacggcggggagattgaaggccagcttctcggagctcatggcctccacgttgaactcgtagttcaccggcgagatgtcgaacctgctgcacttctggccggcgaacacccacgccttcttcgccagcttcacgtcgtcgattccccagccggtgatggccaggtactccgacgggccggccaccacgaaacgcgccatctcgacgacgatctgatcttcttccctccctcgctagtcgctactgctgatctcgatcggcgattgagttcgaccagcaaaacccagaaaccctgatgagatctacgtctatctgatgacgagacgaaggctatggtaggtagtctggtagccgcgatcctccgttatataggtgagacggtagtatgatgggtatcaatctgtttgatttgtttcttaaccaactctgcatatgaattttgtgggtatctatttcggttaattggcttgttaattaagtttgggccgaattggagttgggttaactaattgtaatctgattaattaatccactgctatcgtacagaggcccaacagcatatagttaaatggaataagttcacttggtgacccttaaaagtgatcgaaatctaatccgtgaccctaaaccagaaaaccggatatattgaccccaaactattgaaaccagtgcaatttgactccctcgacggttttggaaggcggtttcactaacgtggcggtattgacctagtctatgtgccgacgtggcgcttaggtggcatttcaattaaaaagttatacgtgggacccgtttgtcattcacacacacaattgtggggcccactaacatgtgggccccacatgacatcttctcccattcttcttcctcccctcccttctctctttctttctccctctcccctacggccatccgtggggagcaagcggcggcggcggcggcggcggccgtgggtgttgacgtaaaaatcgaacacggcggcctgggagatctgcttagctcctgtgcaggtccaattatgatgagatgtgggcgtgccagtcagtagatcctgcaactaacaagatatgtaaacagtagatcaaacagctgatcgactgacaagccgatggagtatttccaaccgatagccaataatagttgatactgataccagccgatagcaatagggtttaagcaatcggctatatgtccaatgtagatgatgatgtaaaggcaatcggctgatgatgatgtaataaaatcacaatataatccagtatagaccaatcgtctagcaatgatatgatagaataagcactgatccgaaggttaaagcatacatcggttaggggtccgatgccataaaatccacagattagattaaacagtgaaacctttattgccatcggctaaatccaacttttatatttatatatatatatatatatatatgtatatgtatatatatatatgtatgtatgtatgtatatgtaatccgtataagccgatgcaacgcccagataacttatcggctagcactccaataaaacattagcatgaacctatcggcttcacaagacttatattatcagcaacaatctagtaggtcgaacctaaccgatgcagcacgagattgtatatgataatctaatactcgatgagccgatagatctgtctaatatgatggatataacaaatctatttagaacagcattatgattgtagagatatatcggctaagacaggagatcagacctaaccaagacagtcccagctaaaccgatacgtctctaaacacaatgcaattagaaatagaattgagatatcaggtaggcaaatatatcaaccaaaccagagcgatccaagagatcgaagtgatgcagccttgaacgacgccgatgtaaatgacagattcaccagggcccgacggaacgtaggacttaccccttcgccggagatcgaactgaaccgatgcagccccgcgttaggtgcccaaattccgccggaggataagtaaaaacctcggggaagagggtggcgatgcgccgagagtagttgtattgatcgtgattgatagattacatagactccgggtgtacatatttatacccatgggttgatacaagtccttgtaggacaagaaagaaactatcctaaagataaaaggaagagataaagtccttatcggacactaaacacactttcctaaagataaaaggaaactaacaaactatgcctaattaatagataaactgccatgccgcatcctccttgaactcgaactcttctagataagcttgctttgattgatccgactccaccaagaacatgacagcatagagacttggcgactcccatcggctgattcccccaatcggctgattccagccgatattaactctaagccgatgatgacttcgggctttaccaaatttcactgttaacagtgggctggagctgaagcggcgggctggagtccatgtcgcgctgctcgccgttcttctcgtaccaccaccacccgcaccactcggcggctggcatcgagacgtcggcgacggcggtggtgggcgacggtgggagggcgggcgagcgagggtggcagcggctcacggcagtgggaaagtcgtggtcgcggacgacgacgaaactgcgcagccccacggcgaggcggaaccactcgaggagagggaggagggagagcacgccgccgaggaggtcgcctcacgccgtcacccctcctacgcggccgtccaccgagcggagaagcg

SEQ ID NO: 81238 - DNA, 7972 bp, Oryza sativa
gacaatttggaattgttggtttatggtggaattggacacacacttttcttcctctttcaaaacccttaaaacctgttttcggtggggtttgggtgcatgccagttgtggcaagtagcaccccgggcactataaggattaagctcgggcctctgttgcaaagcactacagtacttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgaccctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtatccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaagataaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggagcaatcgcgcgcggaagattcggctccattgattgcgccggcgacgattacgggtttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaagggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagtccagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactataagttatgcttcccaagagaaccaatttatcccacttgacatactttgacgtctccccaaatagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgaccttgttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgaaatgagaccctaggtctcctatgtcagtaaacaattatacacatgatcacatatccgcatctttcaaacgaatcctcatggaacttgtctgtattacacatttctccctcattacatgaatacgaggcactgccttaaacgaaaagggacggtgcttaacatcggtacattgtatcctcaacatgaatcatctctaaacatagcaagctcactgtttacagacatgattatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgatgctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagaaggaaaacgaaggggagagacagattagaaactaaggataggaccttaacagatctaagtctttggctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcttccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagaggtctgataccagcttgtcgcgaccgggaaaaattgcctttttcccgaacgctaagtgtattaatccccgtcccaggaaaagccggggtacaccatacaaacatgatataaaagacacatctttattatatcgataatatttacattat

SEQ ID NO: 81239 - DNA, 1682 bp, Oryza sativa
  unsure (1)..(1682): unsure at all n locations
aaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcacacagatcccaaacaaccctttgagcatgttgatcccgtttaaagctattgtttctattcaactattgcatttattttcgaatgtcgttgggtggaattttaaaccctnaattgttttttttttgggggtntttttttaaaaatttctcgcctttttgttcttgattactttattccttgataccttgggttattataacttgactagtcgggctttatatattggttcagctagatattagatatgattgcttagccatgcttagaaacattagcacactattgggacaacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcatgagtttcggttgtaaaatattaaccgtgccaaccacaagccagcgtgggcaacagctttaccttttgtatagcatggttcattgcggggcaccagactgagaagtggcggagataagcccacgggggtcgctggggagtccatgccttgtttataagggggcgattatgatccaggaatagtgcgctgtggtggattgtgttgtgcgaggggtactgtcacagctcctttccgaggtaccgtggtggtattgaggcgcatggtgacatgtcgtggggctgtgtcttgtgggtatagtggtacatttctgaccagtgtaaaactattcgaatagccgtgcccgcggttatggacgggtctaacaatgtctttcgtgattagtttcacacttctcaccataataaaagattctataactggtaataatttgattagctcctggtttggaatggtatattcctggtttggagatagaactgtgcagccgggataggttgttcagaatgggtgggcctatgcaacagggtatgttgtatagcgttggattaatattgtttaattactacttaactattttattaaattctgaaatgtttattaaatgctgtttatgcaaatgaaaccctactatgccatcctttgttatcctgtgcacttgcatatttgctgcatggcttgctgagtatgtcatatactcaccttgcaatcattcatcagaggaggagttctacagtgatgctgatggtgtgaaggattaggtgtagccctggtcaagctgcctgtggagtggagtcgtctgcgccgtttatcttattttttccgctgcttagatctttattgattgagaggaactatctacctctgtaatgacattttattcgcttattaattagagtaataattgtactctattatcaatttgttattgtgtgcctcggctgattcctaaacgagggttcacacacatgtaagcgtttagaattttggatagaaattccgggtgtgaca

SEQ ID NO: 81240 - DNA, 508 bp, Oryza sativa
gttttcttcttttttttttcctttttcttttatacaaagtccttcctggagactggaacgtgtcttctacagggatgttttatgaggcttcaggattcgtcatcgctgttggagcccaccgaagaggatgatgacagtgaacttggagcctgatactgcacctgagcctgagactgttgctgcgcctggttcctgaagctttgaggatgaagcgggggacgatgtcgaggcgggtgcgaggagctcttctggttgtgactcatgttgatgactgctgttatgatgtccattattgtggggagaaacccagatgtaatagtcagaaaacctgagagctgcatatgaaagaacatccttgagatttagtttgaatacatgccgtgtaattcagttgaactgaaatgcactagatagaaatttaagaccagtttggctctgtatatccacttgtggatatagaggccggatttttatccattatctaaaataaaaatttaaaagcagaatt

SEQ ID NO: 81241 - DNA, 6456 bp, Oryza sativa
gcgcatcgagtcacggtggttacgtcttaccccctcggccaaatcttgcataaccgagagggtactggacgggtggtgaaatgggcaatcgaactctctgagttcgatttacactttgaaccacgccacgcgatcaagagccaggccctcgccgactttgtggcagagtggaccccggcccctgagcccatctccgcccccgaggccagctcgggcccctcgcagctgcctcacaccgcctactgggtgatgcagttcgacggctccttgtctcttcaaggcgccggtgcgggggtcacgttgacctcgccgagcggagacgtcctcagatacctggtccgcctcgattttcgggcgaccaacaatatggcggagtacgagggactccttgcgggactcagagtggcagctggactggagatccgccgcctcctggtgttaggcgactcctagttggtcgtcaaccaggtctccaaggagtaccagtgctctgacccgcagatggacacttacgtgcaccaagtgcggcgtatggagcgccattttgacgggatagagcttcggcacgtgcccagacgggataacgcggtcgccgacgaactctcgaggctcgcttcctcgcgagcccagaccccaccgggcgcctttgacgaaaggcttgcccagccgtcggcgcggcccgaccccctaggggagacgacgcgcctgaacggcccccgaggcccgtcggagtccaggcctcgggacccgaggggagcgctcccagctcccctagattgattgcttggatcgctgagatccagacatacctcacagataagactctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcggtttggggtgcctaaccgtatcattacggataacggcacccagttcactagtgagctcttcggcgactactgcgaagatatgggcatcaagctctgcttcgcctcccccgcccaccccagaagcaatggccaagtggagcgcgccaacacagaaatcctcaagggcctcaaaaccaaaaccttcaacatcctcaagaagcacagcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagtttcgcagagatgacctcgactacttggaagagcgaaggtggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatatgggagggtccgtatcgagtgatcggcgtcccccggccgggctccgttcggctggccacgggtgacggcacagagctgcctaatccgtggaacatcgaacaccttcgtcgcttctacccctagtgggggtcgggtgtcaggtctcgggctcgggccaaccccgcgcccccccaggcgtgcagggttggccgggggctaccacatgcatatccttatcttttttctcttccgtatttcaataaaagcattttcgatttcctgaggactgtgtctgtgccatcgtttccttttgaagaatcttggcttgaattagcatgctcgtgcccgaccctgccctcagtggcccgggccggctaaaatcgccaaacggggcccagaaccgagccgtgccccggggcgtggtgaactccggggggggcatcggcaaaggcccacaatcgggtcatccataaccctcggtcaccacgttcctggcctggccagtctcgacacgcggatctccccaggcactagccccgacccgcgccgcatgaggttgggacctaggcacgagccctcgttcaagccaagacacagaaggaccgcggcacagaccatcctcatctcatacacacagcaaatgaaattgacacaaaaatttcctctttatttgattgcagattgaattagtttatacaggaagggggcccgaaggcctcagaagaagaaagaaaaagctatttaagattggcgggggcctgggggctcacgccaatgcgcccgagtcgccggcctcatcgtcgctgtcatccgcaccaccgtcaccgccctcctcgtcggagtcgagggcgaacgcgagccgaggggccgtaccctcgaagctgtggatgatatggtcggcggcgtcccgcccggcgtgcgcgcgccgcctctgtctcccggacggactcctcggcccggcggagtctggcctcctcccaaacggcttcctcagcctggcgagcccggacggtctgcagcttctcgccggtcagcttcccgcctccgggcctccgcggttgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgagcgcctgctgctggcacgcaccgccccgccccctcggggaggagatggggagggggtatcctcctgtttcctcttcccccgggcgtcgacagggcggctgccccccgggcccccgtcacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggaccgctgcagagggggaggacaccttggggaatgagggatgcctccacggagctgagattcagcacccgttggatcaccatcttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcacccgccagctggaggcctgcgccgggggctggctcggaagtcggaggcgcgcttcgtcggcgagaggggtgtagaaccagtcgctcttccagtcgtcccacttcttgcgaagaacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattacagcgttgggggtggggtgcgccatctggagatcataaagctccagaacatccatgaagaaagaagagaatggcgggaccagccctgccattgcgaaggaaaggaagaatacggaccgccccgggtagtgtggcgccgggcatccctcgcccagcgcaaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggggcttgagagcgagtgagtgcggcgagggtagggcacaggaaacgagaagttagagcgcaagcggcgaaggcaaggggaataatggcgagaggaaggaaacgaatctcttcctcggcgtctttatacccttgccaacgctatgcccggctcctcgcttcccgcgcccactatctcaccccctcgtttctcgcacccactcctccactaatcccgctcgcccgtttgcggcgcacgaggcggatgtgcggccgtggcggtcgagatgggacatatcgtgcgcgcgttaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgcgcgatttgcgaccactggattcctgcccgcctgtagagaccggccccacctatcaccaggcctaaggagtggcgtcacgcccgagcgctttctcgaggagggcgatcgccctggcataacgccaggggctacagtcggtgacatgggaccgggggtatcttgactagatgttttggggcagccgcggtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagtgccccacgccgcatttaatgcagcgcagcacactcgttcggtccgtgacaggtcacagtgtgtgaccggtcacagaccggtcagatcgcgggttaggtggcaacaagcggcctttcgcacgcctcgccccgtcccgtcggaatgatgagagcctctaggcactcgtccctagccggagccgacgtgctaactcctggagtcagcacgtcagtcccggctagattcataccaggcttcatcgcaaccattacaaggaagtcattttatgaagaagggctgacgtgtggcatgctaaactgacgtgtggcatgctaaactgacacgtggtagacaagaatgaccggtttgtgactggtctgacgccggtcacgtcatcggcagacaaccgtgctcccacgttacgcctgcttccggccgagtggaggtaggtatggcccatcccatcggagggtcattcggacagcagccatggcaaatctccgcccattaatgagggagtaacagggagatccccggtgtcaggcgagtgatgacgctgggcctcactcaaagacaagctgtgatttagcttccaggcgaaggcgcaagccagtttttttttggaagatagggtgagtccccacccaaaagaagagtaggtagaagtggtgtatgtggtatccccttgagatataaaaggaggaccttgcccactaaggaggaaaagggaaaaaaagaagaaaaaaggaaaaaaaggagaggaagaaaaggagagaaggagaaggtggagaacacctgagctggtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacactccacagatcgagggcttagaacctcacctagtgcccccggccgaaccggcaaaggggggcccgcgcggtctcccggtgaggagccccacgctccgtcatctggcgcgccaggtagggggcgcgcgtgtctttctaagccctcgtcctctttcgtgtgcgccaagcttctcccgctcagcccaatagccgaacgggcagtggcgcacagcctctctccgagcgctagcggtgacgacggggagcagaacccgcgccgtcgagctcgtactccaccgcccccctctcgccaaagtcttaggcgggaggaggcgctcgagggggtcgaaagatcc

SEQ ID NO: 81242 - DNA, 9101 bp, Oryza sativa
tctaaaatctatcctcaaaattgtgcaaaagaataagtaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaatcctaaaagaagttctttcccccccccctttttccctcttgggccggctcggcccattccctccctctctctctctctttcctcccgcggcccatcggcctccccgcgcgcgcgcgccgctgacaggcgggtccgcccgccactctcgctgacgggtggggcccacctgtcatctccctcctcccgccgcgccgccgcccgcccgtgccctagcgccgccgccgccgcggattccgccgcatcccgtcgtctccgcgcgcattaaagagaggggaatcactccccgcaatcccctctcccgattccccctctttcccctctctctctccctcggattcgctcggaatcaatcccgcaaacctcgccggcgtattcaatggagccgagatctccgcgcccgtttcctctctctccggccgctctctctccctcccgttgctatataattgctccccgagctccgctcttccgtttccgccgctcgccgctcgctctcgccgtcgaaatcgtgctcgcgccgtgctcctccctctccgccatcgccgccgagctccgttccgccgccgccgccgctccggactttctccttactcggcgacccctccgtccgcttcgccgtgttgccgccgaccccgtccgccgctccgcttcgcccgccgaccgccggagcaccgtcgccctcgtcatcccgagccgcgccgccgtcttcctccgctccgtccgccgtttccgccgccttcgctgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacacgtgggccccacttcccgtggacccggtccgcgcgcccgccccctcggctgacgcaataaataggatttttaattgaaaaataaatgaagaaattcgcaaatatccatttaaagagcataaaaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatatgattattgtcattgttattattattaccttgttcaccctagatcaaacaaaaccccaactagtggacactctactcatgacaccactagtttaattctaggtagatgcttcgcaatttaattaggtaacattaggaggttttacaactttagactttgggaattctcatatcatttggacactttggaattgttggtttatggtggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggcgttgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatccccaggccgtagctatattttcaaaaaaataaaaatcctttattatttgtgaaaacccgctattctctcttgtcttgctgcttcatttatcgtcaaaatctggcctttaaaatgttgcttttctttttgtttgtagatggccggcagcgttacccgtcgtggtttgcacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgctctggcccgtcgcagcggtagacgagcagttagtaggcttgcgcgtgtgtttttcctcgtttgtctttttgagttgtgtggggcatggttatgccggtgtgtggcataactatgtcggagcctgtcttattttgtttgcctaagcaacttgaacattaatgaaccaatttaatatcagtaataaatttaagaataatagtagtcgtgggtggttagttttatttgttagctccttctctgtttgctggttctgggtggggttttcagatggtgacgaccaggagaaatgttaacaccggtgaaggcaaccaacccgaaggcagcaaccccaaccaccaaggcaatccacctccgccaccaccaccagacaccaacgccattctcacccaaatcctcgcccagcaagctaacctgatgaatgctttcctccaccaccttcaaaacccgccacaacagaatgctcccccaccacctccccaacactctaaactcgccgagttcctccgcatccgcccacctaccttctctagctccaacaaccccgtggatgctttggattggttgcatgccgtggggaagaagctagacacggtgcagtgcagtgatgaggagaaagtcaccttcgccgcccatcagctgcaggggcccgcatctctatggtgggaccatttccaggccacgcagccagaagggcaacctattacttggactcgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccccgagctgtctgttcgtctagtctctggggactatcctgattttcaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgccccgacctcaattcgtggtgcgcgtcccacagcagcaacagcagcagaatcagcaggggactcgtgcgccccgtcctcctacgccaactgtgcagcctgttcaaggtcgcagggacgcttcaggtccgcagcgtctgtgcttcaactgcttcgagcccgggcactttgcggataaatgcccagagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgctcatcaccacccctggaggggttatgacagcaaagtactatagccctgccgtccctatagaaattcaggggattccttttccctcggatctgattctgctagacaccaagaatttggatgtgattcttgggatgaattggttggcccaattccaaggggtagtggattgcgcgagacgcactgtcactctgtaccgaggaccagagcaaccggttgttttctttgcacctccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactagccgaagtaaagacacagttggaagaattgaaagaagaggggtacatacgtccgagtacttccccatggggtgctcctgtgatctttgtagagaagaaagacaagacgaagaggatgtgcgttgactacagagctctcaatgaagtcaccatcaaaaacaagtaccctcttccccggatcgatgatctgttcgaccaactcaaaggtgccactgtattctccaagattgatcttcgttccggatatcaccaattacgtattcgtgaagaagatattccgaagaccgcattcactacgcgatatggactgtatgaattcacggtgatgtcgttcggcttaaccaatgctcctgccttcttcatgaacttgatgaacaaagtgttcatggaatacttggataagttcgttgtggttttcatcgatgacattctgatatactcacaatcagaggaagaccatcagcaccatctccgtctggtattgggaaagctgcgggaacatcaattgtatgccaagctcagcaagtgtgagttctggttgtccgaagtcaaatttttggggcacgtgatatctgctaaaggagttgctgtggatcccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccagctacgacctcatgaaggcaactaccctacacatgacttggagttagcagcggtggttcatgctttaaaaatctggcggcactatctcattgggaaccgatgtgaaatatatactgatcataagagtttgaaatacatcttcacccagtcggatctgaatcttcggcaaaggagatggttagaactcatcaaggattatgatgtgggaattcactatcaccctggtaaggctaacgtggttgccgacgctctaagtcggaagagccattgcaatactctcaacgtccgaggcattccacccgagcttaatcaacagatggaagccctgaacctaaacatagttggtcgtggatttttggccgcgctagaagcccagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccggatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggccttccaaaaacccaaggtgggtatgattctatatgggtaatagtggatcgattaaccaaggtagctcgattcattcctgtgaagaccacctatggagggaataaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcatatcacccgcagacagatggacagaccgagcgtctaaatcagatcctagaagatatgctccgcgcatgtgtcctagatttcgggaagacttgggataagagtctcccctatgccgagttctcctacaataacagctaccaagccagcatacaaatggcaccatatgaagcgttgtacgggcgcaaatgccggacaccgctcctgtgggaccaagttggggaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacttatgtggagaagccagtgaaaatcctggacaccatggagcgcaggaccaggaaccgagtcatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaataa

SEQ ID NO: 81243 - DNA, 602 bp, Oryza sativa
tccccactgccagccagccgccgccgccacctctgccagccagccactggccaagggaggggtgctcgtcgctgccgccacctctgcccgccagcgcccggccatgggaggggagcgacgcgagagagagggagggagagagacgcgagaagggatgtgatcgatgtagataaggaccgtgtggtgtggacgactagataaggacgtttggtgggtgtggaccatgtggtgctgctgagccgctgatggctcggcttaagctataggtgccggttctttcaaaaaactggcacctataatatattataggtgccagttttttgaaagaaccggcacctatagcttaagccgagccatcagcggctcagcagcaccacatggtccacacccaccaaacgtccttatctagtcgtccacaccacacggtccttatctacatcgatcacatcccttctcgcgtctctctccctccctctctctcgcgtcgctcccctcccatggccgggcgctggcgggcagaggtggcggcagcgacgagcacccctcccttggccagtggctggctggcagaggtggcggcggcggctggctggcagtgggga

SEQ ID NO: 81244 - DNA, 599 bp, Oryza sativa
aaatttcatatacctggaactaatcccttttaattccctctaatttatttctcatggggattatctgaaaagccttttccttcattgacctggcaatgccatacaagcaatgatgaaagaacattaccaacaatctctgtgcgcgctgtgaaattattgataaatcctcagctaagtcatttaccgactccgacgaccaccttaatataccgcggccgcaacaactcgacgccaccacctcacaatcaaggtcgctaacgcaccggccaccgccgccacagcaccaccacctcatcaccgtagtcggcaccccacgcccgccaccaaagtcacggccacgggccctcgctacctcgcagccgccgccgctaccacacacaaggggaattaaactagggtgttcagctagagaaaacttatctacacgaaaagacaaaaatacctttccaccactctcaatacaggtggtaccatctcataaaaaaatatgtacctggaggtaccgtatgtttccaaccgttcgatcgggcaggatgaagggccgagattcggtaccgggagagctgctggatgggagcaaatattctttctagcaaagg

SEQ ID NO: 81245 - DNA, 13648 bp, Oryza sativa
tgtggactatggaattggggtttaggtgatgcaaactgatcccatagaaatccaaaatctcccggaagaaacttgaagtcgaaagagaagacccgccataaaagaaatgggagaacaccaccacctcgtgtgtcgggggttggaaacgcttcgccgaatgctggacgccacccgatgatctctttcgccggaagaactctcgccactttccccaaaaacaaagaagtttcgcactgtagcagagaatggggaaagtggcgagagtttcggcggggaagacgaagcgatgctttgtttttggtgttatttcattagggtttcgggagtactaatgggcctaggcctaaacagtactttagcccaatttggttatcggcgtggctaagttgtgatccttagggacttgggcatttttgcttcggcaatacttgctcacaacaatatagcccaatgttgctaaaatcctttttgacgcagttaaataattctttggaattactacgatgcaaataaaaaggtgcccaacggaaaagtgttatactaattttgtaagcctttttaggctgcaaaagctgtttgggttttgttgagatgactggtttttgaatggtcattctctcggcatgttatatgcttattttttattatggcgtgagtcatagcctaggctatttggattcgtcaattgtcatgatttaaaccacatttgatggatctttttgagagtttttactcggattcttgtcatatgtgttgatttatggacctttagagtatttcttactcgggtttctttatatcttcatttttggtatattaaagctaaaacagtcggctagatgttttacacagcgtcgcatatgcttagctgtatgatacttttgatgattcagttgaaagaccactcggttggatgtaatttgtaccttgactatatgtttagtttttaactaatcacatagtcgggggctacagctaattaggtgcatctagtcgatgcacctaacttcttttattttcagcccttcacagtctttgattttagtactcgggaggccagagcagaaggagttggatcactcggattattgcttcggattacgagagaagactatttcgtcgactgtaaaggtctcaggggctactatggagattatggataccccatacctacacggcatgtataatccgattgggtatagggagccatgtatagatagaatatctttaatgaggcccgggttaagttccaaacttgtgtgttaaggaagtacccaggatcctagttggttacgattaggtcatatctgtaactacctattccgttagggatatgggctgtattttgtaatacggactccttctcctatataaggaggggtccgggtgcctcttgggatacgagattctactctcagatcatacgatcaataatacactcggcggatcaaaccccagacaggagtagggtatcacttcttattaagaatgcctgaacctgtataaacttccttgtctccaaacccatccacttttctagcttgatagccacccccttttagtattgccgaaatcttgtttcgacaccacccacggcgcgctctgcaccgtcgtcgccacgccggccacggtggcgagggtgtgccccaccgttgactcggcccggcggtccgcctcaccgagttcccgctcgacaacgccacctcctcctccacgctcgcccgacgtgccttgtggtggacttctgccacccgtgggcatcggagctcgccgccggcctcgccgtcccgcggctcaccttcttcagcatgtgtgccttctgcctcctctgccagcacaacgtcgagaggttcggcgcctacgacggcgtcgccgacgacaatgcgccggtggtcgtgcctggcttggcgaggaggatcgaggtcacgcgggcgcaggccccgggcttcttccgcgtccccgggtgggacaagttcgccgacgacgtggagcgcaggtgttgggcggcgatggcgcggcgcggccgtgcttgagcgctggccggctcggcgcggtgtggagcacagcggcaaggtggaacggagggaggcggcatgggaggaagaaggaggtcctccagcagccactggtgccgagtaggccgcgcgtgctctgggcgtcgccgccgtcaccgagcaagtcgcgaccgggaggaagaagaaggagggagaaagaaaagaaagagaggaagacagatggagagctgacatgtgggcccaagggcatttttgacatttcacgtgatttctctcctctttaaccggaaattattattttaatcggcgcggtgtccataggcaaattaccatgtttatggagtgttttcgcccaaatatgagtttggacagtgtcctagggctaaaaccacatataagcagtgccatgtagcaaaattttcccaatttaaatctgggcactaccattgattaggtcacaatccaaacctacgagtttactattccaataaccaaaatattggtatggcccagttttgcagttttggtagcaaaccaaaacggccctgtattcttctcgtcgagactccaaactacaatttcattttcctttagcaccgctttccaaagtaaacgatgcattttattaaaaaaaaaatatatatatatagaagtatcttaaaaaaagaaataaattaattttaaaatttataatagctaatacttaattaatgatgaattaatgagccgctctgttttacatggtgctaatatgctgctctaatatgaacttacaaacaggcactggctcactctctatctccagtttttcagccacgggctctagatattctatatatttaaatatgaaatatggtgatttttgttttccaaaatatttaacttcgcacatgaggcagtggatttgtctcaaactcccatgtagtctacaatgaactatttgtcccatttggatttgtggacaattttttgggttttcaatgaactatttggatttgtggacaatcttttggattttcgatttacaggtatttatttgaaatggacaggtgccaagctaatactacaaaatatcgccaatcctttcttaaatctcaaaaggtccatggagaacaggctgctaaattgcaagtttgctacagacgacaaggctgtacagtgatgccaggtcagtaagggctgcagacgacagtgatatacagtgactaaaactcaactttactcttcagttgtcaatagctacagagctcatctctcttcatcagttacttgtcaacatctaccacaagtgaaaaagcctgaggcgccctactggtcacaaccattgaccacttcatagttcatagtactagtttagtgtcatacaaggaattttttataagtaaatttcatccaacgcaataaatcatatttaatctttaactaggactataggagatgttacatcagatccagaataaacgtttttttttcatccattggtgcaagcatgtctttttgttcccaataacatggtgaaacaaaaggtatcttccctaaggagtgtataagccactggcctctaatgtttgcgctaaattcttgggtgaagttgatgttttactctttcgatgtaatgaccagcaagcccagagcgccgatgagcaggtactgcaacaacagataacaaatgtcagccatactctcagcaatagatcgattaagctacaaataatattctcaatttgagttatagtctatctagggaatagataactgacagacctacctagtatctatttacaatattggaaataataatcgaggactaaaacttttatcaacatcttacaaactattcccacatggataatggattagagtaaccgtagtttaatctccaggttagtaaacaaggaagagcatacctttataaatggtttctcagtcatgatgattgtaacccacccgacatatggaagaaagctgcagacagcagaaaaataaggttggccaagttaattttcaccaggaatgacaatagattaatgttctcaaattgagcatactgaccctacagcccgtcccataatgtgatgttggtgaagccaaagctgcccatgtgcataaagaagacggtcgtccccaaaattattatcacctgagaagcagtttactagttaagacaaaacattcattggcacccattgtacattaaacatttctagatgtccattgcaaccagcactacacaaattgaccagaaagagaaacatatggagcaaaaggaaatatggttaatacctttcgtgaggatatcaacttcagcactttcctcgcgttcatggacctatacacagataagagtaaactcaaatgaatacccaggaaaaataacgaaataaaaggtgacttaacatcaactaataaaaaattagattgattgacgaaaacttcagagttcattaccttaatcacacggtgaacaattggaatttcacggccctacatacggtacaaccaaatgttaaaattaatgatttcaggagcatatgtaagcatgatttatagggccaattgataaattcatgattcagcgagtaatgtacagataataagttacaatgactcagtaagacttacatcaatgttgaaaacaactatctctcctgtgcggataggatctttgctcatgtgtagaaaaaggatatcgccctgcaaagaagataatacatcattcaggtttactagtgtgaaagatgatcaaaggatgcaaaaatgaaacatggagaaaacactggggactaaatagacaatattcactaacacattatcagattgacgtaacattatcctttaaaagtgatgactgggaaataacaagttaaagatggaaggaagggaaaaggacaaggcagcaactagttacaaactaaccgaactatgaaacggaatctactcttatgcaaaagaactatacaatgtgtattcttatcctcggtgttttgttccaaactgcatttcagaagaggagggaaggtcgactccaaaggtcttttgctttagaaaaaactagagattggcttttatcacgtgtttggaagacttggaagatcgaactaatggaattaaatgggtgctagagaaatcaggtgaattcacagttagctccttgcgcagaactcaatttgggttgagtaaaatgtcagctacaagatctctggaaagctaaaattcctttgattattatgtttttatttagttaatacagacaaaatcaaaaagaaaaagagaacgtcaatcaatgccagaccagttctccatgtggtggattccttggcctaaacttaccacaagcactatcgagtaagctaccaaaaggtggtgcataagaaatgggtggctcggataaatatgctctgtgtggcttgatacaagatgggaattgtgtcttcttaggtatattatggcttcagtgcagcatcaatgaaaatgaagcccttggttaggagtgcagtcctatggcttggaaaagttatccacatctgggttcaaatgaagattgatcgagaggctgggccctggatcttaggcttggccacagttgtgtggcctgtttggttaccaacaaataaaatggagatagaaggaaaatggatcaggcagcctgttgtggttatttccaggtccaggatggttcttccatgcagcaaaggaatgtgtttttaaagctggtgatggatagactgcggcattcgcgagaaaattaagaaataactctgttagcctttcttctattttgctctcactatatctgccactttacagtccattactgtgcattttggatgatatattttgcaccctggtttctctcatttctgtgtgtttccatttccctgctctggtgaccctaaactatgttgcttcaatataaagtggagcaagtgcattttattcgaaaaaagcagatatgcaaaatcttaacaggacaagataggcgaataattatgtccacaggacaagacgaggataaatgtaattaaaataagcaaatttcatagttttgttaggtggaaactaacccttttaaatccaggctccatgctaccagaaaggaccacaaccactggggactcgctccccgttgcaaccatcaatcccttccatatgatcagtgccgaggtaacaatcatacctgcaaagtaaaaaacatctcaataacgagtccccaaccaaagagacaacaaatccaagagcactaaaacctcaaacaaacaaacaaaaaagcagattaactgataaaacccaatacccttcttttcccctccctaaatatcacaactttacaatctaatcttaagcagggaacagtattattatttacaactagctctaacccctaagtttaaaacaatcatctacaggcattcaccaaagtcacaacccacattacacgagagcagaaaaatcacaatccattcctctaaggctttcatatacaatgcagatattcctcgttttttctttcaagaaaaggaaaaccttaataacctcacaggaacagatcaagaacccctaaagcctccctccccaaatcctgcaggcgtaacctcccaaacgcttcaaagaaccgaagctttcgcataatcgcgcggtaaatccatcactacctttgaaatcaagaactacgcggcgccccgcaacccactgatctgaacgggaaggactccgaaaagaaaaactctaaaaccgacgaacataatcaggggatgagatgaagggcgtcaccgaggctgatgatttgcgcgaggacttggcggatctgtatcgagcggatcgactccaccgtatcgccgatgaatcccatctctctcgggcctcggctcccggcgcccggcggcgaactcaacgctgggagaagaaaggaaaacaaatctgcgtgtactgcgttctgttttttttcggacagcaccccgcgaatggtcggtagttacgttcatgcccctctcgttgggatcacgtcactgggcttatttctgatcgacggatgtggatcggacggctagggaaatggtgcggcaatgaaatggcagattgtgctcacagagtttggatatattctcgtgtaatgtgccattggcccgttcgtttctaatgaaagtggaggataaacttttgaattaaaatgatacgttttttaaatagctaaacggtacgtttcgcgtgaaaactttctgtatgaaagttattttaaaatattagattaatccattttttaagtttgtaataattaaatcacacgtttttaacatctcattttacgtgaaacaaaaatactccatccgtcctaaaatataagtatttttagctatgaatctggataagtgtgtgtctatatttataactaaaagttactgtattttgggacgcaagtagtatgaaattaacggtaggaaatgaaatgatatgcgggagaagatgaatgttaccgttgatcatagtctctcctatagatacgtcatttatatcagtacataaccaaaattatagtgtagctattaattttcttatagatgatgtgacacacgtcaccagtaactcgtggtactaataaacctgctctaagctgtactacactactatatattcttatgattatgattagagagctactataggaacaatattttacgtacgaagctcgtcaatgtaacgttttcgacggaagccagtcacgttgtccgcaacaagtaacgtttaccatccgtgagcaatcgtacgagagaatcaaacataacaatcgtacgtgcgattatgacattttttaaaaaatgcgagtttaatagtatgttctttctcatgagttcccaactcatctcactctttttttgcgtgcacaattttcaaactactaaatggtgcgcgtttaaaaaagtttatataaaaaattgttttaaaaaaatcatattaatttgtttttaaaattttttagctaatacttaattaatcctgagattgagagtttacacgagaaaattgatggtgagattaagatgggaatttaatttttaatcccagtatcttgtttggtagaggtgatggaaattaatagggagtttagttagagattagttcattaatgaaaacggatggctgagttttgtttaggcaaagtaaaggaggaattccccccaattaccatctcctacctaagtattgaaaaggagagagttcctctcacaattccccatccccattccgcaaaaatttccatgtatcccaaccaaacaaagcagttaataggctcatctttctaaactcccaatcccttctaaaaactccctccaaccaaacggaccgtttgttccgttttaagtgaggaggattggcaccggggtgtccttgttcttgcttagcgcaatcaacaagcgctaagccgctaaatgccgttagtgtaatcgcatataatcggactgcgatctcctcccctctccgggccccgtcggtggtggtggtggtcgtcgccgtcgtggtggggtggccgggtggggatcctaccagtcaatcttaccggcggcacgcgcatgctcattgacttatcctcctcgaagatattcctctcacttcgctgcaatggattcggatagtgccagtccattctgccgttctgggaagaatctagagtatcaagtaggagcagaggctgggccgcaccatggccggagtaggggaggtgctcacgtcgatagtcctcagggaggtggccaggaagctgggctccgccgccagggaccaggtcacggcgcagtggaacttcaccagggacctggacgggatgcggacgacgctggagtccgtcaacgcgctgctccggctgctccgagacgcggagcagcggtcggcgctggaggatgttaaagtatatagtagttagagttatattaggatagaattggtttgtttagattcctttcatatctgtaatcctttcttatctcctctctatgtactcttatatatttcgacccctgaggctcaatacaaatgtgtcccacgttatgcagtattcctctctccctatactatccaatatggtatcagagcgggcgatctagcgccgctctcacgcttccgccgccgctgcccccgagagtagcgatctcccgggggtggccacccattttttcttttttcttcctcgtcgctgtcgtcgtcgtcttggagagatcgatctccacgtctgttcttcgtctaatctagtcatcgtcaagcagctgcaacagattgcatctcctctgccgacctccgtgcgtggcgctcttgtatcgccgtcaggccgcccgtcgtcgacttcatcttcagcatctgttctgctccgccggcctcatcgacggggccctgccgtcgtcgtcgcctccactggccgacgatcgcgccccgatggacagacggatggcgcagctcggctccacctctggcaccggtctccccctgcaacccccgactcctccatctccagcaccaccgtcgaccggggggacaagctcccagcgctgcttctccgccgccggtcctcgcctaccacctcgcctgtcctgccggctgccgggaccatcctccgccggctcaccggacgtccgccgctcgggaggagcccgtgcggctttggctcaagcgcctcaagggcggcctacgatatctccgacatgctcgacgaattccagtccatcgagccggacgcaaggaaggtaagctcctgacaaaccaaattaacttgtcctgggtccgaccaagttagagtaggaacatttttcccaatttttgtagtattacgttgtgggattatggcacatcactttttttttggtaaatctggtgtatcggatagatgaaacatggggctaaaagtttgtgggatgccataaatttgatcttgaaccaaacactatgtacaaaagagctgatgttggagtaacatataggcattgtttagttcgcgaaaagaaaatttttgggtgtcacatcggatgtttgaccagatgtcggaaggggtttttggacacgaatatcacctaacgatttatggtgtaaacaatagagtcgccaaaatcgatagatcaaaatcggctagtgaaaccgatttcgagattaattcactttcgcggaatcacacgactaatttacaagcaaattagcaaagaggataaatatcgtacttacgtgacgacgaacgactagttttcgagcaaactagcaaaggataatcttctcgctttcgtggagaagcatgaccgtttttcagcgcaaaatggcaaagatcaaccaaattctagggttgctagaactcagccatgaaaatgaaatagaaaagaactaaagagaaatagagatctaccctatagttcaacaaatactttcactcattcactcatcactcattttttcattcctcatgcaatggtcaggattgtctcggtgaaatcccaacggtccagatcgctcccacctcccatctctcaaccgcgccctcctctccgccccctctctccactctcaagccccgccaccccctccccgcgcccaaacccccgtctacccctaatccctcctgtcctctccctctcacgcgccgccacaccgatccctccgccgcaatcgcatccgtgctcggccaaatcggcgccaccgccgtcgctgctgccctcgactgccgccactcggccgtcgtcgcgtccgttgtctcgccgccaccgatgactgatccccgccgccggctcgccctcaaccgatccccaacactgtcgtccaggattcgcctgagccctcgactgctgccactccgccgtcgtcgcgtccgtcgtctcgccgccaccgatccccgcgccaccgccgtcgccgtcgtcgcgtccgtcatatcgccgccaccgatccccgccgccggctcgccctcaaccgatccccatctccgtcgtcgcatccgtcgttgtccaggattcacgttgccgccgacgccttccgtcagctggtcgccgccgacaccttccgcgcagatctcctccacgcctccctcaggtcgttgccggtgtggatcaggactcaggaggccagcctcgacacactgcgctacacagccgccggcctttgctgctcctgttgcatggatctagcggtgggatttgcaatagggacggcgatgtgccctgctcgtgctggtggcggaggtatgagcattggggaagcggctgacacggccacgtactcccaaagaccggccgccgaccctgcatcggcgcctcaatggccagccccacagtcccctccccccatctaactggtaaaggttcctcttcctcagttttggcgagttattcacctctccgccttttcgttcatttgccaatccacgactgtttttcagcgtaaaatggtaaagatcaaccaaattctagggttgttagaactcagccataaaaataaaatagaaaagaactaaaaagaaaaaaagatgaatagtagattgataaaattgtccggggttctcatctctgatcatccgtgaccagcatatatatatatatatatatatatatatgccgtcgtacacatgaattaaccggtcccacacaaaaataggaaagttgaaccgaaaggaaacaaactaataaaacagaaataatatctttatctttgcagccacccgcgctaatcatgccttgtcatctgtgaactgccgcctcagccgcacaccaacgcaagccaatacggctcctgtgcatgaggagtaatgcagcacgccaaatttcttctccactgcatgtatgtgatcaaatcaatccagtatgtacagaatgcacagcagtaactcctcggtcgtagcagcacatgcatcaccatgccgatccaaacactgcagctccccagcaactcgtacacctccaggtgcaacacaaattcctgcgcatatatcaagctagctaattcttaaggaaaccacctaacgattgcaccaactattctaaataatctggcccgctcaaatgaaatcaaccatgagccaaattatggcgtaaacacatctcctctgccgacctccgtgcgcggcgctcttgtatcgccgtcaggccgcccgtcgttggcttcatcttcagcatccgttctgctccgccggcctcaccgacggggccatgccgtcgtcgtcgcctccactggccgacgatcgcgccccgatggacagacggatggcgcagctcggctccacctctggcaccggtctccccctgcaacccccgactcctccgtctacagcaccaccgtcgaccgggggggacgagctcccggcgctgcttctccgccgccggtcctcgcctaccacctcgcctgtcttgccggctgccgggaccatcctccgccggctcaccggacgttcgccgctcgggaggagcctgtgcggctttggctcaagcgcctcaagggcggcctacgatatctccgatatgctcgacgaattccagtccaccgagccggacgcagggaaggtaaactcctgacaaaccaaattaacttgtcctgggtctgaccaagttggagtaggaacattttgcccaatttttgtagtattacgttgtgggattatggcacatcactttttttttttggtaaatctggtgtatcggatagatgaaacatggggctaaaagtttgtgggatgccataaatttgatcttgaaccaaacactatgtacaaaagagctgatgttggagtaacatataggcattgtttagttcgcgaaaagaaaatttttggatgtcacatcggatgtttgaccagatgtcggaaggggtttttggacacgaataaaaaaactaacttcataactcgcctggaaactgcgagacgaatcttttgagcctaattaagccatcattagcacatgtgggcaccgtagcacctatggctaatcatgaactaattaggctcaaaagattcgtctcgcgatttctatgcaaactgtgcaattagtttttgtttttatctatatttgatgctctatacatgtgtctaaagattcgatgtgacatttttgggaaaaaaatttgggaactaaaccaggccatactctctccgtctcataaaaaaataaggccatgctctctccgtctcataagaaaccaacctattactagatgtaatacatcttaatacaataaatctggatgtgcctatgtccagatttattctactagaatgtgtcatatccaatcatagattcgttttttatgggacggagggagggagtatattggtacagaggaatttgtagtacggtttatctaacttggttgcaacattaagtcaacgacctgttgtgtatatctgagatccagtaaccaattttcaaaaccattttacataatcttcttgcactgaactacttcttcaatgtcgtcaaagtgaacaatcctgtgttcgttaacagttggccaggtttccatcaatataaattgtagcttgtgacttttcactaattctcacgtatattaataaatcaaatgaaatttattgcagaaaaagggagtgttccacaaacttgcaactgcacctagcaggtttcctatggctagtaagatgaagaggatgagaaagggggtgc

SEQ ID NO: 81246 - DNA, 8209 bp, Oryza sativa
gccccccccccccctcccctagatccggccggatctggagcggcgggatgggtggccggccggcggcgggatgggaggccgcccggtgagtcttttttttgattttttttatttgtggtttggatgtttttatctgtgattgaatgtatgaatctgtgatgtggtgactgagtatgtgactcgatgttgtcaatgaacctatgaatcaatattgtgaatatatttgtgatgttgtgaacgaatatgtgaatgaatttgtgatgaatctgtgaattgtgctgtggagttgtgatgtggatttggggttcaatttgacgatatgcataccactcgattcggaagaaaataaaaaaaaagcagaaaagaaaaaaagaaaaaaaaggaccagctagactgccgctaccctctctttaatcccggttggtgttaccaaccgggagtaactaaagatcgatttttagtcccggttttttcacccgggactaaagatagcgatctttagtcccggattggtagtcccgggttgaaaaccgggactacaagggggttacgaaccgggactaaaaagcacttctccactagtgagtgcaggcgccatgcatgcatatatgcatgacatggcatgccttcccaatggcacagcacagcacttatatatagcggtgtcggatgagatggaggcgcaccacactcattctcccacaagacaaacatagccttctctcttcctgtacccactcgccattacacagtgcgtcctcctccatccgtattgcactccccctagctatagctatattactcaccttctctctttaagcctgtctagtaggagtagctcgttagctacatataggacgtatagctaaggtttggttagcttggttaattgttagctggtgcgatcgatggccggcacggcggagtcgccggcgagctcgtgcgtgtcgtcggacgcggaggaggaggcggcggtggcgaagccgatggtggtggccgggtgcccgcagtgcctcatgtacgtgatgctctcggaggaggagcagcagcccaagtgcccacggtgcaagagccccgtgttgctgcacttcctccacggcgccgccgccggcgccggcgccgccgccagcagcaagccgccctccaagacctagctcctccatatccggttctcaatctctcccagatggtcggccgccgtccgtcgtcttaattctaacgcatccatgtattatgtttaatttttctctctcgatcgctagctagctgtagttccctttttctagtagtagctgttatgtttttttctgtcattcgatctgtgtgtctttagttaatctgcacctcctctgtagcttggtcgatcgatcaggttaattttgtcaaattagcactattagctagctagtagctagaccagaggatcaagcatgcatcatcccttcccaaatgatctcctactccgtggtgcagttgcatgctttaaccatcctattaatgaatctgccatcattctcaattgttttgcttgttacagtattagttagttgcatatgcatgtgttcttaacgatcgagcgatcgatatgatccatttccatggtttggtttatgtcttttttccttctactatacactgatgaagcaggtttccattaattggagaaggtggttaatttcatcgtctctcagttgattgatcgatcaatcgatctctgctgctgctgcgttacgtacgtactttggcttaattgtgttagctggatggaaaggatgcgtgatgaaaaatcaacctccagctagctttagctagtcaggggacgggaaaataaataccagtagtgatgaatcaaattaaagtagagtcgaacttatggtagatggatggggcgatcgatcgtatcatgaaaaacgtgtgcccgttttaattagagatcaagtggagagtagagtatatggacgcatggaatagcagctgatgaatatgaatgaattgaaaatgaacagagctataggccggcaatcattaggggcagttgagaggaggaattattcggggcttagcatgcacgtcagttcgtcatcaagaacacatttatacccaccgtccttctttcttcttttcttcaggatatttacgagttcctttttcttggcgtgatttctgtgtgcgatgccagaaaaaggccgaatcggtcagtctgagactgaacctggacgctgaccctgaactgcagaactgactgggccgatagattcgagaggatgaggcatgcatccacgtttattttcttccttttcgacgcgtccgtttctactgacaaaaaggagcgctgccatccgggctctgcccacgctgaaactatcaacagatcacgctgaaactatgaacagaccatcagatgctcccagggaagaagccagctaaaagctttggtttgtgcatggaggggagagccagcgatcgactttatcctgtcactgaatttgcctggaggatgacgttagaatgtggagggaagagataatacgttagtttttttttaaaaagaaggataatgtaaaggtgtccgcaaaataaaatgtaacagaaaatggattaaaaatgaaaaactaaaggattttgttttttagtttcttcaatagtggatcaaaaggattaaagaataaaaatactgaacgtaacgatgcagcggtggagtcagatattagagcatccccagcagctactctaaccgatcctccatccttcatttggcgtatagaaggggaaaaacggctccaacagatgcgctactaggcactccaaaagtgacggatgcgccaaattaggagagagagaagaggcaaaaatggagtgtctctcctctcacgcccttttgcaacagccgcctctctcgctccaatccggacttcagcgaccatctccctctggcgtgaccccacctccatcgccgtcgtccccagccggcgaaggagagctcccttgcccgtttttgcttttttttttcagcgaatcgtggagagaggcgtactagatctggaccgtcgtccgccgcgtggccgctgcttgccgctggcgtgcgcgtggtccctcgtccgccgccgtcgccctgtgcgtggcctccgcttcgccagctgccgcccctcgccagccgccgtcgcccggcgcccaccgccttcctcctccgccgcttgccgccgccacccctcgcccgcttctcctcgcttcctccccgcttctcctgcgccgcttctcgagagttcgagtgaacagtgaataagaagataagggacatgtgaaaaaataaaaaataatataaatggatggtagttgaagtatatactattaaaatataagaggatgagatatagagcatgtaatatgaatgatctgttggagttgagagaaatataaaggagaaatcttttttaaatgaccatctaaataggcatatggaggatcgaatatggatgagctgctggggatgctcttaaatgttatggctgagttgaggctcaactgaacaattgctggtttcctctaaaatttacgtggtgatttaagagacttaaacttgattttgaaggtcctagggagccacccccacattgttcatacggtatattagttttttttttgttagaactttcatatagtcatcgcttatttctctatcacgctccccttcctgcacctaggagatttcctatggtaaatcaccatattgatcttctgggtcgtcacactagtaaaacgtttttcactcccagaaggggaagtaaaccctgcacctgcacgcaccctcttgaaaaccgattatagaggaggaaggagacagtttaacaagtggagagatggcaaaacacaggagtttgtgtacatgggatgtttggtattcctttcgtttcatattacaactcatttgactttttttatatatttttttaagtttgacaaaattatcaaatttatagaaaaatattgtagtattttttaaaaaatattatcaaactatattcaatgttagatttaataaaaactaatttcatattttaggtattattaaatctttttataaatctatttaaacttgacaaagtttaattagaaaaaagacaaatgatttataatatatttataatatgaaacagagggagtttgtatgagatattggagccgttgatgtgcaagtccaaccctcaaataatcagtggggattgtctgcagtactacacatgcagtagcagccgctgatatatgggaccgagtccacctatcagccactgccactgtaaatgcagcattgtagagcatccatgtcccccctgtaatagcccaagtcgcctggcaccgacgaacgaaaaggaaagccgaaaaggatatatgaatgcaggctgagggaggggacagattcgggcgggccggccggtgcgtggattgcacgcacgcactccctccgcaagtggccgcacccacaaaatcgccctcctttttatccctcccgcccacgctctcacacccgccggcttctccttgtctctgctctccacacgcggagtggaggagggattaatcggaagcatatcaatcggcggccatgacgatcggcggcgcgtcctccagcgtcgtaggtacgcaacgcatgcgcccgaaccgatcattccttgcatatcttggatggatgctgggttttgattgattgattgatccatcatatcgcagtagtgccacgcaacttccggttgctggaggagctggagcgtggcgagaagggcatcggcgacggcaccgtcagctacggcatggacgacgacggcgacgacatcttcatgcgctcctggaccggcacaatcattggaccactcaacgtacgtacgctcgcaacccccccgctgtgtacatatatatttgcattgacatcctgctgcagattgatacttctcatcgatcgaccacgcatgtgctcactgctgcatttttcatcatctggttggttgcattttcatctgggttgttgattggttggttggttgcagtctgtgcacgaggggcgcatctaccagctgaagctcttctgcgacaaggactaccccgacaagccgcccaccgtgcgcttccactccaggatcaacatgccctgcgtcaaccctgacaccggactggttcgtatgctaaaaattccctccctttgttgtttaccaccaccacctgcccattgcacatgccaccacttcaattccctcatcttggtattattactcattctgccttctaatgaccaacgggtaaagcacacaggaatatatattctgccagcaaattgattgctgcccacctgaacatgctctgattttgcaagtttttgaaagaacttgcactgattgatgttatacatagtactgtttgatagtagttgcttccaattagattaacggtgtgcttagttcacgttaaaattgaaagtttggttgaaattggaacgatgtgacggaaaagttggaagtttgtgtgtgtaggaaagttttgatgtgatggaaaagttggaagtttgaaaaaaaaagtttggaactaaactcggcctaaattaaagttcagcagcaactgtaaatctgaaattctgatgaatgttgaagtaccacctataccatacctttgtttataacatactgatcctctgcatacttgaaatgctgctgactgcggcagcaagatctatgaactgcgtcactgcatgcattcctgcatgtcatgattcctttgatacgcaggaaggaccgaaggatgtttgaatcatattgctgcctgcacgctagtgtctgaattttgccaggaaagatcttcagtttcaaacagatagacattctaatgctgaagtgatttcaataggttcattaggttgtaatgatgtgattgtttcactggaaggttactgaatttcacctgaaaacactgcaaaattatgcagaaattgataccatagacacatatagctagaaaggttcagaatgttagtaagttattactgctagtacttaccaattcaattacaatttaaacctgtgggttctgaattctgattacacacgccttaatgagatggtgagaattgattgtaatcatttcactttacttcatcaggtcgaaagcaagaagttccatatgctggcaaactggcagagggagtacaccatggagaatatcctgacgcagctgaagaaggagatggccgcgccgcacagccgcaagctggttcagcctccagaagggaccttcttctagtcataccgtgagatgttcgagggcatgttcctgttgctgctgctgctgctatatactcatataggattggattgctatctctgtccatggcacgcaccgttcgtaactatcacctgcccccaaatctgtcacctgaaaggtagtagtactagatgtgtatgtagtgcagtgttgttggtaattactgaatcgccttgctaatgcctaatggctgccctgcttgctatcatatgcatgccaatgtgaaggacaggtttggcttggtttgaacgctgagagagattgaataacacgagacctcctgtatctggcaccgtatagactcctatgatttatgcatgtgtgttaagactaacaagtattttatcccggtgccattttcttggcgacatgggcacctgcccacagcccattattagcgggctcgtcggcttcaattttgggtgggaaatggcatggggctttctgatttgggttggcacatgtctgaattcagaattccgcacgaggtagttgcaagcaggttcagcccattttagtactacggctgtgttcttactcatctcactcgtttttcgcgcgcatgctttttaaattgctaaacagtgtgtttttttaaaaggtttctatacaaaagttgtttaaaaaatcatactaatccattttttaaaacaattagctaatacttaattaattacgtgttaatgaaccgtttcatttttcgtgtacactgttcgggttgggaacaggtggagcgaacatagccgtacgtactaatataaaggcaactcatatgttagagcaagtttaatagtatagccaactactagctccaattcatctatagccaatctaatagctcattcatacaatagttatatactatactattaatacatggtcccacatggtatacacatactgtatcttggagtctgtgctacagctgactacaaatctgtagcccgctgctcttctctctcctcattatcttcttaaaatatatttgcagctggcttatagcctgcaattgtaccttctcttatagaaggaaaaaaaaagaactcaaaagctgtgatgtgggctggaagctcactgtcactgtaggtcgctttccggatgtggaaaaggaacagagcaaacgaacgagtcgagccgccgaaaccaataccggatgagccatcaatccatcatatgcaccggaccccaacgatacgagatgcgtaggcgcagtcaaagttggaccgagttacgtacactagcagtagccaggatatgattgtttgcttgatgtgagaaaaataaaataagtgcccatttgatttataggaaaaatgtaggaattttagaggattacaattctatggaaaaaaaatcctatgaagacctttgaaacaaaggattgaatcctatccaatcttttaaaattcctatggaatggataattctatgcacattttggaggaaagttagcaagagatctaacctcttggaacatttcctctgagtatatctctcttatgtgattcctgcgtttttactgtggtccaattaaacggtcattcctgtgttttttctctgttttgtaatcctctgttttacaattatattcatatcagaatcctgtgttttttctattcctcggtttttttcattcatacgattcaaagtgccataatcagaaataatgcaaggtaatccttccgatactgtctaccaaccacggaagacgcggatgcataagtgggagtagtgtagaaggaccggccaggaggaagaagactcaccaaacgcgaacgccgacgaccggctggctatttcgttgaacactagcacacgcaaggaacggaatatactcctccaagtgtttcgcatggacggtcaagtcaattccggaggcctgcagcggcatctgcccccccccccc

SEQ ID NO: 81247 - DNA, 5267 bp, Oryza sativa
cggcaaaggggcaagccccctttctccccctccttttccccttttcctcctcgccggcgtcatcctccctgtcgccgctttggccacgaccgccgagcgccagctcgcgcccttgaccgcgcaagtcggttcccaaaccgacattgccgcccctttaaacccccagcctcccctttcccttcctcttccattcgtctccgctccattgccgccgcccccgtgctctgtctcgcctccgccgtccttcgccgagcgccgggagagccggtgcgttcgaggacgcggaaggggactccgggcgtgccctcgcttcttcctcttcctcggcccgaggccggagagattactcccgcgccgtcggcctctcgtcacagcgcccctcctcttctcggtgatgcctctctccgttcttcctcctcgctccatctcccccctagctttcggtagtagcttgagtagcctccccgtagttagccggcgccgccccgaccgttgccgtcgctcgccgtgtgctcgccgccgtcgccgcccgagctccgtagcccccgctcgtcgccagcctcgctcggcgtagttccgcccaatccgacgctagcgtcgagttcccgaagccgcgtggatgctctcaccgccgggaatcgacccctcgtggcctcgtcgccgtttccctcttctcccgccgccggttgccgccgccgcaatccgccgccgtcgagcaacctccggcgaatccgagccgttggctcgtctccccttgtcacgtacaaccacccggtgtgctcgcttttgcccgtatcgccgtggttcactccgccgctcgccgtcgccgcccgccgtccaatcgcggccgggtcgtcgtctacctcccgccggcccgcgaggcagccacgtaggcgccacgtcggcgccagctcagcctagaccgggtcgagccgaccccggtcagcccctccccttgcgcgcgttccaccgcgagccgagaggctgcgcgtgggcccgccgcacccgcgtccaccgcaaaccgcgcgcgtgcaccgcgtccctcccgcgcccgcgcgcgtgcgcagcatgctcccacacgcacggtgagccgagccgctgacaagcgggtcccacccgggaccgcgcgtggtgagccctgtccaccggcccatcactctctcctccccccccccgcgcgcgctgtgggccgccttttgggccggccggcccattaagctcagccgagccgccccaaatctcttgggccgcaccctagccgcccgagaaaagtctatattccctccccctttttttttgcttttctttttcttttccaaaaaggatttaattaaatccttttcctttagaccaaaaatccaataatcttagaaatacaatatcttcccaaccgtaagtccgtttgactccgttcaactcccaaaattcctcaaatctcgagatctatttaatggcatgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatctaattatattgcttgaaaaatattatgcattgataggatcgcatttaatctgttgtcccgtctgcaaggcagattggcggacttacctaacttgttgcatttgatccttccattgttaattgctacaccatgtccccttgtaactacccagttgcacctcgatattcgtgcactctgtgcgagtatcgacggtcgccttcaaacttaaaatctgagtaacaacttgggtaaaacttgggttttacaaaagattggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtagaatgggacacccctggctgagtaactagcttatcaggggagccttgatgccgagagacatgtggattcgccggggtggtgtcagggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaatagtcgtgcccacggtcatgggcggatgtgaggtgattcctagcgtagttttgtttgactactgcttgtgaaattgctgttgagaaaaggggttcgatgtttgaaaaatctgtagctgatgagatcagctaggcccgggtggccgtttgaaaagttgttggcccaggtggccgtttgaaaaagctgttggccgggtgccaaccttgtttcaattctaaagactgatacattgcacatactccgaccggacgagacgcactgtctcatccgtgtcgtttgagaagcactcacttagttgttttcagaaaatggttcaaataaaatcaattgctaaaacaacagccttcccttgaagcctgcaataaacaccttatttcccctggcttgctgagtactcccgtactcacccttgctctatataaataacccccccccagttgctgaagaagatgaagcggatccggctgatgaagagttcttccaagagcaacccggcttcgatgagttttagggtttcggcctagttcccaagtcgcgcctgtgatgattggtccaagtcctgacttccgctttccttttgtaatgcagttgtgagctcgggatctgtccgcagcccaacatgactgtacttctactctataataaagagacctctgttgttgtgatattctgtctccctgtgataccagcactgtttcctgggactggtatcgattaacaggttaatttggagcgtcacgggctagttccggtcggtactagtttggggcgtgacaatatgtttgggcaaaagtctgccgtaaagacttatggtatcttagagtttgttagagataatagtcgtgtccgttatggacgtatcttgtaattctcagatataagtagacccgagccctatgtaaaaaaaggactcatccaatacaatctcagcgcatcgccaccctttttattctatatgcttgatctatgtgttaaatctgccctttatgttaggatcttgtcgcatctagatatattagacttctgtttggtatattctacttgctttaacatcttaatatagagtggtatcggagtattagccgatgcatgctagatacatttgatcggctatgatataaatgtatctaatcccactattaatatatatttcgatctaaatgatttatactgtctcggcaaggcgaccgatctatcccaatcacttgatttaaatatatatcgatataaggattatatatcattaatatctacagccgatcgagtagatttagttatgatttgcttattgatatttgccgatcgatgtacgtatgacatcggcttgaaataaatgatatgtcatcggcacctagccgatcggctatcatttataggattaattgcggtttttttgttctatttcttattgattgcaggatcaaatcaactggcacgctcatacacctgaaggcgagttttggacctgcactggagttgagcagatctcccaggcctcgtgttttctatcaacagcggcggcggtccctggcgtagcgaattgatggcgctcgctggtctcaggcatgtggatcgatggtggcaacgtgtctcgggtagtttcatcttggcaacgacggcaacaaccgcaacttggcagcgatggcgatgactgtggtgagggtgccaaatcggcgacatagctgactattgcagaggggatttggggaatccgtggttgtgattgtggtcttggagaaattgcgtgaaaaggaaagtttgggaggttttattttcgaaaaatcatctccatagacggtcggcttaaccttgttgcttgcagaaatcggcttaatagccgcttacaaaaaaatgatttttttgggggttaaagccccgcctataaaaatcatcgatgttcacacgtttttgatcgcaaggtagggacgtatggcctcatgcaaacacgtgttttgcagtagtgtatattgggtactgatcgacaggtaggctccttgtcacgcgtactcattttgttctagccgtactcgtatatatgtggtccaatgacatctatttttggataatggaaattgtcgacgggggatacccgtagaccagatatagagggtattggggtccgttgatacgaggatctacgtagtacgacatcaagcaaacaaaagacaaggattatactggttcgggccccttggtaggtaatagccctaatccagttggtatgggattatatgatggaaaccacataatacaaagggaataacagaactcgatgataccgacgagaccgtagtcgagttagtccgactagatctcccggcgacttggctcctgtaggccccgactccgtaggttgtggtgggtatattggcggtgatattcgatattcgatgccttaggtcctgcccaaggggtcccttatataccgcgggtcagttaatctccaagtagaactcggagatatcggacccctcacgatatggtaaaaacccaacctcatccgagtaggactacttccattcgtagattatgtttctatcacgggatagatttccttaacgtatacgaaaactatccgtacacgcgcgggtataccgtatcggtacccatcgtatatccaaggatagagggtataccttacccgtaaccctgacagaaatattttacatttttgtttctaccataagacaaagacgatgtagaaagaaaagttaaaagacatttccattatccaagaaaaagatgacatttgtctttgtctgccataagatgctggtctgcccgaagtttatataaataaaaagacgatgcaaagaaagaaaaataaaatataaagtgataggataaattctcaactcccctattgactaactttaagccatgtagatttttcaaagccggccgttaagaaagaaagaa

SEQ ID NO: 81248 - DNA, 585 bp, Oryza sativa
ccagtcccaggaaacagtgctggtatcacaggaagacagattatcacagcaacagaggtctctttattatagagtaaaggtacagtcatgttgggctgcggacagatcccgagctcacaactgcattacaaaagggaagcggaagccaatacttggaccaaacaacacaggcgcgacttgggaactaggccgaaaccctaaaactcatcatagccggcttgctcctagaagaactcgtcatcagcaggatccgcttcatcttcttcagcaactgggggggaattatttatatagagcaagggtaagtacgggagtactcagcaagccatgggaaataagtgtttaatgcaggcttcaaggaaaggctgttgtttttgcaattgattttatttgaactcttttctgtaaacaactaagtgagtgcttctcaaacgacacggatgagacagtgcgtctcgtccggtcggagtatgtacaatgtatcagtcttttgaattgttcaagattggcacccagccaacaactttcaaacggccacccgggccaacaactttcaaacggccacccgggcctagctgatcccat

SEQ ID NO: 81249 - DNA, 1263 bp, Oryza sativa
cttcaccgccagcgcagagagcacattggggcgagcagatgagcaactaagaagaagtgatggtgaggggaagggaggaagggatgtgcggtgagtggagggggggcctgagcagctgccggcgatggccggaggaacagagaggaagagaaaaaggaggaagacagcaagggagaaggaatgggtggttgcaggggcggcctccgcagatgccggcgacgggagggtggtcggagaccagactcaccaaccacggaaggccgaccaccggtgcgtactggcgccacgccgccacgcagacgccggcaaaccaccgcccatactccggcgcacgcgccgccgcgcgtgaccgcgctcgcgagtcgacttgcgtgacgaccccgccgctcgcacgccgctagacgctgcagcggcaccgccagccgcgccacctccgcttcgcgccgccccacgacaccaccgtcggcgcaccgtccagatccggcaacggcggtgccggatctaccgccgcctggccgggattcctcgccgccgccactctccgccgccggcaaaaaaactccacctcccccacgcctgagagggggcaccactgcggagaaagccccgccgccgccttcctagctcgccggccggctttgccggcggtgagctccggcggcggcgaggtaggggaggggacgagggtggcggcgccggtggtagggttcgcccccatgtcgcctgcgtgtgggcgacgcgggggtctttttcaatgatggatcattttgcttggcacatcatcaatcattttgccttggcacatctaatatgataaaacagccacatattataaggtttttgaagtagtatattacttttgaaacaaatctccatctcaagtcaccaaaacagtataataggatgattataattgacgatttgacgtttccatacacaacttgctttgtgcagattagtcaaaaggatgatagactcgtaacattgaccatgcatgatcctgtgcatgacatggcaagatcagtcatagatgatgaattaattgttctagatgatacgaaagaaaataaatgtgggcaaagcacttaccgctacgtattcatcaccaactatgacaagccatcaaaggaattctccatgattttacatggaaagataagggctctccatttggtgggttgtagcaaaacaaaactcaatgatggagcattttcatctgcgaagtgcttgcgtgtcttggatttaaatcattgctctatacag

SEQ ID NO: 81250 - DNA, 601 bp, Oryza sativa
ggtgggtgtgcggggtgcgagaggtatatgagtgggtcccaccgtttgctcttcctcgtcatgactcatgaggtgtgagggggtgtgcgtcagtgggcctaccaactatctacttatttaaagtaggtagatagaaatttatttttgacttatctttagtgaagaattattgtttttatatatcgggaccatttgaaaaaatatatatatataatatgtgaagatattgcatcaattatacagcaaagatattaatacaaagataaagtagatgagtatatctaattgttaaataacataggtttcaacgagaggggttggactacccccttattaatactctaggtccactcgattcaggggaaggtgtttactactacctccgtcacaaaataagtgcagccgtgaaaatccgtgtccaacgtttgaccatccgtcttatttgaaaaatttataaattttttttaaaaaattagtcacacataaagtactattcatgttttatcatctaataacaataaaaatagtaatcataagtttttttcaaataagacgaacggtcaaacgttggagatgaatagtacaaaactgcacttttttt

SEQ ID NO: 81251 - DNA, 11690 bp, Oryza sativa
acgacgcggagcagcaggacgccgcctgcagctcgtagcgcatccccgacgacggcgcgccttcctgtgacgacaccgccgccgtgtcaggccacaggatgtccgcttcttggaactcttccatggcggcctggccggccagcgctcgttcccggttaacctggagcccttttcagctgtgaccgcggcgagccggcgggcattcttatactattcgtcttcgacgctcttgctagcggcattgcttgggacccgaagtgacgtagggggcactcttccccccggtgctgattttggaatcttggcgaggtagcaacccatgtggggttacttgctggagcaccttaatgtgagagcttgagcttgcctaagttacagctaattcattacctaaaataaaagttacagctaattaagaggccggcaccggtctgattatctgtggctgtaaaatcaagtcctaaatcgtcttagatatgatgaacatttcttggtcatgctcccacctatctagaacgtgagccgttcgatgatacaaccatctgtttagtactgccgtatgtctggataggttgttgggtgaaaatttcggttcccaagaactgcttttagagcggcggggggaagtcagtgtggcataggtgagcccaaacaaactcaaatattcctagtatctgttgcaaaatttctaccacagaatcctttcggaaattaaaattttaatggtgtagtgtattcgatgatgagtccgggctgctgcccgttgtagctgggcggtggctccgtgctgggtgcaaccgaagtttgcagctgagtgacaaggtagtgtctcctggccgaaggttgagcccacaataattgggcctgtattccggcactcgtggaaatccgtgggcttgtggcctacgagttgtaacctcttcttgtccctacatacatatatgggccatattttgctggcctaattgccggcccgcacgtcatggttctcccctgaattatgtcatgattcctgcttgcggcatgattcccccagcggaacagcatgaagcaaaacggctcaaaacctgccgactcaaaattcacggcgctcacgtcacgagttccgacggtcgacggatagcacagtcatcacagagttcgtcaacagtctcaaacaaaatgctcgttaacaacagcggattgggccaaaatcgccggtcaccaaccgagccaaccaagcacatgcaacgctgtatccccagcactccagcagcgtttctcatcgatcggttagcgcgctacactaaattaaaccttccacgcgtgcagcatcgcgctcgttttaccctaagcgtgaacgcctcaagggaagggataatcgagcccctggctgcggttggacacgccgaattcaatggacttaaaccgaggtagaagagcagaactgtagaagcgtgactgcgtgagcatgtgaagtggattgtgagttgtgactgctcattagccgtatggctttctgcgtgccgggccttgctccggccgatcggtctaaaaaaaggtagtataaaaaggggcagatgatccctaccaaaacggtgcaataaatctagattggggcagcctaaccagtcaaaatgtagcagtctcaacgtactctgatgaaagggtgtgggtctagctggtctagtggtgttactcaaatactccaatcggtcgggctgcatgcgagatctgtgaacagatttctcaaatgtctgcatgtggcgtgtccgggagattctccttcgcatcgtacaatctcatctgtagcgtttttaacacttctttatttttacgctgatgaacatgataaatacttcatccgttctaaaataagtacagtattccactgtttatgtttaacgtttaactttttattttatttaatttttttatgattagtttttttattgttattagatgataaaacatgaatagtattttatgcatgaattttttttatttttttataaaacttttaaatatgacgtgtctacaacgagaccgttctctgtatagtcataaccagctacctcaatctcatatctaattgctactagtatactcaaaagtgcatgtattttttttcttcttatggaattttctcttagattagtcattcgatttacgatccgattacaccattatgttcataacaattaaatctttataacaagatctcacatgactatatttttatgaaaaaatacaaattacttttataatatatgtaaattacttttagattacattaaattacttcttagtcataaaagtaatttacctatattatagaagtaacttaaaaaaaataaagtaacttgttacgacattaaaagaaatctatacatccataatgttattcataatattgtgagttgtttattttataatcatttttagtcagtgacgtaatttgtgctgattaaatttaatttctatatagacccatgtttttacctccataacggatttatttttgatgtcgtgataaggttactttctttttgttttaagttacttttataatttatgtaaattacttttagactttactaaatttactataatatgtctaagaagtaatttaatgaaatctaaaagtaatttagatatattataaaagtaatttatattttttcatcaaaatataatcatgtgagatcttgctataaagatttaattattacgaacacaattacgtaatcggatcatagatcggataagttatttaagagaaaatttaatttgaagtataagtggttcctatttgcttgaaacataggggataaactactctctctctagcgtagcagagtgcgtcacatgccttctgattcggtttgttctggccttcttggcaatatcggcatgtggaacagatcagacgactacaccagcgtgtgggatcggacggccctagatgcgtcgcgtgataagaccagatcgagaggcttctcgagatagattttacgttttaaataagatgaacggtaaaacgttaggcatgtatacccacactcaacattcaacactggtgatcagtcaatactaacaatcaaccgtgactagtgactccaacgagcacgtgcaatccatgcatccctccccactgtgcagtacaggcagccgctgtcctgttcagtcgatcactgcactcccggtctgactgctgcacgagcaacccgactcgatggatcacgatctagtcgccctataaataccaagctccgatgaccccgggcgtgtcgtgtcggccggtcggcgtctcgtttcgccggcgcccgcgcatcttacactgtccaagccagcgcctgcgtgcaggtcgatcgccttctaaaaccggccagcgcgcgcgtctagtgcagcggctgggaatggagcgggtgtcgtgcgtgccgctgcttcggcggctgcttctcttggccgcggccgggctcgcgggcgccgagccgcaggtgccgtgctacttcgtgttcggggactcgctcgtggacaacgggaacaacaacaacatcgcgtcgatggcgcgggccaactacccgccctacggcgtcgacttccccggcggcgcgaccggccggttcagcaacggcctcaccacggccgatgccatctgtaagccgatgtgttactgccgttgattacttggtcagttgatctaatatatatagcatcacatttgtcgatcgatacgtaccatgcaccattttgtagctcggcttctgggcttcgacgactacatccccccgtacgccggcgcaacaagtgagcagctcctcaccggcgtcaacttcgcctctgctgcggccggaatccgggacgacactggacagcaactggtacgcacgtacgcacagctatacacacgcgacacgcactgacgcacacataaaccaacatgtactattcgaaccatgcatgtgtttcgagcgttgcacgctggaaatagcccacacgtatgtacgtatgttcgacacagggtgaacggatcagcttcagcgcgcagctgcagaactaccaggcggccgtgcggcagctggttagcatcctgggcggcgaggacgccgcggcgaaccgcctgagccagtgcatcttcaccgtcggaatgggcagcaacgactacctcaacaactacttcatgccggcgttctaccccaccagccggcagtacacaccggagcagtacgccgacgtgctcatcaaccagtacgcgcagcagctcagggtcaggatcgattacactcgagcctgcaactagttactgtgttgacgatatatgcgacatgacactggaactcaaatcttgtctgcgtcactgtgttggatcagacgctgtacaactacggggccaggaaggtggcggtattcggggtagggcaggtggggtgcagcccgaacgagctggcgcagaacagccgaaacggcgtcacctgcatcgagcggatcaacagcgcagtccggatgttcaaccggagggtggtcgtcctcgtcaaccagttcaaccgcttgttgcccggcgcgctgttcacctacatcaactgctacggcatcttcgagagcatcatgcgcacgccggtggagcacggtacgtactccaaggcaagccccaaaacgagatgtgcctagaactgctacgttatcttgacgggtgggccggtgtgctggctcacgtaccgatggtttcagggctggcggtgacgaacagggggtgctgcggggtggggaggaacaacgggcaggtgacgtgcctcccgtaccaggcgccgtgcgccaaccgggacgagtacctcttctgggacgcgttccacccgacggaggctgccaatatcttcgtcggccggagggcctacagcgcggcgatgcggtccgacgtttacccggtggacctgagcacgctcgctcagctctagctaaggtgcctgcgggctacgccgtgccgcatcaagaattgtccaagatcaggatcaagacttctctctcgtgattgtgcgggaattaatacgcgggaggacgccggaggtctcatatgttttgcttctatggtgtagaacttacagaatatgtgtgggcatcttatacttgtatggagtatatcagtatatgctagttgcagacgttttacagtgcaactgtaactgttgctacaatgttactgaaagagaaacagaagaaaacaaaaacaacagtctgtatattccagtttgtattgctttcaatgctgtctgatgtacaaccgcattgtgatcgacagtgaagcaacaagttgcaaaactatttccagtgaaacacaaatctatggtatataatgagttgattttctatcaatcatgcatacaatcctccacacgaaatcaacaacaggcccaactgactgttaaaaataggatctcgatgaacgtgatgaacgagtggtgctgccctcatttcgatctttcttccacatgccctcaaagctcaggaagcatttgagaggtttcacctgttcaagacaagggcacagccaaagtaaatcaatctgttacttgaacaatttctctattactatgacagaatgttcagaagaccattgcaatacagcaggaaagacattagccgctaccttccaacggtttctctgagatatttcattctggatataagacaattgttcaatgatcgttctaaagtcaggcctgctagcaggattttcactccagcattgttcaatcagcctatcatagtgtggagcagaaaagtggtcagttcagggtgaaatagtggcacataaaagttcaaagttccagataggcaaatggaacacagattgcggaagcttgtacgcaagaagattgcaatggaaaatatgtcataatagtgctccaaacaatttagtagttaccacaggcaaaacaaaagaaggaatgcttactctctcaatccgtaagcataatgctttggaggagctctgaaaggtggcctttctttagaattatgtgccttctcaatttcattatttttcttgtcataaaaagggagacatccttcaatcatctgaaaatgtttggaatatcagtacaaaaactggtcttctagggggctctgggagtaggttcagcagttttactttacagttcatagtggcacaggaatacagaatgttgcatagcaacacttttacctcttgaagtatcaaagcaaatgagaagacatccactttagtatcatattcttcatttcgcaggacttctggagctacatacctacctgcaacatatttgtcatgccaattatcagtgcagaaagaaggtaaacaaatgtaagtgatgatattttggaacagtaagatggatactaatatatagctcaaattcagtatgaattttcttacatgcattgcctggagaagttacagctttctcttctctaacttttcttctccattttagcatcttacacagatcgaaatctgccaccttcagatgtccagtgtcatccctcaatatgtttctgttgtcttacacaatggatagaagaagcctttacaaatcatgtattcaaagcatctggtctagaaataaaataaaagtagtactcacgaaggctcaaggtcacggtggatgatagcttgaggtttatgctcatgtaaataattcatccctctattagatttcagagagaactgcaaatcagtcttcattatagcaacaaaaaagtagaaccaagagattcaggtcatgataggcaaaccttgcaatatcaagagctaatttcactgcatatgacggttccagagcccctttcctactcaagtgcttgcgcaaatcaccctgagaacaaaaattccaaagttctcatcaattcactaaaaaaaggtgttttcatactcaagtgcatgcatagtcatgaaccatttgacattaacagaatactaataggaagttaacaaagctagtgatctgtctttgtagtggggctcaccttctaaaaaagctagaaacagaaagtagttagggaaaagtccatctagtctatgaacatattttggtggaccaaaacagcaaagttaagctcggtacacatatatccagcttgcactgatctattgtgcttgtgaccaaatattagcagctagaaggaaagagtgaaggctaaattggcattaccagttggccaaatatttccaacaaaagaaaagcaacagctaagacaaggaaaaacagatctggcattgccacttgagaatggcaacaacattttatcactcagaactatgaatgaccaggtaactagaaaagttcatctaaagcagcagctcctattgcagtttatcaaataggtctcagatctaaagatgatcagatatgtgaataatgcaaatttaaaaaagcgctgcctataggacaaaccttgggcataaattccattacaatcatcattgggctgctttgtgttacagcacctaaaaattgcacgacattcggatgccgtattagttgtagcacatcaagctcatctctgaatgcttgtctgcaatgcaaaccaatctaatctgtcagggaactacatttttcagacggagtctacaattaagtgaaaaaagacgagtaaaacagtaactgaatactactcaatggaaccaacccacactttgttctcgtccataattagatcgtcatcaagcttcttaacagcaaccagaatgcccctccatgttgctttcctaaatgtaccctgagaaacagatgaaaatgatataaaacataattgacgaaaattgatggagcaacctaacatatttaaaattatgtacagaaagtaggggtcagcaagtcaacaaattagaaacattgtgactggcagattgtgtctctaactgaaaatttcaaataagaaagaaaggctaacatattcatatatacacacctttgatataccatttccattagtgaaatctagctcgttcggggaaatctcgtactcaggaacctcacggacatttttaacatgcataggagcaatcttcaaaaaaaaaaaaaaaggaaataaattcagaaaacttgaacatagcagtacatcaggaagacaaaatgcccgtacataatagttcggaagtaccttaagcttggagccatgcttttccaagatcttgatcacatcatggttctggtaatgcaatgcgtctgccaaaggctgccagatggtagacaaatgatacaacactcgcatattaaaatagcaacctagaaataaacatatatattagaagtattatctcgaatccatctccctcggtgactaagaccatgttcgcgtcaatcaatcattgtacttactgactaaaacttgcatctaataccattccatgggagttcccaattcaactcagattatccccgagtaatcatgaggtttttcagctagagcaataaaatcaccaatagcagcaaaacaaaacaaagttcagggaggctcaccgtgctgccccactggtcctcggcgacggcatccgccccacgctggaggagcagctcgacgacctcggcttgcccctcgcaggcggcgatgtgcatcgccgtgcggccgtcggagtcgcggaagttggggtcggcgccggcgtcgaggagctcctggatcccctcgacgtcgccctcgtgggccatgtacatcagctggaagcccatgaccccgaccgcctcgctcgacccctcctccgagctctcccccgcaccgccgcggtcgggcgccatcgacgactgcttccccagcttaaaccgcggggtcgccgcggccgtcggcgtgcttggcttcggctccatgtggcggcgcgggcgcgggcacgggaggcggctagggttccgatggggaggacgagacgagacgagagatcggatcaatcgaagactttgacggcggaattgagtagagcggcgagaagggggaggggagaagtactagcaggcagccgcgcgaggggaggaggaaccgagttgggaaaaaaacgggtgggtgggtggctgagctggcaacacctccaccaacagaccccacgtatgaaaccgaaaaggaaagaacggccgcaggatccccggatgtgcgggtgacagctgggccccgctgcttaatgcggtagttttgcggttagtgctgtttgctggttaaagcattctcttcgaaagacaggagagaaacagttttgtgttccaattatggtgtttggtcatttggagtacagggactttacgggattattattgtacgaattagcttaaatccttaaaaaaaagttaaaagccttacacgctttggatgtagactaagattattaaggttggacatgtaaaaccataattctattagtgcactttttccgtactcgtaaaggaagttgtttaggataatgtttaagttaaaccttaggaatacaaatcatgaataactctcaagttgttgaatttgaaaatgtaaaaaatatatgaatagatttgtcttgaaaaatactttcataaaaatatacatatatcacttttcaataaatatttttatagaaacaacaagttaaacttgtgttttggagaccgtgtcgctgtctaaaatgacctcctctatgagtacgaaggaagtataactaattaagttttaattatttaaaataaaaaatgtactattttaaaacaatttttatataaaaagttttcgtattaaatacaatatctaacagttcaaaaaaaatatgctaataacaatcgaggtaaaatgtattaatcaaaaaagaaccaggcatatgaccacccaaacccaaatggcgaacacccaggaatgctaacactgatggaattgatcaactaataaatgttatacttccttcgtttcaggttttgattttagtcaaagtcaaattactctaagtttaactaattttgtagaaaaaaatagtaatatttttaatccaatactagtatattatgaaaatttatttaattatatatttaatgaaaaaatgatagtgttataaatattactttttttatagagttagttaaatttatagtttgattttgaccaaatatcttatataactaaaacagaggaagtaaatgtttagatcgagacatgtcggctgcttaatactaagaaaaaggcatgttgttcgcaggagacatcagatgtccggtccaaatctcggggtggttagcgagggaaacactgctagccagtagtagcaatatcatcatgtctttatgacgtatatactaattactaataagataagagctttaggtagtatgaaacgagcattatatatgttgtaagatagttgatggctggagatgcacgttgcggataaggactcgcatgatgtaatggggccttggtgttgtcatcgtgacgccggaacagaccaattggggataaaaagaatcgtaaagcgtgtaggtatggacgaacactatgctgtctagaagcaaagacgccttgatctcctaaagaaattgttgtcgtaaaaatctgaaagtgacattttgcttcttgttcattcggcgggagatatataaataaaagaagacgtagtacaggtctctggtccttgatggttgctaggagacgagctgacgaggaagtattatccactaagatcagggagatatataaataacgaagtattatccactaaaaacattgaacttctctagctgcgtacaatccagcctaagatctgacgagtgaggattaagcgtataatatgagtggtacttatctcaatgttcttttacaagctgggactaactcagcaaaggaaactaaatttttctttagtatttgacgtttgccactttttcaggaggagatgcccctgatatttgtctactttattcgaaagtaggatcgcatattcagataagcatcctctccgatgctgaaaggccgtcgatgaccgagtcatttcgttttctcttcgttttcctcgctgttttattgccttctttccgattatacaaggcaccagcgcattttcaacgtagctgaaagcgcgtacccgaccggccgagccgaccagctgcttgtgcagttcagctgcgtgactgtttccgttgcccagacgggcataagacgacggccaaaatggatttcgtccgcgtctcctcctcacacacgtaaatgatcgatgccgacgcgttttagtacggggaaagaaagcagtcagcttgggccactgtatgtcttcgatttgagttggctgttgttctgactgttcattgggccaacccggggccaccagctacagataaacaaaaatgaaaaaacaaactcagatcactttattctattcgccccgttttctttgtccttattctcactctagaatatttgattgtattagatctatttattttatgtaggagcggattctgatccctcgagaggacacctccttattttgtacatcaaatttattaaaaaagtgaaaaataattggtatagtagatcaacatgtaatatgtttttccataaacatacaagttcaaatttgatttataaaattaaaaaaaaaacgaatttgactacggattacacgttctatccaaagttaaaatttgttattttttctatttatataagttaaatttgaaagcgatatatcacatattgatctactccctccgttttttaatagatgacgctgttga

SEQ ID NO: 81252 - DNA, 3882 bp, Oryza sativa
acagcatcatctattaaaaaatagaggtagtatcttactatttttttaaaaaaaatgatgatttttttagtgacaagaaaaacaaaaggacattccctggagggatgaatagagtttttattgtatctcttcttactatatagttggtacccactaagtcataattgctataaagcttgcacacagcttgccacatcatcgacgcatattagctgtcagatatccagtttgctgttggcaaaaaaaaaaagggaacaaacctctcccttgacgtctctgcccagtgggctgttggtccaagcaacagaagaaaattttttcgttcccaatggacgaaagtggcccacttgataaacacgtactccacattattttgtcggaaagaaaaacacgcaaccaatgagtaaaaaaaggaaacatgcgaagattgatcaacaatgtttctcagtaagaattctcaaatctcgctgcaacgcgcggggcatccactagtatttgtaatttgcactccacgtccaggtgtgtgcacgcctgtgcatcccctttagtaaaaaaagaaaaaagtttatcacattgcagaactacactatgcatgcggcatgccaacgaagaataatgaattagaagacaacatcaataacaatacttacagtttcaggagatgagcgtcctcgctgatgtttcctaccaaaaggaaattcatagaagaataaagaggtcgggtgtcaacctagccggttgcatcctcacaacacgagatgtgtaaagcccgattattgatgttccagcataaaacttgtaccgcacaacgctacaggtgctatttccgagaaaaataagtcgaagaatccatagcatgcatgctattagcagaatggtgaatatattattccttcgaaacacagcatgcatataaataacatgccagtacgccaccatcatcctttgttgtcatcttcactagtgaaaaatttagaaatgatatggtacgaagttaaacaagtagtctttgtagtacttaaggcagtttatgaaacaaactattgcaaactaatactcttttatttagttcatgatataacaaagcatgtaaagtgtgcagtgaacaaatttcctgttggatatgtataactggcaacaattgatattttctagtccctatgaattcatacactaatacaatagatatttgcgtatattatttttcatctattgacatcgtcaagaaacatgtgtctcgtcaaactagaatcagaagatgaatgatgtccattcaataataaggatgacaaaaaaagaggagggaaagtgaatgtttaaattgttctcaggttttagctcttaccttttggagaacattgttatcttcactaggagatgcttcccctttcaactttggtatcagccaaggagtcgatgttctttttgagtatcgtttaaccgtatcagatattgggcacaatcacacaattgcaaccacactgaagaggtcccaaaagatggaatcgtaaaagaatgaatggcaggacaactataaaatcttatcttcgattccatcggcttatgaatctgatgagatcaaaagttgacatacagtggttaaacatattggcaacattctcatgtaaacataagttttgtttctaaaggttacatttagtgcttgaaacatactccctccatccctgtccagatacatagctagaagttggttttttataggacagggggtgtgctgctgatctattggttactatctaccctcaattgtaaaatcatgcgagcgcttaactgacatatgtattcaactctacgccatgcactgtaacaaaatatggacactcatcatctctgatttgttggatgttgccacttcctactgtaaggtatatatgcacatatcctccatgtgaagaaagagctattagattctactttctctaacatcaggtagaacaaggaatccttatcgtaaaaagaatgaaagtaaaaaaaaagaacgaaagtaacagtcaaatttggattgcatggctagaatttcatgtgctaggaagaatatgtatgattgtaccagaaacttgtgtacatggcctaaaagataagctgccacatactacctccgtcccgaaataagttaatctagtacgggatgtgcatgtccagatttgtagtactagaaaatgccatatcccatactagattaacttattttgggacggatgtagtatgcttatgactcgtaagctgtttttggcatggccaaattaagattaaataaacatcaacttgggaacaaccactactggaagtttgaaataaatccatgacctcgccctgtggatatgtatcgaagaattgtggaactaatattaatatacaatcagttttctttttcttttaaagaaggttctctacaggatccaactagctacccaccaaaatatacacactagtattcaagattagtcatcaagcctcaagtaaaaaaaaaaggtaccaagcttagttgaagaaaaaagtcccctcgtactgagaatactttagtaccaactatattagctttagaaactacttctgaaacgttcttaataacatgtcccgtttctctttctcaaaaactagatttttgggcaaccttagttgaagtttttctgaatttgtaggttcaccaatgaaaacatagatgaaatttaatcttagacaagcattttttattagaataaagggttaattggtccatactattgcaaatatgcctgattggaaatctactattactattcatgataccgactgagtgccgttccgtctagttttttatcggcacccatccaagtcacccttctccatagatacttatcatttaagcgtctaaaatctgaatactataacatgcacttcagtttcatatatagcatatgaaaaaaagaataacaaatgtcatgcttaacacaatgcgatgataaaagtatgtcatgtaaacataaatctaaataaaaggtacaaactacataaccacaacctacattattctcaaatacagaaagattatacatccaaagataggagccaagtaattagaaaattgcatttgatttctaggtttcctccataaaaccaaaacaatactagcagtaggaagcctttgtggggaaggaattttaagaaaacaaaagctctcgaaaaaaaaagctagcacaactcaaacaagatcccctacatgggagtatggcatgatattagcatccaactttggaaaaagtgattatgacaaccatcgttccctctttataagaagttgaatgcctagactcaatttttccaagtccacattgaacaaagtaataacatgttccagttccacaagagatgtctggtgtgccaactgtggagcccttggttttggctcatgtcatacatgacgtgttagatccatttagaccaactatgccccttagaataacatacaacgataggttacttctggcaggtgctgagctgaaaccatctgcaactgtgcataaaccaagagtagatattggtggcaccgacctgagggtgttctacacattggtaaagcaaagacctatatgcttccatgttggaacatgttctaaatgttgataatgcaactccattacacaagaaaaaataatatactaaacttgtttcttctacttttacatatgcaaaaggtactggtggatccagatgctccaagcccaagcaacccatcactaggggagtatttgcactagtaagccatttataaatttgtcttttccagtctcagtgggatacatagacaccccgaggtcatggttgtggacatcttctgggtgggacagagttcctgtgatgcaacgtcccacctgacgtggt

SEQ ID NO: 81253 - DNA, 6195 bp, Oryza sativa
tacagtacctcatcaatacttattaggtatcagacgatttctactacgtagggggtgatacatacaaggtatcagagggtacctaccaaatatcaggtgattcttactaggtattagggaccgagcaccgagacgtcatctccggtggccccaccctccacgtctcatgctggagcttgtcgccggcggccgtgtactccgtcgtccacgccccacgctagaggtcttcgtcggtggacgcgtcctccaacgtccatgcctcatgtcgaagctcgtcgctagcggccacgtctttcacattgaacaagtcctccactgtccacgcgccacaacaaagctcgtcgccggtggctatcgtgagcaggtcctccattgtccatgccacgccggagcttgtcgccgacggcttcgtcatcctcgctccacgtttatccactccggcgagagttccatcccggccatcgtagtagcccacgctcaccggctccaactccatgttcgaccactccggcaacagctccatccctgccgcagcccacgtccgtcggctccgacttggcatccgatcactcaggcgacaactccatctcggccgccgctgcagcacacgtccaccggctccccgtcaacatctccatcccaagcgctgccatggccgcgtgcagcctccgaattagtcgcctcgctcagatgtggtggagctgattgcatcccattccaagagatagaaatgagatgccgttgtatagtatttccgtaagcataagcatgagcgaaaagatgggacgattaggtggaatgcaagtcagcccacttaacactccaatactacagaaaacatttgtagcgcttaactgctcgtacacttaagttacattgatgagattttcttattatagtatcctttggtgtcttcacactaagataggatagcttatcattttgtttgtacttattataagcaaaacagtttgttgacgattcaaatatagtttatgagtaaacttttatatacgtgttatggcgatttataaataaatattcaaagaaaatgtcgacgggctatacctgtaaacgctatttgtagagtatggagatcgttagaactagggtatatgcgagatcggatctaaggaacaatggacaaggatttatattggttcgagccttcaagttaagtaataactctactcctatttgtatgtatgtatgtatatatggatagtaataccacacagattacaatagggaataggacgactaaactaatatgccaactagaacttgttgagaacggctcgacaaaatctatctggtgaatatagcggattgcttctatatgtggctttggctatgagttgtaactcgatgtccctttctggacgggtgaggtcatttatatgtaatagagatcacgttcttctccaaataagactcggagaaatgaaacatgacatgggcttaaggagaccttatcactcccaagtaggactctgacaccatctattacgagaagataattttcttttttttatctaccatatttccttaattaaaagatacattcttgtatactatcgggtatatggtattgctgtatttaacgaaccagtgtataagaagtatgccttattgttgacactaacaaaactgcaagaaaaaaaagcataaatcaaaatttaaattttaaaatctaaacttgtacttatgcttataagttgaaggctaaccgaaacaagcgaaaaacactataaactgtaataataccttaattatcataaattctgctttacattgatcattttggacatcgagtcattgatacagtctctgcacatattttattattgtattttctaactatatgtttataaaagaactattagaaatataattatataaagtgtttatcatgacaaaaactatcactatcgttttcttatatgaattctaaatatatatataagacgacaaaaatcgtgaaacggagcaagtaaaaacattgttaactgaacgtgagtacatttttacttgtggaaagttacaaaattccacattccaggagtgggggtacgcaagagaaaggtgaagagtaaagacaaagcttgccctggaggaaggggaacaccacgaggagtcgaggccacaatgccacatggatacatgattcccttggatctgagcacaccgcccccaagtcaggtaaaagggacagagagcccacatgctgagctacccagcttctactcagccaacaaacaaccagaaaaatggtccttgtccctactccttaagatctccctcaagaccaactccatgacaaagcaaatggcataaaagaaaacgaatagcactgaaagtaatgtcgcccattgcttcctgctagtactgtaccaaacaattactccctccgtcaaaaaaaaaagacaaaccttgatttccgtgtctaacgtttgactgttcatcttatttaaaaaaattataaaaaaaataaaaaaataagttacgcataaagtattaatcatgttttattatctaacaacaacggaaatactaattataaaaaaaatttcatataagacggacagtcaaacgttggcacgggaacccacggtttgcctttttttgggacggagggagtagctattgaattattatagggtgtatttagttcacgccaaaattgaaaatttagttgaaattggaacgatgcgatggaaaagttgaaagtttatgtgtgtagagaagttttgatgtgatggaaaagttgaaagtttgaagaaaaaatttggaactaaactcggccataaccaggtgacaaatgagtcatacacctaggccctgtttagttcacaccaaacttcccccaaacttccaactttccatcacatcacatcacattcaaaatattcctacacacaactctcaacttgttttccaaactactaactttccccaaacttttttccaatttcaaaaactaaacgcagttgtactgtctctcgtgctatctctctctccccaaactactccattaatcatggcgtggatgcaggcacacagcataaaaagttggctaaacagggaccatttctgctcgccaacatgcgagctttgacattaactccaggctcgggccatgagagggatatgtcctcgtttttattttaaggtttggtattgtgattcatggaatcatggtggttatagtaccattctggggctaggccgctagggcagtgaattgaattcactgaattaacttccatgtctgcattctggattgcttggacacgtttggctgcatcgcgttggaaagtacatatttgatctcatctctggaagagccagaaattatatattctgtcatgtgcacttgtgcagcatgcactactccgtacacactttacacagtgcacaagctaacaaactcctcgttgattgagaccaagaagctgtagaaaataccgttggggcgttgggcgattaaaactatgtcagagctcgggatattatagggggtagcagtcgagtcacgtttactcgactcgtaactaaattcttctgtactactttgtgactgtatatgatatattgtgatgactgtatatgatatattgtgatgtagtactacgaatctaacatatgtatgttcatatttatattattagaatacgttatatttaatactatattagttttttttatgaaagagagcactctttttcagcctccttgcattggcaaatggccgacaaatttctagaagtgactgttgaaaggacgctgcaggtcttttgtgatttatgggtttaaggctggatttacttttgccaaagtgaaaatccaagtaggaaagtggtttgtgcctgaaggttcctttcttcggatccactctttgcagagttaaccacttcacctagtactccaactgtccacttggtcgtcgattctgttaccgtcgagtttcctttctgcatgtaaaatatcagaaatatcgtggcggtggaaccatgcatctacctgttgacctagtagtaaaaacggccataaccagggttagtacctatgtgtcaagtcttcagagcgagtacaatagcaaactatataagtcaactgtaagcacatgtggagaagagaagagagaaaaggaaagcggattacagatttataaccagctgcagcacgaactccaatacgttatgtgtgtatgagatgtgggaccatatattaatagtctattatataaatgagctattagattgattatagatgaattggagctaatagttggctatactcgtaacgcaaaaagatcctgagctacaacgaaccagttagggtgtgtttagttggagaaaaggaaatttttgggtgtcacatcagacgtttgaccggatgtcgaaagaggatttcggacacgaatgaaaaaactaatttcagaactcacctggaaaccgcgagacgaatcttttgagactaattaagccgtcattagcacatgtgggttactgtagcacttatggctaatcacggactaattaggcttaaaagattcgtctcgcgatttcccctataactgtgcaattagtttttctttttatctatatttaatgctttatatatatatccaaagatatgatgtgatgtttttgggaaaaaattttgggaactaaacgggcccttactgaaccgtaacttgccacttggtagggttaggccatgagcccatgacgagaggtaataaaggcttaaagctgcagaatctaggttggttggagtagtaaaaaagattcaaccgaggccaacgagatttcaactcccgcgtgataatcgaaaatgctattggtaccaacttgagataacctatactagtgtggtactgtggtggagtgatgttgtacagtacggagcgaatagacacggtggtgtggcatcgccggactatgaccagcgtgtcgtgaaccgcgagcgggatcccacatggacaacaaaggtcggatggggctaaaattttttactccctgtcacatcggatatatagatactaatttaaagtattaaatataaactaataaaaactaatttcataaattagctaatccactagacgaattttttaagtataattaattcataattagtaaatgtttactgtagcattacataggctaatcatagattagttaggctcggattaattaggctcaataaattcgtctcgcgaattagttcaaggtcatggaatgagttttataattaatctatgtttaatactatcaaatagcgtctaaacttccgatataatatgtactaaaatttagtctctgcaaagcaaacagggatcgatttcattggtagagtacgaagagattgagtagcgtgactccatggaggaaattgttagggaaagttcagttccgatcctaaagtcacgttccagcggtatcatctcggtacttacctactacaaacagaggtcgtgtcggtagaagccacacgcttagattaaggtctagtgtcagatccggacttggcgaagcaaaccccagacccacaatcccaggagtggcaagcggaacatgcatacaaccacccctttgtccaacaccaacgccaccgacaatttccgtcttgacttgaggctttgcgactcgacgagtgattggtggatcggtggcgtaatcgcggcttagactgcggatcagcggatgacagtctctccctaccccacaggccactcgcccactcgccgacacgcgctcgtgatgttgctatgctgcgtagtgtccgcgaactccgtgggcctccggctctctccgagtcgtcgggtgaaacgggccgccggcacgcgccacgcggccttcttctactacatggacgcgactgtttcggcgtgggaaagaaaaagtgtcgcggcgagccgccgaggcatcgcggctgcgctccgcagtcgcaagcggccaagcgcaacgacggcgacacggcgtggcgcgcggagcggtgcgggcagcggcggccccgtgcggcaggcagcaaatgcgacgcgagagatcgcacgattcccttcccggggaaaatatgtagtgcaaaccacgtatgtaatggaaacttggaaactaccattggatcgagaaatggacgtccgaaattcgtccacgtcaccataaattaaaatacaactcatagtgatgt

SEQ ID NO: 81254 - DNA, 2438 bp, Oryza sativa
actatgttgcactcatattgggatggagggagtacatgaagttgtggagatcgtaagctatcatgagcaagaaaaacagatcctagatcaacaacaacatcaagtggagaaaggtacttcggttccaggtgtcgcttttttcagcctctcgcatcacccctgcacaggcgatgcggggggggcatcccgaacccaccaccaccaaactctctccttctccgcctcgccaccgccaaagtgaatcgtcggaaaccgcacgacgagcaaggatggcagcggcgggggctcgggctgcctcctagctctagcatggggagcagatggtgcaaggtggggatggagatggcgcggcagtgacgggacgagcgcaatggtggcacaacagcttcccagctgagctcgactatcggagtgggctgagtcaacgaccggagcggaggtggtgcaagggggacgtgtcaaaaaaacacgaggcgagacggttgaagcctagatgcggctaggtccacctcccctgcgaccaaatccaactcccccacgatcggatccggcgccatggcggtgaatttacctaggtggagcaggggagcaggcatggaaagggcgcgatggcacatagaagcattccaggcatcgtccccatgaaggcgaggcctgatacggcacccgggtggcatttccgcaggggagcgggcatggagagtgcatggtggcacgtggaggcggagccaaaatctggtgccctgacggcgcttctgtctgggtggagcaggggagcggcgcggcaagggtgtggcgacaccacaacctagcgccgcccctgtggaggcggaatgaggaggatgttgaggtaggatgcaaggtggcagatgtacatccgtggatgtgttgttgctggagaggcaacgcggaatgttgttgtgacctcaaccgataccgtccagatgctcggggatggacatttacccctaagatggaggcttgcaacgacgtcagcgcgatggtgtggcactgacgcatggaggcaggcggaggctggtcgactactagtatcggtgtagtggtgtccacgcatttacgatgggtggttggtggtggagctttagagtggcaattgcagaatgggagtgaaaggtagacaaaaatctaggccagtttgacgggccaacaacggcggcgccttcgggcatcgttcttccttgttgaagcttgtctctccttccctggtagggctgttggtgaaaaccttatctagtctccttgagaaaaaccttgtctagtctccttgagacctggacaaatggcggcaacgctctttgtcgcgcttcctcctggagacgtcatgtaggaggctccattattgccaatccgttgttagacagtctgtttgaagctcttggatgacgacaggtccgtacgagagagagggatctttcttctctctcgccctctccatttactaccttttgccctagtgacgttgttgaggctaggtgttcagctatctggagtcgactctgggcactacagttgtagctcttttgttggtttagagacgaccggtcatgcttagcagcggttggtctaatgctggtcccttcctcggttgtgtgtttaggtgccatcggtgcatggtggtggcgtgtttgtttttctttttattgactttagcctttcagggttttagtattgtattttttttcctcctctcctcagtgaaaaattgcgctattgtgttattcgtttaagaaaaaaatagctcctagcatgttgatcgattcaagagcagtaataataagttagtcggccaaaagtccaaagagtgaaagccaggtcgtagtttatttcatttttgtgagtccaatgtgcaatttgtctgtaaactcgatcgataagaactagagcctagagttggctacagaaaactgatctactagctgatagagacactactagaaaaaaaaaacatttatacaggtggccatatcctccacttgcatctaaacgcttgcgaaaatcaatgatttttgcaggcagctaaatccacctgcctgcgaaaatatttttcagtgcaaaaaaaattggcagccccccacccctatcctccgcgcgctatcacgagctgtgccaccacgagctcatgcgtcggcccgctactgccgccgacctcctgcctccacaccgccgccgctgctacatgcaagtcgccgccgccggccctccccatgacgtagctggatccaggaggagaggggaggggagggaagtcgccgtccgaatctgggagtgggagcgccgccaccgcctacgatgacctcctgcctccacgccgcctcagccactgcatgcggtcgctgccggcccaccttccccacgacgcagccggatccgcgaggggagaggagcgccgccgaccttccgcctccgccgctacatgc

SEQ ID NO: 81255 - DNA, 2881 bp, Oryza sativa
ttatatttcacgccaattttcgtaggcggacgcataaaagatctgcctgcgaaaataaattttcataggcggacggtgagattcatcccggtttacatttttgtagacggtcatttggctccgagggtcatacctttctgaaaacataaaaggtcaacgttgctaaaaaatcgtttttctaatagtgagatggaccaattaaaagttcaatcttcggaaagaaaaaaaaaacaacgaagaaaagtgctcctaaaatataagttctttctccctaccaaatcaatttgacattattatggtactagtagttctcctaccactatatgtatgttccttcccttccgtagtaaatattaaatcagcactggaatcatcctcgtttctatcagctttgcctcatcgaaaggaacttatgatttgtttatcgaaaaagtgagtaggcatgtagtatcaatctacacctgcaaacacacaatttcttccttggccgagtagatcagagcggtggttaggcgacaaacctcgtcgcatcattgtcctactcactccggattgtttatgaattggttttcatcactttatctgcatctggtggcgatacatcggacgagctaatccgaaggagcagggaaagggctccccgtgtgttggcgttgctatccgaaggtagaggtgacatcgtcgtcgaccctactactcgcgtcccattggcctggccgttgctgctctgtgtatggaaaactatatctttcttccattatcatttattatttgtcggcagaaccaactagggttcttgattcctccttccattttctaccgcaaaaacaaatttcacgtgagacagtacaaaattcctcttaaatccttgtatattctcgtaggaacgtaactctatgctagcggcggtgatgaatcatttgccggtacattgtacacgctacggcaggcattgtttttttttttctgttaaggaacttatcctagtcgatctcctacgtgccacggcatctactggtcatgtcattggcaatcattgtttagttgctgattagaattgcaatcatatgttcctgacaagttgtactgttgtacaagaatctgtgatggaaaccatgtgtgcatcgtctacgcgtgccgtctcgcccatagcgaatcccaaaccgatcgttttttttttcaggaagattgtaaaccgatctctcacatgtttgtaattataatcgcattcaatatgttgtgtactccgtacttgtgtatagctcgtattatagaccgggagatctctggtttaatcagtgccagcgaagtcatgacaagtaagaaaaaaagaggggggagagtcacataccgagtacgactcgccaattatcagttcatagttttatatgaaattaagaaaacaaagaaacgttacaattggcatcctaaacagaatacaacttgatagtattaatttaaaatttattaaattatatgcaatatctataaatgagactccaaattgatttttgttaattttggatttcagactaattaaaacatgaaaaatgtcgacgtttgaggtcacgactacggtatttccatggtatggagatcgtcagtaccagggtatatacgagattgaagtaaaacagatggagacaagaatttttacacaggttcgggccccttatctggcaggtaatagccctactcctgttgaccaaagccagtgttgctcttattcatctgaatcacacaagtacagtgtttgggataacctatctagctgtcatcgacttggcggtatagataaccaacacgtagtcgataacagggtagtcttcctcctcgagtgcgaacttatcgagatcagagatggtgctagatccctcttgccggcctccgcatgcatcatattaggtctgtctaggcttatatctgatgtcgatgtttggcggcgtgtgttggtgtctattctgacttgtgtgttgatttatcctcctagggggctggtatttatacccatagatgtcaccttgtccaagtagaactagggagaccgatatggatacaatcctaatagtatttgtcgtttctatatagaactctacttgtccttccttattcagaacttcttctatatacgaggtatgattttgtataagacttggtatatggtgggtctctccgagcttaatcgattactattgggtatgtggcacccataaccatgataaaaaaaatcatcaataaaactcaaaacctagtacaactcaatatattactccctccgtttcacaatataagtcattctagcattttccacattcatattaatgaatatatatattcattaacatcaatatgaatatggggaatactataataacttacattgtgaaacggaggaagtagttatgaattcttgaattattaaatcctgaaatgcgctaaggattacgtaatttggatggaagcaaagtagatcgatttgcacataaagataagatcacaaatattttttaaaaaaatctatcggacctaatggacacatctccaattgtcaaaaagcgtagcaaaaagaatctaataaagacaagcaagcacattccctaaaggttgaatggaacatatttggcctcatcttttcgcttatgtatatttatcaactaaaatttaaattttcaaccttaaatttgaaaccttaaatttgaagttgttttggggttttttttcatcgtagtttatttttcagcctttgattttagatcgtttagaacacatgtagtataaaatttttatttataaattattttttatttgtaaatatgccgtttggcttagtttaaaaaacaaccaaacgatggggctgattgatccttactttcttgggaga

SEQ ID NO: 81256 - DNA, 742 bp, Oryza sativa
agctccttctactactccaccactgaccactccactccacagctccactccaccttctagaacaatctcagaggctctcccactccgcatagtcttcccatagcaaccccaagaccatcgcacaagcgcaaccgagccgtgccggaaacaatggcggtgggcaacggcctgatcctgtaccacatcctcgggctggcctcctgcatcgcgctggtctacttctccctcggcgaggtggacctccgcgacgccctgccatccctcccgttctcgggcggcgcctcgcgcgcggcggcggcgtccctgcccttcgtggagcggcgcggcaagcgcctcttcctggacggccggcccttctacatcaacgggtggaactcgtactggctcatggacctcgccgtggagccgaacacccgcccccgcgtgtccagcatgttccgcaccgccgtctccatgggcctcaccgtgtgccgcacctgggccttcaacgacggctcctacaacgccctccagctctcccccggccacttcgacgagcgcgtcttcaaggtaaccaaaaccaaacccatccattcccaaattccccagcagtaagaacgcgagatgcccactggtgcggatgctgatgcgcgcgcgcgtgcaggcgctggaccgggtggtggcggaggcgtcggagcacggcgtgcggctgatcctgagcctggcgaacaacctggacgcgtacggcgggaagcggcagtac

SEQ ID NO: 81257 - DNA, 11215 bp, Oryza sativa
cagcatatacaacaagtgaacctatagcaactgaaccaaggctgtaacgcaacaaccgcttcattgaagaaacaactgtaacaaatggtatgtcatgctgcataggaatagctcaaatagtcagtggaaaggagaagtaaactaactgctaaatatagggtaaattttaagtgcctcaattcacttacagatatttcaccacgtgcccaatagtatgaagcaactgatccagcaatcacggttgaagagcaagcaataaagaattgggttgcccagtaacagccaaataagtggaaaagaatggcaataccaatatgaggggtgtaatggatgctgtacccacagcagttgtcacagtttactttgcccaacttcagatcatatgagcaacaatctgtattgcagtcatttcggagaacttgaccagagctgaagagatggagtgtggcagaaaaccagaacatataaaagatagcgaggataaagtatggcacaactgggaaaataattagtgcctgaacttcaccaatgaccttcgcagcaacctgaagataataatttatcaggttagtgcttaggaactattaactatattcttgccttcaaagaggaggaatggcattgatgctgagtgtcttcaaaaccaagcttctgcttatacagtgtataatagttagctaatcaagcttgtacatccaatgattcacgtaccttcaggacaggtgttgctatcagtatacgacggataatagctatggaggtcagaaatgcaataatcattactactgtcatcaccactgtagcagcatgaaggtggcttatttcctagtaaaagaatgaacaatcaggcacaccaattgggaaaaaaggggccccggtattgaaaaagtcaaaattggtatactcaccccccagttatgtggacatatggatcactttcgccaattacaactgttaagggatcattgcctaaccagccagctgaattaaaatgtagccaattaggatcgtatgtgtgtaacatgttaaatggcatacaatggaatttcccttgctatattttggaattatgacatgcaaaattgaaccatacctttaatataaaaaaacatggtaacagagattactagagcattgaagaccactacagttatccatggcatggcagcaacaaaataacgaatcagaagcaaccagataactgacaagaaaagagggagcagtccaccgcaaacaattaacacaggccatgacttcccaatgtcagcaacgtatctctgcagacaaaggaaatggtaattaatatcttcaaagacaaaatgggactccagtgctatatgaatgatattgcatcaggaatttctcagaataattcaaaatgcatatccattttagttgcaagaaagtatatgcttctttcagagcaacggtgcaacaaaattcttttgtaaggataaaaagtattgctgtggtgtaatgtacggtcagtgttagctataggaatagctgggccacttttcacttccaacgtaaatcagaaatgtttgcgacaacaaaaaaggaatgtgcaggtaataaaacagtgccaggaagtttacaaaccttcaagactgaagatttagaattgatggccttgtgtattgttttatctatgagaatattttcgtcgatgttgataccacccatctgctgccaatgcttcaaagagacattggatgctcgcgcaataaattggcagctccagtagactgaagggaacaaagattttggatcagctatctcatcattttaacttattgcatgaagaagtaaagcccttaatttaatccatgctcacatggaagtagtacagactgagcaaagattaccattcacacttggaaatatgacagggtagcatggaccctgcagctgaagagaactatttctcatatctggtgcgagaaactcaaaataatcatagtccctgttgatccaatcatcgatagagaggcgaatgtccccttctggataatcacaaacaaagtttaatccgtctgctgctggaatggggcactccatcaggcagatggctttggcatcagcaaggttaatcttgttgtccttgaccccactttggtacacctggtttgggttcatccaatatctaacatcaagctcatgcaaatccgggtcaccatgcctactgcacaaatgttccctttgtagtctagttcataggtaagcctgcgtcatcaaaacaagataagacatcagtattactaaatagtagtttggttactcatcatagcgtctgaataatagtaaaatgatagccatgtaaaagtcgcacagcactgagttttatccctaaacaaatttcctttggtcagcactcagtagtgagttttggtttctataatatataaccgtaatgtgaatttcttttagggagcacaaatcttgcatagctgcactgaaagtttttttttttttgagagagagagagggaatacaattccaaggagcacacagtctcactccggtgctttctacttggagtagaaagtaatctggatcgttgatctcatttaatccaaggtttcaagattatttttactaccacctctcttaacggtagtagaatcgtggagggtattattgtctatgaaaaaatatttgcggaggggtacaatcgtcttttacattcactaaccctagtagggctctctcctccgtcgttcgttcctcacgccgccgcacgaagagaagtcccaaatcgcatccggcgccgacgccgagcgaccccgcctcgtggctcctcccttcccccgccatcaccgcctcagccgaccttgcctgctccaacgtctcgcctcgtccgccgccctcacctctttcgccgcgtgtgccgcctcaaccgccctcgacgattcctccgccctcaccggcttacggcctccgcctccctcgcctattctgccgccctcacctcctccgacgcctcagcctaccgatagcgcgggcttggcgacgtggtgagtatacccctacatctctcggtagtcggtactgaaatcccaagctattactatttgctagtgagaaggtttgatatgaatctctcgattccacttttatctgttgacacactgtatcatgctactcggtcagcctgcgcaacgacaagcactgcagcatcgagaactccatgaagaacaactgttccatctgttatgaggtgtgttcttctaccagaacataacagtgatgctaccttctgtacctactgttcattaaaaatccagtctcttatgtatgaaactgtgatcatcgatcacaaatgcagtgctcatccatcacataagaggtaacgtcctgtccttccatttactcccatgcagatcagttactgatctttgattgctctattcgaatggtgtagttgaatgtaaaaactgaattctgtagtcgggttttgtatgactgattagatgaatgcttgttcttttacggaactatcaatttagcattggttagtaatgtactgatcagctgttttctcttcgggaaaaagaccttgaaaaacgaaaataattcgttcaggctgttagtagtaggttcagtacatatatttggataatgcatgacagaaatcttgaggctttaaaagaactacaatagtacaatgcataaaggaggaggcaacaactgtgcatgtttgtatgctaccagaaaatactagtatcctacaactcacaactgaattgtgaactagtatattgaaaaatttatagtaattccattacagctaacaaatgtgttctgttgagtaccctgatgaagtccactccctcgtgttgctggcaagcctcacagcattgttgcctcttatttggcatccatttcctgcaccgtgcatgttgtttggagttgagtttactcatgttattattgaaactagctgggtggcccgcgcaattgcgcggctagcacccaaacaaaatcgtatattttttagtataattttacttaaaatttattaaatagctatctcgttgtcttaagactttgaaagactaaactaaatagctatcatccccgtatttctaattatatagtttttaaaagtcacaccagctgctactccttacttctgtcatatccttttttatttgcttgctcgatctaccgctatttctattcattctccttgaaacctttaaaaattagatcttatagtttttagagtttattgtctcgttgggtttcgtttttataatttctagaagttccgtcaaacactgccattatacttctctacagcccgtgcactgtcttttctctttattatcattgggattttcaaaatcgaacatagctatcgttcgggttcaattttttactttctagaagtcccaccaaaccattagcggctttgccactgtactccttaatggctcacccgttgcctcccttctttattgtcattgggttttttttttactttttagaagttccgaacctttaaaaattgaaccttgtagattttagagtttattgtcttgttaggttttattttttataatttttagaagtccagtcaaacgatgccactatactcctctacgacccatctgtcgcctactctttattgtcattgggattctaaaaatcgagcataactatcgttggaattcattttttattttctagaagtcccgccaaccgtcggcggctctgcaactctactcctatgcaccccgcccgctgcttctcctttttattgacattgagattttaaaaatcgaatatgattatcaatggggtttattttttttgtcccggcaaccgccttgcctgtttgcttcacggcttgcctgtcgtccctccttttaatcgtcattaggattctatttggtgttttattaacagtttttatatgtcgtattaaccgtccaccaatgtactcctttataggcatgttacttaatttatctcttcaggtgttttagacggtcttttctttcaatagtttttattttatatcatcatttttagttatttacaaattgtattcctaattgaaatctttttttctttttataatttcagaatttatattttttttcaaatttttatttaatttatctcgtcatgtgttttagacggtcttttctttcaatagtctttctttttatcaccaattttagttatttacaaattttattcctaattgaaatcttttttatttttctaatttcagaatttattttttttcaaattttaattaatatcatatagtgtaattttaatattttttttttgaatttaagttgtttcaaaattatattcctatttgaactctcttttagtttttataatttttgatattattttatttttattctgaattttaattaatctcgtattgggtttttatatggatttttcttccaatattgcttatttttaattctgaatttcggttaattttaaattgtatttctactcttcttttctttttgctaatttcagattttatttttatttttattacgaatattaattaatctcgtgtttggttcttatatggactattctctcaatatttcttattttcaattccgaatttcagttatttttaaattgtattcctacttggactctccttttcttttctaattttggattttattttatttttattctgaattttgattaatctcgtattgggttcttatatggactattcttttaatattgcttatttttaattccgaatttcagctatttttaaattgtatttctacttggacttttcttttctttttctttgattaatgtgagaatttctagcccccacaacgaacgtggtgcctcctttcaaggctgttttaataatataatagattggatacaggatgatatcctataactccgatgcctctgcaacacatctccggatcaactttcgggtaaacagctactaatttatctgtggcctgactaacattagttgctcataatattttctatcttatcttacaattagtgctgtgaagcactcctatttgtttagtttcttgagggaggctcgaagctgtttctgatcttatcagagactagagaagaaaggagaataaccagatgccaatgcgaggctcaaggagtattttaaaagtcatgtttttatgtgacctcaactgtgcttacatgtttattggtccaatgcctctctgacttctttgatgttggctcgaaactgggataaggttgtaattttgcacataggaaaacctaggaccttgaattgtatagttttagaaatcaagtttttatctgatctcaactatgcttacatgttctggtgcccttgtgacgtcatgttcggtgaatgagtgcaagtgctatctatactgttgctctgtgtgcatgtgtaaatgtcaatggttccacaaaacagttgatcagtaaaaaagcagctctttctgagattggacgatgtcaccccaatcacctatcggtagtgtactacacacggtccaattttgaacaggataatggtaatgttttgagtgttgctaacgccagatggtttttagaaaaaagtctagaagattttcgttcacgaaaataccatcaaggagtcacaccaaaataccagaaggatttaccatgtgagaaatttaccaaacaaattgcctgcagacattagcgaagcagagcgttgcgacagtgatgaacgctggctgagatctaccggaatagggcaacaacggcaatagtgctaaagtcagcgaaggatcgatgcgatacaagattgaaacgtaataaaaatcacgaatattttcctaataccaagtttacccctaatcgtagtactaacaaagtactaatatgcccttggaaatcaacggtttggattatttctagttgtagtatatactacaagtagaaagcaccggagcgtcgcccataggagtaaccactaaaggcacattttctccctgcaaagcaaaagtgggcttctttacctatcctgttgggaggttgacacaaagcaagaaaagattattcgattcacagtacacataacaaagccgggagctagaagtttcattccgaaataagcaagatctgttactaaagtctttaatgacctcaagaatgttccatactagcaactggcaccctcattttctctctctatgtcagttcaattagactgaaagtctgaaagtaacacgtcaaggtgaagaagaatgagccaacaagaatgtgaaggtatgcactaaacacctgaaatagctccgttcttggtaattattgctgtctaaagaacagctcaaaatgtacagcggcactaatcaccacccagcaaaggaaaagctccccggatgaacgctcttagcatctagctacaggaaaccgaaatcaagcagcaccgacagcacagatcggcgaatcttgaggagaggaggggtaaaggcgggtcacctcacctgagtggattgccctggttgaatccgaagctagagttgacgatcatggcgacccagaaggccgcgaagagcaccaggaaggccaaatcccggcaccgccggttgtgccgaatgatgccgcctccatctccgccgccgccgccacctcccagctcatcctccccgccgccgcccgccgccgccgggtgcctgcctatgatggcgccgagcggccctcccattccgccgccgctcgcttcgatccgatgctgtggtaggtcgcgcttgagcgagacagcgagcgatctgtagcttgggagcagaagtgagcgagctcaagctggcggggctggtcgagtgatgggcttgtcagggtgagcagctagctttttgttttttttggctttttgctgatgcggctgcgtgaaaaggagatcaggaaccttttccaagtttaccttttccaaaatttctataaaggcatcacgttgaatcttttgacacatacatgaagtattaaatataaataaaaagaaaaactaattgtacagttagaagagaaataacaagacgaatcttttgaacctaattagtctataattagccataagtgctatagtaacccacatatgctaaaaagatgatggatgaaacgatttggtgaaaactgattcattagagagacgctccggtgccctctacttgcagtattctactccaagtagaattaatctcgaccgtttattttaaagggtaaattagtaaagtgctaaaaccgaataggggtaaatctggcacttaatttttttctcatttgtgcgtcctatggtcaagcgtcgctcgatccctctccatcgaacagcagagtcgctctccatcaaaaaggagagcgcagggaaagaaaaagaaaagcagatcgcgaggtccggccaccgccggcgcttgtgcatcgcgttccatagatgtttcttgctgtaggtatttggtttccattcagcttgattgtttcatgtaaaatttaaatatattagttatatatctgaatattacacacgatggacaaatcgaaacactccaatccagcaatgacagatacaaggcaacggaagaataatccggtatgtttttttacgtagactttacaattgcaattacaacaagtaatatacattgaaccacgtacaaaaacgatgatatacacagataggcactttcaaaaccacaagctgttaataagctatagttttgaaaaaaaaaacatggccatcagtaacaagccaaagccacccaaagccatcttgagataatgaattcataggaattacaggacatagcacaccaggaatctctcaagcgttcattgacgtagtgatcattagcttgtccaccttgtcatgctcagccattctgaacaagctcacttgctccggattcagtttactggcattcaacttgaatcccttcttctaggaggaaaaattatgaccaagaactacagaacttgagtagacaagcagaaaaactattcgagaactagaggccaacgaaaaagaagattcagtgcagatgttcgagctgcaaacctacaagcagcaagaaaaacaaatcaaatctgacctgcaaagcagaaaaagagtcttctcatgtcagctaatccgttggagagcagcgctatagccagcgagaggagtcttggatgatgattcggaggtcgagagattggtggtcattggctccggaggttgcgggttccgcttgggaggcgatggattgggggctcgccctcgcggctgtgggatcaacggcgggtggagatggacagggctggagccgagcgtgggggaggaggccgacgacgaggaaggggatagcgaggtggacgaggtctcggcggcggccagtggcacggtgctgggtcggaggcggagatccgggaggcgaactcgtcggaaggtgggccgacgcgggggagcggcagagagggcgcagctctggcgatcccagacggagatgcgagctcgtcgagggcggctgaggcagccagtgcgacggaggcgagggagtaggaggcgtcgagggcggtggagcaggcgaggtcgtcaaggtggtgatgggagccgcggggttctctccgcatcggctccagatgcgcgattccggaaggacgaaaatatccctccgcagataatttttcctggataaaagtacccctccacgattctactaccactaagtgtggtggtagtagaaatagatctgaaccattggatcaaataagatcaacggttcagatttttttctactctaggtagaaggcaccggagtgagactcgattcattaaccatggtcaatagagtaaactaagagcgagatctactaatctaaagctgacggttaaactagcttttgattgggccacgtggcacccataagttatcaaattaatcctagatttcatcaaagaaaaaaaaaatcaaaagatagaaaatggcataagttttctatgacaattctaaaagcaagcagtaccttaatctagttcttaaaaaaaatagtaacttaacatcacaacatgtataacattagaacattccgatcaggtgggatcaaaaggaggatgtagcccatatatgctggtccacttaaaacttacatatagagacatttacttaaagaccctaatttttttatttgggagagtgatccagttgtagaaatcgcttaggatttattgccaatttacaacatatattgttgagaattatacatttccatgttattttttcaaataggaatatcgcaaatattccattccacacatcttttagaattaatcattaaaaattaaactaattttgtatataaccccatacatttaacctccctagcttttagtatttgaatttcacgtacattggtccatccatgtgaacaaattgacttatcttacaccacttactttaacttgattttgtggaatatgtctaactaaatgatttccagttgatacaattgccatgtgttccagaaataaatttcattccaataatttcatttctttttttatcagcctatttgcttctgcttgtatagagtaaggtattcaatctctcaagaaaaagaaggaataaaaatggtcaatttatatatatcgaacaaaaccaacaataccaccgcatgctatattaattggagcgctgaccgacgaacctattttctagttaacaatatggctggatttggttacctgctcaaagccgatgggttgtccattctggtcaaatgaatcaaccaatcctgtgggtgtatttcgtggatcatactaataagacattttgctcatgttgctaatatgactatagtgtgtacttcaatcattatggcatcttctcgaccttggactatcacgtagatggttaccaaagaatgcctctccttcatggtaaccttcatgaggaggtatacatgcaatcgccttttaggcgtggaacatttacttttgttttctctagttctatgtgccctagactagccggtttggtcagcgtcaatgcatcacgtcaatcgaagcactgagtaagttgttttgtactggttttaatacttaggggacgcgagatataaccggttttgcggttgagatatacgggttagattcagctgatagttgagggagtcaaaaaggactttctgttcatgtaaaataaaaaaaggccggatcgggtaaacgagttggacttatggtacttag

SEQ ID NO: 81258 - DNA, 6482 bp, Oryza sativa
taaaaaaccattcacaaactttgagtaggagatgaattaagtacttacgacttttgaatcatttttttctcgagtaaataataaactattgctagttaaatatcatacaggccattcatatacatatcgtgttgtatggccacaaatgaaaaatacgagagcaagatactcaaaattcttgtgataaattgtctcatgaaggcgcatgatatagtaggaaaggggggaggggagtgtatgcatagaaagaaaaagaaagggaaaaatgaaaaaagggatggaaagcgtacgtacccatgtacgtaggtgcgtacctatgccaggggatgagaggtgggaccttgcagtatttagtttgctctaagatcaatttaatataacggtttataatattgggcgtaccgatttaaccgaaaatcaagtaatggatactttgcttttctttccatagaatttctaatatttcctctaatttattagagcaccacgtgacagcttgagagcactttaagaaattttaaaggacttaacacatgtaattagaatattaaccgcttaatatatatgtatggggcatatggtaatatttgttctagcttcgtgcatgtttatatacatgtcgagagaaattaattatgtggctagcaagccattagatgtctaattagtagcaattaattttgacaccaatttacagatgttgatagtagtttgtacatattcatcttacgactttgattatccgttgatccctaatttaatgatcaccatgactcgcatgaaaaaaatatatactacttagggtttaggacagctgaaattgatgaattatcttatttatgtgatagctatttgagggtatacatgaatgaattgacttctaaaaagttaaaatgttgtttaaaaatgacaccgtttagaaacttggaaagcgtgcaaacgaaaatccaactatagaatcaaggaaaaaaagagggtcttaaacttccttatagcactcttgtctttgtaagagttctattgatattcgttaatattgtgctcatattataacataatgatttcttttacgtataccaacaaatagtacaaaatccaaatatgacataacacaatacattataattattatgtaattaactttcgattccaacttaaatagagctacaaatagtacaaaatccaaacacgacataacacaatacattataattattctgtaattaactctcgatttcaacttaaatagagctaagtgttagaaaaaacgcaacccatattgcttaattctgctcttgctgcatcacacctctaattttcttttcatgttattaataaattaatcttctccatgtatgaatttatatgtggcaaaacgttagtgctgcggcagtcataatcaccttagatgcctcagacacgatgctttgtcacgcgtgcaaaaggtaaaggtacagacgtgcattgtgtagcgggccaaaaagagaacttcggacgctttatttattagcaaataatatatcagatgatttaaatgatgagtccaccggttctttataagtgtacattagttattatagattttaaatttttaatttaatgggtacacaatataatgatgtagactttagtgcattatttgagaataatagtccaatgtaataaaaaatagttccgatgatttaaataatgggtccatcggtttaagtgcacatataaatcagttaatatagattaaaattgtttatttgataggtacacaatataattgtgtaaactttattttaaaatagtgtattatgtgaaaataatagtacaaaataatgagtacacatgtttatgtagaaaatatataacattattaatttaatggtaacatataatggtgtaaattttattttcaaaaattgtagagctaatttagttacctgtgagcattctttgttggtgaaattatgattatttaaatatatatatatatatatatatatatatatatatatatatatatatatatatatatatatatatatatattatataaatggggaaaataagaaaaaaggaaaaaaaggaggggaaggaagcatacataccatggtacatacgtatacccacacatgtgcgggagaaggaggagaggtgggaccctatagtacttggtttgttttaagatcaatttcatctaacggtgtgtaatataggacccaccaatttaagtgtaaaatcaaggggtagatgtttttattttttcttagaatttttatgattttctctaatatatcagagcgccacgtgatggtttgagagtgtttatagaaagtttaatggacttttagtatataatagatagatagattatataatgtatattattcatttatttagatattttatgaatatttcgatgacgtgcgtatagtacaatacgaactcaaaataacttatatttgtacaactatgggttgaaattattaacgtggtttttatctcatgtgagtgaaaaaaaggaaaaagacaagaaaagtggggacgtgaggccctacatgcaagtacatactccgaaccatatgggctggaatatgaattttgttttttctcatgtgttagtgaaaaagaaaaaagaaaagggggagtggggcccacgtacaaaatatgtaacgtacatgcacgtacacgtacagggcatgtgtggatttttaaagataataataaatctaattgatatttttttatgctatatctaacgtttaaaaatagtgggtccaccagattaaatgaaaaccaacggctagatgctttgcttaattcttctaatttattagagtgccacgtggcggcgtaggagcgtttgtaggggggcacgtggcggtttaggagcgtttgtaggaagtttaatggacttttagtatataatagaagatttggaattacataagtgaaatcgtcttctcaaataaaccaccctcttgctcaagactactcaagagctgctaacgacgatgcaatactatggggatatcgactgaaagaactcgatagaagtagaacagcctctgaacattggaaatgtatctttctaaatgctgtaaactccctcagctccctgtaattaatatgttgtattccctctgcccactctacttctaaacttgtactcccccgcgggtgatctttaaaaaaatatgtccgtgctaaatattacggagcaattttatttgtcaaacaaatatatatttcaaaccagagatgatgtggtatgaatgatatataaaagaaaggctataagcaaagctcaaatagattttttatgtgcagaattctgaattataattcatgtcacgcatggatattggatttgcctacaaatcggcgctatttcaccaagtagatcgaaaatgtttcatcttttaaaaagctgaaacacaaccaaatcacttcataaaacattttgctacaacgtatgaaacaactgtttcaaaaaatcagacgttgtttcaccctatataaaaacaatatttcagcaaatagcgaaagaatgtttcaactcttaaaaaaagtgaaacactgtcagatcgctggatgaaacaatttggttcaacgtatgcaacaaacgatttaaaaccattgcaacacttaaaccccatgtacatcaacaaaccatgtgtacatcaaaaatgaaattattaaacagtatcaaaaatgcactgcaacatttgatccatacatggtaaaacataacgagtacaaacatggtatgctgcagtattgtgtatggttgccaaattcactccctcccaacactcagtcgcttccgcttcttcagctgagctacaatggctgataactctcccgaactttgtacgaaagacccatccacgtacattagcttttgcccagcccattggtgatggagtccatcttgcattagtcacatgagcttctctgtgatccaccttcagagcgctatgtgacagcatcaagagacagggattcccaataactctactggatatataatcgagcttcccgagacggaagccttgcccgtgccatgcatgcacacaaacattccgaagataccaggatctccataagagtatgttagcaacacagttgggctgcatatgggctaggttagccatgtttcagtccaagcccaggcaagcacaactagcaacatatataagcagcaacagcaagcacttgggtgatttgggaacagaagaaaggcaacggcgacggctggcctcggtggctaggcgagcggcggcggcggcgacctggaggccggttggctccttgtcaatttccttccctacctctaccccttcctccagtcccccaccttagcttctagaaccttctaaagcctgtatctccttcctcttcttcttgagtttcagctcaagcaactagttgtgtatttgtgagttgtactagagattgttgttgctttgttaagagaagaggtctctaacagagtaggaggaattttgccctgtacctctggtttgattgactccaggatgatgcatgaggagccaatccggcccagacctaaccaattgtctatcatctggtagctcccaaacatcacgtacgcaatggtatgacgtttgggagctaccagatcgtagtgcagcagctcgggtacaggagacgacagcatgaaacatgtcttcgtaacctagctagcttgtcaacaaatacggcaataagttgcatctgcttccaatctgcgcatcttccaatataattacccatcgtggcaagaccttctctagctaattaactgccaagcaaagattttaatgttttgtgacactcgggttgcccataaactcgcccatatattatatatattacgttcttcatttgtcgatgaactagcttagatgatcgatcccagttcggttgcattcatgcatatgattgatcgattgattggtcagggccagacaataagcgttgcggacgcctatcttttaaaaatgccaagctaggaaatcttctcttctgccatgtggcaatttaatcttcagaatttcattagcatctcatatggagaaaaaacatgattgactagattcacatcccaaggattggtctcttgattgatcagttgttaaacccaccacctaatggctctcttgattgatcagttgttaaacccaccacctaagggccggtttagttcgcaaaaatgaaaattttagagtgtcacatcggatgtttgattggatgtcagaaggagttttcggacacgaataaaaaaactaatttcataactcgcttggcaaccgcgagacgaatcttttgagcctaattaatccgtcattgccacatgtgggttactgtagcacttatggctaataatggactaattagactcaaaagattcgtctcgcaatttccatcataactgtgcaattagtttttttttcatctatatttaattctccatgcatgtgtctaaagattcgatgtgatatttttgaaaaaaaatagtaactaaacaagacctaagtcacgcgcaactcccactttgtcgtgacaacctacgtacgatcggtgtggattgtcgggggtatccactgatccttccatatttggacctctctaccatctccaattctcaaattaaacctttctttagtaactcaagcccatatcatacttggtcccacatatcatacatacattatctcttgtagtttatgttgtagctggttacaaatctgtaggccgcttctcttatctctcttcatttatctttgatatgtgttttatagctggcttataatctgttattgtatctgctcttaaccatttgtattttatggtgccatcatttctaaagatttcgaagcttatcgtgtacatgaagcagggaacaatgatcgatgtagatcaagaattagatgactctgagtctgagtgtataattaatgagtgaaaaattaagtgaaaccagtgcatgtaggggtgcggctaatgggcggctaggctgggcgcgcggcggctaatactactaggactactgcgtactatttttactatactaccactataaaaatatatacgaagttttatacgtatatatttttttatgtataaaaaaatatacacatatacaaactttatatatgatgtatacaaattttttatacgtgtatataaactttatatatatatatatatatatatatatatatacatcgaatataaagttggtatacgtacgtatataaagttatatatatttataaagttatttgaatctctttataacgcattgaacccgttaattttcactgatacccggttttgcctagcacaaattgtaaagcagatgaacggtggatgattttggagcctgggcaccatggtgtcccaattattattattggtggtaatatatatatatatatatatatatatattaaaaaccagaaagaaaaaaaaagacacgtgagctc

SEQ ID NO: 81259 - DNA, 554 bp, Oryza sativa
cgccacgccacgccacgccaccgccgccacgccacgccgccgccgcatctcccttcatgcatttcgatctctccgatctcgatctctctccgtcgccttcgacgccgcgcaacgccgccgccgcatgccaacgccacgccgccgccgccgtggccacgccgccgccgccttcgccgccgcgcgcgcaatgccgtcaccgccatgccacaccgcctgcgacacgccacgccacgccaccgtcgtcacgccacgccgccgccggcacgggcccacaacgccacgccgccggcgacgtcttcacgccgccgcgccaaccgacgccccgatgccgccataccgtcgttaacgaacgagaacgagaacgatcgaacgaacgagagcgagaacgaacacgtcaacgtacgttgccgcgacaacgtgaacgagaacgaaaacgatcgaacgaacgtgaacgagctagggaacgtgaacgagcgaacgaacgaggacgaacgttaacgtgaaatgcaatatatatatatatatatatatatatatacatgtatatatatata

SEQ ID NO: 81260 - DNA, 597 bp, Oryza sativa
tcacatgtatatagcaaatcatcggccaactaatttctgttgacattttcttccatggaaagcgttggaagaggccagctccaagcgtgctgcgctggggttgctgatccaagaagtccttttccagatcatcaacttcgccaatgagaaaaaagaccatattcctccaatctccgataggatattcaatcacgagatctcgatccccaggtgcatattttcatttacatatctaattgcactgaacatttcgttgggtaccctctgatgacagatgaattctgtaagtttgttgaagattctgtatcaatatctgaatctccaggtgacaccttttccttggacgtgttgacagctcttctgattctgtattcgggtggaacgccgacgtccttagaagagtgttgaatagttgaactgaagacggtgatcatcaagtacgccatgtccagcgttgggatagaagataaccccctatgtggtcgttctgtcaaagatgtcaagccattgtcatgaacagtatcatattgtacagaataatttaggtaataatagaacagacagaaaccaacgattttactcactggagatgtaaat

SEQ ID NO: 81261 - DNA, 621 bp, Oryza sativa
tagttgtatttttgttgatttaattttgagtagataatttggaatgcgatacatgctatgatctatgatttggtattttgctactttttacggaatttgtagcctgctagatgttcttacaaagatatgagaatcatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgtatactgaaatgttgcactatagcaagagtttgtatagtcagtcaacccccgtaccgcggtgtg

SEQ ID NO: 81262 - DNA, 8569 bp, Oryza sativa
gcggcggcacggggagagggtcccgagctctcggccacgccctcctcgatgtcgtcctccatctcccccgcggcggcgaggtgccgcctacgcgagtccccccatagcgacgtcgtccactacgtctcaggaggaggcggcgagagagatgcggtagtagaagcagcctgagctgaggtatccaatccaagaggtggtgaggaatccgaggggatctttttggcgcgagaatcttctagaggatggcgcgcgccggccggccgggcggtgggctaatatttgtagggtgaaattcctcgccggagcggagattccaatccaaacgccggcgaggcgaagcgagacgacgaactgagcagcgtctcgctctctcgcagtcgcaggaggaggaggagggagattttccttttctcttttttttcctttctttttattatgaatttttggctttggtggaatggaattatggaaaaaaatggaatggaagcaggaggaggaggaggaggatcttctgcgccgtcgcgccacaggagatatagcttcttactgcatccagtagggacgcgacgcgtggcggcggagggggtgtccttatccgattccggggggcgagatggacggtctggattcatcgtggagcaatcggacggcggcgggaggggcgcacgccggagagttagagtttgggtggggaccaccagtcctttccgcaagtaccggagattggacaaacggacgctggaaagggtggaatcagagtacggctcgctgtacggtgggcccgccgtgctttccatctccttctctctttgcctggcccaccgggcagtgacctccggtagtagtagttcccctaaacttgcactgattaattttcgagtaaattccatttgataaaactatcactttgctacagctttattcagagtaaaccataacggtgtgtgtctaacatgtggcctgacataattttgtatttttgagtgcgtgcctagcaaataagcctagagaaatcaagctattacggttacagttttatgataaaatcatcagctattgttatagtttgctgaaatttacttttattttttttaatattaatttgcaaacaaaatactcctacaaatcttactccattgatttatggttgttttggcaaaactccatatccttaatccacgacaaatttaaagtttgtaaattaaattataatgatttatttacattctgtcttaagtgatgataaaatgattcttcaaattttatcaatgtgatctcagatttaggatcatgccaaacagagcacaaaactcacgtatttacaagcggagaaatcatgtgtctgctagcctactccaattgttaaatacagtgtactactacttgttataacatcaatatcaatgtcaaaccttcgttttatataatagcaacggccaaaattcactgctagattatgctaacctgatagcaaatcaatgttaagttattagtacttcattactcacatacataagattctagcaactggatccaagataccacgcttgaccgcatccagttagcttctaatttcaacgatgtgccttgcatgcttaattcactaactaagcaattgataaacaatttactagtttgcatcaacagagaaagagatcgtacttgctccaacttgtcccgacgtgtccaacacgttcctcttcgacgtaacttgtgttttaaagttggcaatgacacggagttaattataactgtttttcaagtgataaacacattgtcaatgtcaccactgtgctggggcactactcgagcaaaacgcatcaagttgcaattaaaaaaacttccggtgaaagaaacataaactcagaagaataatcaacctcgatgatattacgatattttcattgattaagagcagcaagggccaaatcaaatcttcaggtcagaagcagcggcagtactcaactgctagagcagtaatcactgtcaattactaagtactccctttgtttatttttaatttaacgttggcgtcaaacaaatgagaatggaggaagcaattaactactccagtagggaatacatagctatagcgtttgcaatgtacggcagcaaacagcaaaggccaaacctttgtttccaagcgtatgtatgctagtcaagaatctaattaagcaatattctgttctcaaaaaaagaaaaaaaaaagaagaaagaaagatccaatattctaataaccggactccagattctaagaaagcagtttcgtcgtatcaatcagaaaatagtagtacaacgcagttgtttctacataccataattgtagcgtacgtcaggctgcacgcttggcttaacttgatggattagtgccaacctacaaatactccttccatgcatacaacgatcatacaaagggtaccgtacaaggtagtaaacacttatgccttctttcaaacgggagagcattttgaaggatcatcttagggattgagctagattctaaaaaacaaaaggaaatacaaatacacatttctcttgtttcaaaggaactctcctttggaactcaggattaaaaaaaacatgaaaagaaaaaaagaagtgttggattgaattgtcaaggcttgttaaatccttaggatttcaaacaatacaagaattgatctaataaagttgtttggagtttcctagggaaaaagcacgagaattttgagagaggaagacataggaagattcccatgaggttggaatttatgctagaaaccctccaaaattctaatgaattgaggcaattcataagaatttatatggttttgagatgaccactcatttgttccaaagatatgcatagggactatttccaccggattcaaaatctccaaatatcctttgtttcaaagaagcccctatatggcgcatactgtaatataagttgtattaccatagtaatatatgtggttgtatcagaaacagcttctatttaacagttagctatgacatgagcttttattgttctaaatttcaagggatagcaagtagtaccactgtgtgaactacgtattagttagaccaagcacaactagttgttgcaagattttgttgttgtagctgccagaaattgctttcagctagcttctgcgtccaaccataacagtttttaaacgtagaaaggaagaaagtcgacccaccatattatgcgcatttgtgctgtaagcaccggaacaaaaacgcatcaagttggaataatcaagttccagacttcctgttatttggcaaagtattgacaaaagctggggtaacctgacctgaaatggatcatgacatcggcacaattaaagcccacgctttgttgtcgccacctacaaagtacgcttatgctgcaagtgcaaattaaaggatattactgtcacttccaaagtaattatgtcacgcggtagtgacaaaagctggagtaaattccgtattatcgcgcagtaagtaaccagtagtgtgaagaagctgtggccggctgcgatagcgatgtgaaggtgaagccgctctgctcaaaacaatccagcagcaactagcagcagcgagtaagttgatgggaaaacaaacaaattcagtagaacatcaaatgcagcagcagcagcttgtgccaatccaatccaggattaggtaagaatagcacgggatcaagtggacaaatcggacagcagctgctgacccaaaagatcacactgccgagtcatcccaccttactatattgtgcatacatcaatattagcagcattttttcatgccaactacagggcttaccacttaatcagagtgggtccttgcatgctcttatgaaataaataatgatggacgcatatcacaagcactaaagccaccagagcgtgttcattatcagatcaccggatgattagcacagccttgccaattatcagccgaccactaacttgtgacatcataaaccacactaacgataaaacttttacagtgtaacaaaagatgtgatgtgaagacagtttttcaaaatttaaagtactattgcttccgttaaccttccttcacgagaacaacaatgaatcggcatggcacatcagaaatattcaatcggttgatcgtcgtgataacaacgcttccatggctttgaatagtagtttgcttacatttgtatgcacgttccaatttttttatactaaccttgaaatagcacttacgtagttcggtgttgattttggcacataccgtacaatacaatattggtagatgacgactggcaaagcatttcaatacaacagcaacaggttcgcaacaataataatgccaccgtgctactgctcatgtggacactttctagatgaacaagtaagcaagagttgctacacatgaggttgtataccagaaatgaaaattcccaatttgatgtaaccagaagacctatgaaatagcttaaatggacaagatagagatctatcagtcccaacagtacgcagattccagtttatgtaattgcttaaaaaaattcaacagggtgttagactgttagttcacctaaggcattctgctaaactgctgccaaacataataaaagtgtccattcgtctcgagcaaactagcatggcttccccagactagcgaacatcaagaacacaggtaaataatactagggagcatgttcatgtacagagaaaaccagacataccaatttatagctttcagatcttagagaacattttgaaacagggaaaagatgcatgaaaattgaaaaggctcacaaaatcagaactctcataactttcttatttcagatcactcaccagctcagtagataccagaaagtaaccatttaagaacaataaaacagaaacagtgaagaagttataacatagactcgcacaaaaccaccaaattttacaagatgtatttagctcaatatcattaacaccaaactgtggtttagtagaatctgaatatctgatgatattcaggaagatgtgacatgcccatagatctgccaaattttcagggatcatatccaaatacatcttgtaaaatttcatattcagtgaaaggcttatagcatggcacagcaacttggttaggcattggagaaatagcagtagattcgttagaaaatggcataagtaagaagcttcagcaagaatgaaaaataaggaatgaaggtatagcagattgattattcattgcttcaagaactacatgcaaagcacaactttgtataggacgagcaggtgcatgacacctagattggcctaatgctaattataagccgtactgcttataatttgtggccaaaacttttatgtgtccttagttttctaaaagccagtgctgaaaaataaaccttaaaatgaacttcaaaattaagttttaaaattcaaattgacagtggcttataagctgtagggaaaatgatgggagcctaattactctagcattatactgtagctacaactttatctataacttaacaaataccaaattctagtttgaaaaatgcatatattatctttacctaaggcaagcaacaaactccttattcatatgccatttatccctgaccccagaccaatgcccataatgtttgagacaggcagatgaatcgtcaacacaaaagatcatatcacttaaaaccttcctccacctaagcaaacaattgtaaaagctgaaagcattcatgaacaaagataatacttattctggaaccaatgttagaacttaatgttgtagtagtcaccaataagcacggtccaaaacgaagataagcaaagcatattatactccttgtgtctttaatcaaagcaaaaataagaactaaataatgtgttcaccaaattaagtttagtaaagcacctcatcacattgcaactagggactaaattagtttgttataacccaaggttgcatgaccatgaactgtttcaatctttggcaaatgggcttccttactacactatatttctaaaagtaccacttcatacagttcataattagtgcagctgtaccctagctttgacttttgtgtagactcctgactttctgaattcaaatatgagatgcttgcatgtcattatgtcaataagagcatgcaagttatcaattatatgaacatgccttgttacgaaacaaaacctgacaaaaccttttctataatgttcaccacctgaacctgcaagcacagagcagaagaggaatgcatgctcttttgtgtagactcctgactttctgaattcaaagatgagatgctcattttcgaggaaaaaaaagttgaggtgcttgcacgtcactatggctgtgttctttgcccagggttcccaacccctctccctcgttttccgcgtgcacgcttttcaaactactaaacagtgtattttttgcaaaaagtttctatacaaaagttgtttaaaaaaatcaaattaatccatttttttttaaaaatagctaatacttaattaatcacgccctaatgaaatacttaattaatcacgccctaatgaaccgccccgttttccacgatcactgttccggttgggatcctgggctagcgaacacaccctgtcaacaagagagcacgcaagttatcaattatatggacatgccttgttacataacaaaacctgtcaaaagcttttctataatttttattagctaagatcaccacctgaacaatgtacaagcacagaggaattcagcaaaagagtgtgttgagatatttgaatccataaggaattaagaaccataacacagcataaaacatataatgttattgctgaattaactaagaacatagacacgtttatggtattggaatacctaaaagctattctgtatgtgaaacatgctgaatgaagatatatatatatatatatatatatatatatatatgcttgtgttaggacctatttttagcatccctgactctgctggatgatatttcatataaggcatcccaatagcacatctaaggtcagaacaaatgaagcttaagacctaacaaacttgttttcatgttcatttcagaagacaaataactagagtaccaaccaagccctaggaaactataaattcaaaagatcaatagtaagtacagaacacacacacacacagaggaaaaattgtatacttgcctgcccttgctatgactgctgataacattaaagtactgagtagaaagaactagggcacacctgaattcattaactttatatatagtgattccccacttcatgcggccagtaggaaaactaattatgtactgactactgagaactaatatgtaagtagtgtcgcgagtcaagatcagcaaagttattataacgatgtgatcaccttgttcatgtaacaagcagagtgatcaccatacacatattcccccctacgaaatcatcaaaacaaaataaaagtaacctgaattttattgtctgaagcaacaaaccctgaaaagatatttaaaacatttcacttttaacaagtacagcaattgaaagtatctcatgatgctacgaaccaagtacaatgcaaataaaattctttgacatgtcaattccccctgcatgcaatggatagatgtcccgaatcaattaaaatcttaacctgagcgcatttagtcacgcaccggactggtatgtgttctccatagacttcagggcatagcagtgaacccaccatcgaacacaaagccacggtatacgccatcactgtacccaggaacaccatcaacccagtcccacttgccaccgctgttgcctagctcatcctcctcccacattgccagcttccctcgcacccgctttccagcaaaccacaccttgccatcaccgccaaacaccttgaccttgttgttgccaccagcaacagcagtaggcatggcattaccctgtgcagcagcctcacagaggccggtgaagcaacggtacatattgggaggcatgcggccagcttcgtcccactccatggtggccagatctaggcgtaggatgagcaccgtggagcatggcgcgtctatggcgaacgaggacctgaggccgccgatcatcaggacacggcggccgccggcaccagcgaggaggcgcgggcgcttgaggatctcgaagacatcgccccacgcggagcgctcgacgggggcccaagccgcttgtgagcatggagagcgggcaggagaagagcttccactggctgcgccacggggtgccgacatcgcaaagcgcgaagacggcggcagcgccggaggcgagtatagggctccgcggcttgaaggggagcgagaggggatgcttcatccacttgccggatccggatggggtgtaggagagggcggcgagctcggtgagcacgaggacgacgccgccggggccagcgaggacggtgccgtggcgcgcccaggcagatccgagagggggcaggaagctgtaggtccccgcgaaggggttgcagacagcgagcgatttgggcgggtgggcggtggaggcggtgaaaaaacagaataaggaggaggggagggatggcggggaaggcgaaggggactcgagccagaggtagaggagagagggggaggaggcga

SEQ ID NO: 81263 - DNA, 633 bp, Oryza sativa
aagttttttttttaaaaaaaaacaggaactggaaacaggagcttccattaatcacaggctcaattctctttttattttgaattgcagtagactcctgcgcaagttttaggacaggatgaagtcgaacaggaagtaaaatgagaagacataaacgatcgtatctgcctaaacagagcagttaggactccgatccaactcttcgtttgtgtagtaaatgccgcttctagacagtagcatctgtttccaggaagattggagtcattcaagttgtgctgctctatccagaaccacaccaaacagctatcgccttagggtgtgtttccacgtcaaaattgaaagtttgactaaaattagaagcttgaagaaaaaagttaaaagtttatatgtgtaggaaagttttgatgtgatggaaaagttgaaagtttgaagaaaaagttagaaactaaacaaggagttagtctagagatccttcgcaccataaatcaccatccaccttttatgaactcccatgtttcaagacattaaggctgtgtttagatccagaggtgtaaagttttgacgtgtcacatcggatatacggacacacatttgaagtattaaaacatagactaataacaatacaaattacggaat

SEQ ID NO: 81264 - DNA, 26486 bp, Oryza sativa
ttgggtttgtaatagtattatcgctgaatttgtaaccttacatatgtatttatgtgacaaatttaatgctaaactagaaaaaatgcccgtgcgttgcaacgggtgaatgctattttaatcttattattgttatacggtttagttaggataaaatttattttagaaattcacttgatattttttttagaaaatcatgatatgcaattaggagtctgattttcatctcaagttagcacgtgagtttttttaaaaatatttcttataagactcttttgtattttccaaaacaaacgaacttaaaatccgactcaaacacggatctgtatttccaaaagcaaataaatttaaaactgactcaaatacagatgatgtactaaaatgccggaaaaaaacatctccaatttttttaatattagagataggtagtttccagtcattagcctttcggcttataagctgctaaaaaaatttaaatattaaagtcttaattttagagttaattcgacggttttttaactgtagtttatattccagcattgtcttaaaccgtaaataatacaaatataaaagttttatttatgaattattattttttcttatatgacattttatgagttatcagtcgcagaccaaatgatttgtttcatggttttgtgatattatggatctaaatatattgttttatgataattttattaaaatatagttacgtagtttctaaaatttactcaattttttttcgatccatgcaaagatcttcggcatttttataagaaacggccgtgtttggtggtgggtgttgggaacccatcacccacgcacggaaaatagagcggtccattagtgcgtgattaattaagtattaactatttttttaaaaaaatagattaatatgattttttagcaactttcgtatataaactttttataaaataacacaaaagacagaggggagctgggaactcctgtatcgaacacatacacagccctagtagatgtgagggctgaggctctactccttgggaaaagtaacagggagtgtcgggcggaaatttgagtgaaaaaaaaaatacatgagtgacatgtagcaaaaaccaaaatgataaatcgaaggcccatgtgggtcttgatctatgaaggccggaaatgacagcccaacccactggagcaacataatgtgtcgtccccttgggccaattccataccctcatgtaagcccattcactatccttccaggctttccagcccaccgctccaccgatctcgtcctcccttttgcggcttgcgaatgtcaacacactgttttcccagtgccccggcggccagatctcctcatgccactcgtgctcttgcgcgacgcctccccgtcccgactccagaggaccaggttctcctggaagcagatgcgcggcgcggttcacccgccgagccggacgtcgtcgtcgcctccgaggagatcagctctgatcacctccgtcccggcggttcttgctctggccttcctcctgatccttgccgccggcgtattcctctactccggcaccaccaccacgccgtcccgggccgtcacctccgctggccgcgtaaacgaagcacgtggcgggggccatgctctgctgtccccgacggtggggtccataggtggtgcgcgcgccatctgggagctccccgcggcgccggccagggcggtcctcttcgtcgcccacgggtgccactgccgcccggagaacttctggccgccgtccccgcgctgccccgggtgcgtcggcctgccggaggacgtcgccatcacggaacgcgcgctacggaggcggttcgcggtgctggccctggcgagcgcgagggagtgctggtcgatggggaaggaggtgagcgccgcgaaacgtgggatccggtcctgggccaccgagaacggcctcgcggaccttccggtggccgccctcggcgcgtcctccggcgggtacttcgtctccaggctcgcggccgagatgaagctcgccgccgtcgtgcttatgatcgccgagggctccttcgggccgggcggcgcgccggccggataccctcccgccatgttcctccacatgccaaaggaccagcggagggcggcattggtggagaggaattccaagatgctgcggagcaatggcgttgaggtgaatgagctccggagcctggagctccctctaaccccgacgatgctgtccgacaggatcccggggctgaaccggggattgtccgagaggatctggagggtgttcacggaggatggattcgtcgatgagagagggttcatgaggaaggatggccgcgcaacgccatggaaggatgcagtggtgaagaggggattctgggaggaggtggctgggtgggctgatcacatccaggaagagcttaatcttgcatatggataccatgagatgacgagcttgcacactgatgaaatgttcgattggattgaggagcacctgagctgaggtttatggttgattactcctaaccctttcgtgattctctaactaaatatgaaaactgtactaattggaggatccgagaagatgctgcaatcttcagcttgaggaatttctgtaaaatgaattaggagagaaaaggtgggacgatattgtttgtgaaaaatagacttgatgttaactgctgtatatttctttcggttggctcttctgcaaatggactataagaagcataaacacagacacggaggtactgtagtttagtaaggttttgctctgatctgtaatggagtagtatagtatcagttctatgtgtatctagataaatcttttgatgaatattgttgcattcttgtctctgaacagtcgcactttggtgctgaagccacggtttaattgctagatagcagatgaaatagaaagagaattgttattttcaacattgcattgtccccttgttctgttgttcgtataattgcagataaaacaggcgttcattttgcctgtatagaacttttcattcccttgtccgtaatgtaaacatttggcgcctcccaccgtgcaaacatcaaatgtctaatgcattatcttttggttagcttcatccccttcatgtatcagacatgaaattttcgtttgtctggtcagctgttcacctagccaaaaaattctggattggccttccagatttgcagttagagactcaagagtgcaacatgttgttcactaatgttttgttatccagtattgacaatggttggggtaggcatatgaaattctgaatgtgaccaatctggtgagcatcagtcatcagatggcaaactgtatacggctagacaatgccaggcatatctggcgcatctcaaattgtccatatgagttcgatttctggacttgtgattctatttctgcaatctgcactcgtgtttcaggctttcagctcgacgacttcactctatcctcaaggccttcgactgaaaatgaacctgctagctcttgatgcgtatttgtcccttcagtgaatcagtgccgctggcacaattgcacgccgctggcacaattgcacgcttgcacctctcagttcgtttcctgcttagttcttcagttcttcaccctccagccaaattaacgacaaactttaacaagcgagcatgttaatgtctaccttgtccaaattttcatctatacaaactgataacgaagaaaaatatacaactcaataaatatcgtctggttttctactttgtacgattcaccacgttgcccaacctgatgtgtgcacgtcagaattggtagcagccaatacagataggggagagaggaattcccttcctcggattcttggcgcgcatgacgtcgtagacccggagaagattgagctctgcagcaacaacccaaacacacaaagcggtgcgcttccacttccacagcgggctcatgcggagtcatagcagagccattctcgggagcctccacctgtgccctcccgcggtcagcaaccgtatcgctacctccccgcgctatatatgctacctccccgccatacgcatactcccatctcggtgcaccttaattgctctctcttccgtagcgtatctgatcgatcgatcgaccaaggtggtgaccatggaggcttccaggaggtggccatatgcagcttggtttatggccgttctgggtttggtcgccgtgttttcatcgtcggaggcgtacgtcttctacgccggcggccgcgacggctgggtcgtcgaccccgccgagagcttcaactactgggccgagcgcaaccggttccaggtgaacgacaccattggtacgtgtatcatctcgatcatcccctcatcgatgtataactacgtgtttttttttttggtttaatcgttcaagtgtacgtgcggcgcgtttcttggctcgcagtgttcttgcacgacgacgaggttggcggctccgtgctgcaggtgacggagggggatttcgacacgtgcagcacgggcaacccggtccagcggctcgaggacgtcgccgccggccgctcggtgttccggttcgacaggtccggccctttcttcttcatcagcggtgacgaggaccggtgccagaaggggcagaagctgtacatcatcgtgatggcggtgcgcccgacgaagccgtccgaggcgccggagccggccggggcggccgggcctgtctcttccaagtcgtggtcctggcaggcgttcccgccagccggtgctaccaccccgccgccgctgccgccgtcctggggctcggcgcctgagcacgcgcaggctccgggcaagagctcgctgggtggttctggcggcggggaaatgtcgcgcagcagctcgcttggcgcgccaccgccgacgtccggcgcggcagggttggccggcgtggttgccagtgttgtggttggggttttaggggctttgttgatgttctgaaatgttgtacactgccacactaggactgggcaggacgccaggacgttctacctccatggcgatcatacaggtcacagtggtcagcgagttagtcatagttagtttggtagttaaattagtataagacttaaaactgatgcacaaaataaagagaacgctgttacacgtacatgtatggataatgaaggcacatgctcgactataagtaccattggccttcatggttcaacgagatgcataattttgtacaatattttcttcggatattgccctgtttggatccaggtaacatcagatatttagacactaattagaagtattaaacgtagactaataacaaaaccaattcaataagcctggactaattcgcgagacgaatctattgaacctaattagaccatgattagcgtatgtgatgctacagtaaacatgtattaattataggttaattaagcttaaaaaaattgtctcatgaattaactcttatttatataattagttttattattagtctatgtttaatacttttaattagtgtataaacatcctatcattcatcccaaagtgctcagtacatctggagtgacttcaattgggccattctaatagtggcccaagctgggcctatagaagttctgggccggactgctcggtgtggcgtcgcgtcctggcagtcgagacgggagcgcgtctggaatctgcggaatcgccgggagggcgcgcggtgccgctgccgccgaagccgcggtgaggtcagtgccccgctctccccctcctcctatagtcctattccagcgtcccgtgctccgtgcccccgtcgccgtcatctccacacggctccggctcggggcgcgcggttgcgcccgacgaggcgtcgaccgttgctgccgtccgccatgcggcccccgatcgaggagggggtaacaggtaactatttcccctggctcgttgcccattgatttcgtcgacggccgctgtctcgttgcccactgatctcctccggcgtgccgccgttctcctgccgcacgcgccgccactcgcaagtgctccacctgccggccaagccaagctgtagctccgctctttgcccagctttgttttccttccatctcccactcgcggagaccctattggggatcttcatatcagcgatacaaaataactcatcgtctattcgtctctaccaatcctgccgctcgtgctctattgttttccatgatttaaaaggcctgttttgcaatggtggactggtggtactagcctgctagtttctagttccgaagatctagggtttcatgtgcacaatgctgcattgtagttgctccctcctcctttttttttccctgtggtgcgaatttacagcatggagtacaatgttggcgtgatgaatcaaactcggaccagtcagatgaatccattttggatcagtcagatgaatcagacttcacctctgactctgatgatttttgtgcacttatggtcaggataaaatatcaagacattcattatcacaaatcagaacgatcgatcatactgatgatcatactgatggaagtgcttttgatagtgagcctaacacagaaaatttgaatcttgtatttatggcgatagagctagagcaagacatggtgctagcaatggcaaatgacaagttgagcgtttggattacaaaaaactgtatgatgtatgtatccttatcctgattcttctatatagtgaattggttttcttttatcaatggttggttagttggttagtttatgtaggaaataaatgtaatcgataaggaaagacatatcaagtaacaattagagggacaaatatatggctcataatactacatgtacaactcacatagcttagttaaataaacttagctgataagccatgcagcatcttgtagtatggttgctgccttgttgtgcacaatgcattgcaaccaagtggttagtatttcagattttcagttatgttaacctgctgataatatacttcgctgtattaatggtgttaaacaagagattatgtgcacgtgtggatgtgtatttacccatgcatatcattggaattatataaaacactcactttgctctctttttaaaatagcatatcccttgctattgattaagcacccaacatgtcgtgcctttgatgcactctcctagtttcctttggattcactgcagtgagcagccgagctccaccttagtcgcatgttcatactgttagagcttcactgcaggccagttggaaccagtaccagcattctcggtggcccgtcataccctaactgagaataaggacaggcctaaatttcacaataagcattgatgaaccaaatcctaatttatttcttctcattttgtttttctctcctgtgtttcttttctagttgtagccagagcataagacaacacttccaatgaaagagtatttcttgattccaggctggtgatgctgttttgtactaatgtttgccaatctttatggaggctttaaacctgtagctctttaacgagatttgcaattagtaatgttcaaactgatgcattcttgaataagaaaatcgttggaatccattgcatatatgattggatattactaacttccattccatttatttcatattttcatgtgggaatctacaggaggcttatggaaaagcatcatctgattcaagtgatgatgaagagtggtagtacacatcaaaagggaaatttagaagacaatgtgctgaatcacctcagcatggaaaatgattctctagaagagcaccagttaggcaccagaataatgaacataccccactgaatgtaaggctttgtgattcagtaagtgagcaacaaactgaagtgctttgctccaatagcaatggtagcatagccagaaataaacactttggtcctgcaattaatcaagtataaaaaattaagtgtctacttatgttagtcaatctgaacttccccacaaccaccacattttaacaattaaaccaactatcctctccagctaacaaataagctcttctttgggaaatgcacgatccaactttatgattctaacttttgatatctctttggatattaggttggacatgcataatctaaagtgtagatttgtctcgaaagtacttttggatatttttatcatgctttataaacacattgtacaaagaaactagctgaattccttgtgcgttacgtgggactaaattaaagttccatctttacttcgaattattggtatgcagataattgacttcataatttgcatgggaatcaaatcgcttatttattttattttttgttctgaattttcagttatcttgtattatatttagtgtgaactcttctaatatattttagtccgaatttaagatatttatgagttgtattttacatgaattagttgttttaatctagagtattataatctggacccataccattctcaacattaaagattttgtttttctttttctccaatgaccttgtaatatctaggccttgattctcaaattgttttaataaaatatataatagattgaaagtcaaagttgagttttggacagtgttaatgcccaaaccatcccttattcgtcactggagagtatattgcttacattactaaattatttcatggacaaccaatttttcttgtaggactgaaggtatatttcaaggaagatccgtaccctagttgtgcaacaaataaaaatcttgcacaaagagctaggcctcacattcaatcaggttctaaactgtgatctttgttcttcctcccatgagcacttttgcggggctgtcactgtatttctcctcctgaatagagtttctgttgacaggttagtaaatggttttctagtactttgtcattaatcaagagtagcagccaccaaaaaaagagaacaacattgaaaaccatacagctgagaataataataccaatactgttgatagcatagaggatcgaatgaaatggtgatggaaaaagtaagtgtagatagaaatgaaatgatctctgaggaaaggatggaacacaaacacacaataatctcattgaaggtattccagtaagacaagataccaactgtgggcagaatgtggttgtgaattctaatgtggtcaaccaagattgctctattgtctccaaagaaatcgacttgctaaaatgcggtactagagaaaaccagggcaagtaatgctggaacaccagaagttgagtccacagagagaatgatccctagactagaacatgcagatgaggctacgcgaaaggcagtacagtgggagctgagaaagatgaagacgacgggtgaaactccctagtgttcggattatttgaggactctcttattcaggtcaagttttggatgctgcctgtatcgcttaatgtcatagtaacatgctcatacgtcataatgggttaggcccatataattaggaatggactagatgggtattgagtaacattggatctggtggttacgtaaatagagtggatgcgctgcacgcggttggggatgggtgaaaggagacatgtgaggtggcgtccagtctggaaggacgagggtgggccaattagttgcgtcgaagcaaagattttttttttgttcgtatttatagtcacagaagcctggttactgttgctgttatgtttgttccatttggagccttggctgttcatccagagtttctgattggataactcttggaaattcatgctgccatactccggttacaggaatggttaatcgactgtaaaagtgttgacatagtctgtagcagacagtagatgtgttgtttgccgtgccctgtaacataggagtattgaattaagagtgccaagtgaactgatgagaagtatttgtgactgaaatctatacctctgttttttcacctccaactgtagtaagccatttcatttcgcccatcgccagaatgtttggatgatgttatctagcaactgcagtttgcaactgacgaatctgcttaatgctgcatcgttaactggtgagtgctgtgtgtgaactttaaccctaaagtaagctttctaaagaaatccctaagctatgttagttatgaactacttgtggtgttgtttttagtatcttatttatagatgaactgctaaatatagttccaaagagagatcaaaacaaaaggctgtccttgtaaaaaaataaaaaggcttttatagatggctgggccggaaatctcaatggtaggccagtttctctcttcccatgtgtgtgtacagaactatagataggaccatctggaaacggctcccagccagccgcggagccgcttctactcccacgcctctccgcgtttcaaattcaaaatccaaaggggacagcgccactcgcaccacccatcccccatggcggccaacgcgttctcgtcgccggcgacggggaggacaccgaaccctaaggtggcgccgtccccttccaccagacgggccgcagactccgccgcggcggcggccgccgccgccgccgcggcgtcggactcaaaggcgcggttcgaggcgtacaaccggctgcaagcggcggcggtggcgttcggcgagaagctcccgatcccggagattgtggccatcggcggccagtcggacgggaagagctccctcctggaggccctcctcggcttccgcttcaacgtccgggaggtcgagatgggaacccgccgccccctcgtcctccagatggtccacgaccccaccgccctcgatccacggtgccgcttccaggtgcgcgtcccgcttcttcccctagggttcgcaaccctcctcgcctctctctctctctctctctctctctctctctctcggatcaagcctagccgagccaacggctcatcagccctgtgtttgtgcggcgcgtttcaggaggaggactcggaggagtacgggagtcccatggttctagccacggccatcgccgacctcatcaagcagcggactgaagcgcacctcaggaagatccaggccgcagtctcgcccaagcccatcgtcatgagggccgagtacgcctactgccccaacctcaccatcattgacactccaggtttcgtgcttaaggtaagtacaggtgaaattaggacttctcacaccttagtgaatatggttgcttgttaaattgagacttggcgtacctctatggagaagattgcttgttagattgtgacttctcatacctgaatgaagaagattgcgttggttgctctgtcagttatgttcttagttgatagaattgttgtgttatttttgtaggctaagaaaggtgagccagagagtactccagaagagatcctgtcaatggtgaagtcgctggcgagcccacctcatcgcctccttctgttcctccagcaaagcagcgttgagtggtgctcatcactctggttggatgccatcagagatattgatcccactttcaggcgcacgatgatcgtcatctccaagtttgataaccgcctcaaggtattccttcagaacaatcaacatgtgtacatagggtttgattacgtcttctctgtgagctatgatttgtactggtgttgtggcttatgaaaatgcctctgtcttgaccaattgaaggaatttaccgaaagttgggaagtcgatagctacttaagcgcaagtggctaccttggggataatatacacccgttcttcgtggctcttccaaaggatcgtggaacaatctccaatgaagagttccggaggcaaatttgccaggttgatatcgatgtgttgcgtcacttgagagacaatgttaagggtggcttcaatgaagagaaatatggaccatacattgggttcagttgtctcaagaagtacctggaatctgaacttcagaagaggtacaaagaagcagctccagccaccctggcattgttagagcagagatgtagtgaagtctcaatggacctatccagattggactccaaactgcaagctacatctgatgtctctcagctgagaagatcagcgatgcttcatgctgctaatatctgcacgcatttggtatgcaaagaagacacatcctatacttaccgtttccattctaaaggttgttgctaatttttgtgctggaactaattgaaattttactttcttaccatagcgctcactacttgatggagcagctgatccagcaccagagctatgggggaaaactactgaagaggaacagatgcatagtggtataggcagctggcctggcattaacatgcctgtaaaaccacccaactccagtcttaaattatatggtggtgcagcttttgagagagtaatgcatgaattccgctgtgcaacatactcaatggagtgtccacaggtttcaagagagaaggtatgttttagattcaagcacatgtctacaaaattttatgtgaaagtttgcttaatttgtggtactgatatcatcaggttgcaaacatactacttgcacatgctggacgaggtgggagtagtgggttgactgaggcagcagctgagatagcacgtgcagctgcacgatcatggcttgctccccttatcgatacagcatgtgatcggcttgcatttgttctccaaagtctatttgaccttgcaatggagcgatgccgctatcaagactcaaaatgtacgatctggatgcctgtggggttcatctcacttcctacaattacatggttactattaatcttgaaactgattttgaccatcttttatgattaatagaaataatttgttcagtgtgatacgagcagacaaaagacttgactattagtagtttctgttggccaacacacactactggcaaaatatatattccaattcttttcacaccaatggtctgcaattaatttaactgcattcctcaactctgtgatgtgttttttgctattacttgtgatcacgttgtccatgcaaaatttatatggtcaatcattttcatgggtgtttactggggggttagtattttgttgatattaatatggatcacttgtgtatatgtttatctattcaagcttttgatatttagctaatatatcatcttttcatttttatgttgtaagaactctaagagtatctcattaatttcatcgtttgcatggagttatagctgagccttagcatattttagaagtcaattggagtccaccaatttgttcaatggttctcatacttattatattttcctggcagatcatcaaaatgttgaagatatggatggatatgttggcttccttgctgctcttcgctgttcatattataagtttgtcaaggaattgtccaagcaatgcaagcagatagtgagacatcatcttgattctgttacaagtccctactctcatatttgttacgagaatgacttccttagtggtgtcgggtctgtggcaaactccatgcataggtttaaccacttcccgggagtcacatcttttgacctatcagacagcggttctgcccttgaagaagctcaggagaatgtgccaccaaaggatcgtcaacatatgacaccacctgctaaaggaaatgagtcaaaggaagttcttagagaaagccagctgacggttcctgagacaccttctccagatctgccagttgatatgaatggtggcaagaagaaagacaacggaaacttgaatgatggtggtgcaagaaaaagacatgcaaggatggcagcatatgcaaacaggaatcatcataacaatgtgattggtggtgatgacctgggctcaaaatctggatcatcatactccagcatatgctcaatatctgctcagtatttcgccaaaatgcgggaagtcctgattgaaaggaatgtaccctctgcactgaactctggattcttgaccccatggtatgcctgatctttcaattatgttatacacacattttgttgtctttcttctgttcagtttggtagttattcgaagtactacaattgatctattcgaccaccttatcacatccttaacccactgactgatgagtgtttgctgtcattgatgtttttatcttgctgagaacatatgaccacattaaggactttcctttgtgaggtgtgcttcaaacactttcataacccagaaattccatgttcaccatggttcctgtgacacagtatataggcagtgaatgagtaaaatatttggattttcaagaataaccatctgaatcactatgttgttaaaatgtactccctccgttcagattttaagactttctagcattgctcatattcatttagaagttaatgaatctagacacatatatatgcctagattcattaacatatatatgaatgtaggcaatgctagaaagtcttacattgtgaaacggaggaagtagaatactatatgtcataagtacagtagatagtcaatattagttatggaccgtatatatttctggcatagctgctagcctgctactgcacgtagaattgatagcgtggttagtagatgctagccttttaaatttgtgtgcttgtccagtacacgtgagttttgtccttccctgatatgtgtactccaacttatgcaatgcagtcgtgagcggttgtttttggcacttggcttcgagctgtttgctgttaatgacgatagattcatggacatgttcgtggcacctggtgctgttgatgctatccagaacgagcgccagtctctgctgaaacgtcaaaagattttgttgtcctgtttgaatgaattcaagaacatatcgcggaccctgtaacaaagatttttctggtgcctagtctacaggcatgtatgatgtatccaggagcttcagtatatccgtaaagatgatacatcggagttcctggtgagtttctactgctgtttggcattttttagctcaatgcttctgttcttaatgcaagtagtctttctgttgtcaaattccttattgacatgtcgtaccacttttcatctgttcaacattgataacctccttgttaaaaaaattggctatgattgagaattagattaaaaagagaacgtgtagatgatttgatgatctcaaatcgtaccagtgtgtgcacaactcctaaagaacacttatacaaatcatcttaagatacaacaccatcagtattgccctttttgctctgttgttttgtcattgtatatgcaacgggtggtctggttgggctgtttcttagtattaatttggagttgaggtgtgtatgggtgcaccatcgaaccgattcaacagattcggtcacgactcacgaggtgaagtgtgcaggtgtgtacttaataaattatacgccgttgttagttggagttgatgactccctgtatccgtccatttcaacgtatttcaactgtcctcctgtcatctgcatgaaaaatcgccgaggtcaggcaacatcttctgctttcgttcccatttctctttcatgctctcccactttctcccctttacccacaactgtattttcttgtaacttaagccattgtcctctgtcatacttcaagtagctcgttttgggagtaactggtgtaaaggtctagttctatttggtaagaaggacctgcctacttggctcacttgccgcggcaagagtgtttggcaggggctgtggaccacggtgagccagaccagatctgcttatcatgttcgtgctctacactagcgttgcatagcttgttgtaaatctcaagcgctcaactaccccgttgataacttgatatacctttgcttgtcgctttacggatgtggccctcgcctgccattttaatttcccttcaaatcaaatcttgcacaagtttagcagctatgcaaaaggtagatgttagtccactggaagctcgtgtacctgtccgaaaggaatgtctttctgggaatcgatgccattctggagtaagtggccaacaattccctcttccctcctcccctggtctattcgtctggtcaatggttggtggtgtcgcctgtttcaccattttcgcaaatcatggaggaagaaagccagttggctagagatgtgcccgtctactgtacgcctcagctgcccaccatgctattcgattctgtcacggtggtgccgttaggtctcagccagagtacggaatcccggcattcccggaattacccctcccccacccacccacacacacaaaaaaaaatcaataaaataaaaaataaattctcgactattacccgggcaaaaagttcgatctaaatattatttcatatacttcggacagacaacgaccacaaccttagctcatgtcatgtgactatgttattaggggtttatttggaacgtatgatttaaaataacgcaggaacaagtaaaacacatgagacattgtacttcctccgtttcataatgtaaagactttctagcattgtatatattcatatagatgttaatgaatctaaatatatatgtgtatagattcattaacatctatatgaatgtgggcaatggtagaaagtcttacaatatgaaacggagggagtatttggattgttcataggaatataagcatagtagtttgatagaattgagagagaggagagataaaagagagaaaatgcattggacttctcagaggaaaataaaaataaggtttcagctcatagtaaattttcctatggaattggtgcattggatagcaatccatagtaagctcaaatttgttgttccaaagaacatatctctactattataaaaattaaagatgtttctaccagaattttggtatgtcatctgtgtttgaatcagttttaaatttatgattctgtcaaattctttcccttttttttcttactccagagtctctctcttatccgagacgcacgcaaattaattggacccgcaccttttcatgcgcaccttgccacatacagcaatcgggcccacgcctgaattcgttttccacacgagcctttgcctgccgccgcgattggacccacgacgctctcgtgcgcacgattttctacatgcccgattgggcctatgatgctcacgcgcgggtgatttgccctcgccgcatgtctgattgggattgcgtcacctcgcacgtgattcaaaaattgaagttgtttttgtcaaaactacggtacgttgtccctcgtccgtattcgattctcgtcacgtataacattcattgtgaagtcacgaactgcgaaagtgagtccgtgtgatgttgataccaagcgaatgaaacttgctaagtccgtgtagatatcacatacgtcgttgcctagatcatccgattttattcatattacacggtacaattcctgagacatgttagcatgatttcaagtcggtctctacatatgcttgtacgtattaccaaggataccgttacaataatccataagaattagttttactttcgaaaagagcatgccaaccgaaataaagaatgatcaaagttgttaattccgtccgtcgtcaattcctgcctgacttgagataaaggtggacgacaaatcgagcttgtgtttgaaggcctcattgtttgtcttatgcttattcctataagctaaatttcaaattttagaacttaattttgaatttgactttttggtttttttatcgtactttattttataacatttgcttttgaatcgttaagaaagtgtatatataataaaagatttgcacataaatagtcttctatttagtaataagtgattcggataagcacatgaataaaccaaacaatgggttatgattatttatccaccgacgcatatatacaaattaaattggctctacccgttgcaacgcacatgcatcttttctagtataggaaatattcgcaaggtttaggatcctttgaattttctttgaattttcttctatacaaaggagccctagatgcgcgaagatctgacttaatatccttgtctttgaagctcacatctcattttcggaagcatagactccttgctatctaaagccattctgaacaaaaccttacttcagaaatactcctgctacatccatctatttctcatctttcaacaaagaaaaacgggcacctgctacgttggattctacccgttccatgcctcacgggggacagtgaggtgatggtgtcaggtgagtccaactgtgcgggggaggggagtgagtgagtgacacagagtgagcataactaaaagacagaagaattggtgctggatttttgcagtcaccagatgggcatctcgtcttccacttgggtggtcctgtggatcggcagcgtgcagcatgatggagccaaagaacctgcagtagagccaacagaccaactgctggattctttacccggttgagttcttgccacagttcctgaagaacaatgacctgtattattactatactgcagattctgcacagatatggtggctgctgagacttaaaagagggaatgaatccaccacactaggtagatatctcctccccatctctaaaatggaaagtgtgtaggagctaaaagtgatagcaactgtggtccactgtgatgggcctttcatggccagtgttggatgtggaatcggtcgtctacacacttaatagttggtcaaagaaagcttaatagttccaaacacagagaggccggagctatcgaccggaaacaccatcccacaaagcccatccacttgccaagttgccatggagtagtactactgaacctgttagagttcaggacaggagaggtgagatcaaaatgaaaacaaggactcaacaaccagaaactcatgcaatcatgctccagtggtctcagaaacaatcggatagagactgaaatacattacttcaatagagagttggtctgaattaactagctgtagtcctcacttatccacatagatccttcagctattgcattgggcaagccacaaggccggccatggcacttgcgcggttgcgccttcgcactcctcgtctcctccaaccgagattccaagttagtactctctactccctccataaaaaaaaaacgcagcctaattagatatggtttttttttaacgaagagagtagggagtatgttctaaaatatttaggaaaatatagcaaacctactctatctatagtattaggcttttgttggttcctgtataggaactgagcttcttagtggcacataaatcagagtaagcaattaatacatgattaattaattattaattattataaactttaaaaataggttcatttagatttttaagaaacttttatataacttttttattaaaaaaatgcatcatctaccagtttagaaaacgtgctaacggaaaatgagaatattgaagtttagagttggagtttaaagcggagcctaaatttgttcaagtttataaaaatatcaataacttttttaaaaaaacaaaatattgtcaaaatatattgaatattagttttagcgaaactaatttagtattatagattttgtttaaaaaaacttgattagatttaaagaaatttgattagagaaaaatcaaaacgatttacagtacgattggtggaagtacatattttaggaatagtaaattgacaaagaacaaagaaactggaggtcgagtgatcaaaatgcatgattgcaaagggggttgtgcttttgtaggctacacgggggtttgacgctggagtgcactacgagaccaaaagctgtggcaaacaatagtgcggcctacgtacatacgtgatgcttggaacggatggatgcgttgagtgtttgaccagggtttcagctggcacgtctcgcttcgctggcggcaatgattggctcgagctctcggagttgtgtggtggcgacgccgcgagcccgcgacgcaccccgcccgcgcgcggtgccgaaccgagcctggctgatatcaccgtcgcctctgccaatcggccactgggatgaccggtcaatttttggccatgtctgatggttgatggacaccgcgtgcttggccgaattgtacgaggggggagagagaggatgcacactggcgatagtggtgaattgaaaatgcccagcgaaagtgatcggaatcgcggagctaagctaggcaccagagggtggtaggagtatctttgtgccaacttgaatcttacgcactcgcgtgttaagaaaagtttggactattcaaacaacatgaatgaataaccagaaaatcagaaatcttgaagctacatggccaacagaaacaccgaatcctgttggaacgggacaagaagatgtcaccgagtggctcaaaacgtaggagtacgcgtgcttgatccattttcaactacggccgaagtggatcgacactatccttaccaatttttcacataaaccttgttccaaaacaaaacataaaccttgaccacggtagtcccactcctggtagcgaaatgtggccagcagcatcatttcccatgaccaagcaggcactgaccgccactcgcctcatgatgaggagccgatgcggctcggaagaaatactacttctagtcaacagcgccggcctcccgtggccgttaaaacggggaaccggattcttccccaagctttttctctccatcgtggagctcaattctcggatgcgatattcctcgcccacgttccccggccgtgacgacacatgtaaaacctcgaacggaaacggatggctcggcgcagagcaagcgcgcctgacttggctgtagtagtactccagtttcactctcaccggtcgaaaagctggtacgtacgcgtggccttccactgctttgccggctgtgctgctacctggagtggtgaagtgacactgagctgactcttcctcggaccatggcaggaggaggagggggtgggcagagagagaaatgtggcgagtgcggagcccgagaaacgtacggtgcgaggctggcaggcgaggaatcgtcgtcaccggggtggtccacatccgtcatttgtccgtcatttgggggggtggcctgggcaagtcaatgcggctggccctttttttatggagagcatctatcttcttccttggacgccttccgaccggtcgagctcgcgaccgaatcaccgaaatgaacgacagcgagtaccagaacgggtaaagcgctcctcgtgtttcacccggaaaaaaacaccccctatagccgggtttaaacacttgcaactgctctccgcgctgctgtgctgcgtactcctagttctgtttgtaagattagcctaggctaattttgagagctaatgtttagtcataaattagtaggctaaacattagtctaagatggtatgtttggatccgtgggttaattcaagactaaaaggtggagagagaatagaaagaggagagagaaggagagagagagagagctgtttttttatggtccccacacaaaattagccccattagcaccccttggaggggctaatgttttgaaggggctaattcacattagctcaaaattagtccacctgtttggatccttgagagctaatttgaggctaaaaggtgagggctaaacattagcccatggaaccaaacagagccctactcatttgcgttttccacattttttttctgttttccttgtcttcgctttatttagtcattgtactgttatccttttcatagctacgcacctttacgacaagaggcgccagtgtgcagtcgtagaaatgtcttactactttttttaatctattctctgattttctaataccaaattattcatttataaccttaaactaccatctaaaataaactgagtttcagttgcttgtgaatggcgaagcataataatgttacttatgcttcggcttcacaaagcagataccggatttctcatattttgcaaaaacagttggaaaatttggggggggggtttgaataaactttatttaaaaatgcactttatatttttttgaatttaactaatttcaaagaacaagttttcatctattttctctcatccactttaacatttaaacctacgaggcatctagaagcttgttcttctatgtttacagcacttgctcttgcggtttatcaactcaatcagacataaaacatctaaattttacgaaagccgagaaattatgatcgtcctaggtaatacgtacaaaagtagtagcaaaaggtgaattatcctatgcatttgagatttcataattttacaggccatactctaatcctcttccacgactaactgtaagttcgattgggcaatactccctccattccaaaatataaggcataaccacccctaacccaaacaccaagaaaataattattatcatcttatagtttggatcatcctaataaatacaatgcatgtatccaatagaattagagaatataagagtggaggatttaaaaaaaataataatttaatggagaaggggtcatagttaattgtctacatgcatacatgtcttatattatggaatatcttaaaaaaagtggttgtgccttgtattatggaatggagggagtagcatctttgattgagtaatagattttaccacattgatagtattgaccaactaagaccagtgtttgcttcatgctatgatttttgaagtatcctactttttcaactaacaaatctatctaactacgaacttgccatttccctacagtacatataactagatagtatctcttcgtatcaattttctattcgtagttagatgtacttaacatggcaaatttctatacgaaatgaaaccgtcgtaaattccgtttcttataaatttgaataccaaatccagttttcttgtggaagtttttttcctaaggcatacataattttagctctttttcttggcaaaggcaatgtattttctcgaaggtttctaaaaaaccaaaacccatgaacaaactgcaaacagtgaccatgaattcctgtttaccagtagacccacttccctactaccagtctaccacactatgacactacccaacacagccgagtaaaagaaaatggaaaaagacaaggaaaataaaatgagaaaaacccaacaagaaaaggaaatcaaagctgggaaagaaatagaccctggagagagaaagcatccatccaaggtctcagtcacacctacaacaatgcatctctaactcccccccttctccctcttttcctctccatctcccttcttaacctccccaccctcttcttcctcacctcaagtcgtctcctcttcttcttctcttcttccttcctctcccaacaccaaaacccaagaaccccacaagtgcgggcgaggaggggagggaggcattaatggagccctctaccaagcagctcctccccatgcctcagcaagaccccaactcgccgtcgtcttccacctcgtcgtcgtcgtcgtcctccacctcgccgtctcacccgcaccaccgtgcaccacttccaccgtcgcctaggcccgtcccccgcaccatcgagaccacccccttccccaccaccttcgtgcaggccgacaccgcctccttcaagcaggtcgtgcagatgctcaccggcgccgagcaaccctccaagaacgccgccacagcagcgacagcggccgcggggaacagcagcgccgccgggattggtggcgggcagggggcaaacgggccgtgccgtcccaagaagccggctttcaagctgtacgagcggcggagcagcctcaagaacctcaagatgatcgcgccgctggcgatgggggcgctgccgtcgccgaccggcaggaaggtcggcacgccggagatcctgtcgccgagcgtgctggacttcccgtcgctcaagctcagcccggtcacgccgctcaccggcgagcccttcaaccgctcgccggcctcgtcctccgaggacgccgagcgcgccgccatatccgagagggggttcttcctccacccctcgccgcgtggcgccgagccgccgcgcctcctcccgctcttcccggtcacctcgccaaggatggccgcgccttccgagtgagtgacccaaaagctcccgcctttgcgcgcgcctcaactatatcaagtaatcgacgacgagtacaactactgctactaccgctctcgctgtaccgtttctcttcgcagttctagttttgtggttgttgttcttgatctgctgctgctgctgctgtaatttttgcccccttctcgaaatgaagaagggagtttcttttttttcttctttggagtagtgaccagtgagcgattgtataatccgagctctagatttcggcttcggtttcttgatcgctcgctggggactccgaaaggatggatcaatcgattaattaagcttaattttgagcttggtgttctaactcccttcctaattctgaccggtttactgtttctcctctgatgtcattcggtttggccttctcatcggcagctattcgggggttgattccttctgatccctggctactgttcttgcgtcagcgctcataaataccagccttgtgattttgtatagtactcctacaagcaaagatctgaattctgaagtcataattgtggtcaaagttcttttgcaagtcgcgccaattcaaatagaagtatttatactgctaccactactatctctctgccaagtagaattcgatcattttaacagggtgaaagcatttacaaaaagctcaaactaccctggcaaaattttggcgtcttttttatcattcctactacacttgaatactccatttcccagtaggcagtagcagtccaaagacctgtaaaaaatcgctgtagagccagaggcaccagcaggaagacttgcgtttgtgggtggccacttgcatgggtggacagtagagaccagttgtcagcggcaagccgaagcagctgcatccatccaggcccggcgccccggcgaatccgcccgccccacgcacccacgcgcgcatctctcccgcttccgacttccagcggccaccgagccgtcacacgcgtgcgcgcgcatgtggcgggggccatcgtcgatcgggggaaatgcattgcatttgcgtgtttgcatggtcggttaacatgtcctcgtctcgttcctcgtcgccgcgcgcgcgcggttaaaactggctgtcaccccccgttgatcgaggtgattgtacatgtgtcccatgatagggtttgccagaaaactggtacagtacttcgtatgattgatcgagttttagttattataaacttaaaaatgtattttaaatagtttttatgtagagagtgtgtttgtgataatcaacatagaatttgtatgttaatcagaaaagaaaagaacgaacataaaacttacacattttggcctgcacgtatgcacacggcatttgttttggccgacggaacacggaaatttgtgatgctatggttcgccagaaattgcatatgcactatgcagtatgcaccccgagcacagtatacgccatatgcattatggaacgggagctatcagagacgcgacacatgccatcctttatttcatcagtaaaaaaaaaaaaaacagaggagggacacagtatttcaaagggggaaaggagaaggggactggaaagtcaaacccgaccgagagcaaccgaattaagttttcgcagttaagctgcatatgccggcctggtgcatgcaccggtagctagattagctcgaccttgtttgacttgtctgcaccggtggatcgtcgcgcagcgtgcagtagctgtacgtagttgggggatccagtgcttgtttaattagtggccgatcggatggatgcgagggccatgcatcttttctcctcacatgttactgttcataaactaatcaggatcattagttactctcatgtgatgatgcatgatgcatgggggcgacaattaaattcagggctcaggactagttaaggtggggcgccatgtggtgtcatcaagtccgtaaagcatactgagagagaggctaataatataaccgatctgttggctataagattatttgtagttgttttattccattatctaaaagaaatccacaaaagttacacatattacacattttagtttttccaaataagttgtttctccttgtagtctttatgcattcaagacttaaatgaagagataaattaaatgttttattagaacctaaggagtcatctaaatgtttattggttgcatgcttgtattcactccttgattttgtaacatttaaggtgatttaatttttttctgatcttggtgtcaaaagtaatatgtgcaacttttatggatagagagagtaatagttagctctttacaattaatatatgacacactcgtctctcttacagagtttcttagttcttgtgtctaaggcggctgtaagtttacagcccgcttcttctctctctcctctcttttctcctccacctcagcatttagccggcttatagcctactattatacttgctctgatctgcttgtttagttcttccggcgggtcagccagttcacactggccatgcgattaatcaaccgcaaattaagctagttgttcacaggaagtaaaggaaagagcggcttaatacactagcaaatgggtttgcctttgaacagagaggggaggcgtgggtcacacgatggatggagaaggggtcgcggagtcttttctttcccttttagacgagaggtggccatagacccccccc

SEQ ID NO: 81265 - DNA, 13619 bp, Oryza sativa
  unsure (1)..(13619): unsure at all n locations
cgaaaattagaccgcgagagaaaaaattgtcctcccggaattaattttgagtggttaagtcaactcaacaggtgcaacgtaacgtacttacgtcttagatggagtttatttctccgggttaagcatgtcataaaggagagcgtgtagcagaaaatgtgaagtagaagaaaatgcatgtgagggtcccctttttatctgttcgaaatagaccgtccccgtgcaaaatatcagatcagacttgcatgggtgcatgcgtgagtaacatgtactccctccattccctaataacacaaccacttttttctcagatgtttcataatataagacatgcatataagtatacaattaactatgacatcttctctattaaatcctccactctcatgttatctagttctattggatgcatgaattatatttactatgatgatcgaaacttcaagatgataataattatttcttggtctttgggttaaggatggttgtgtcttatattttgtaatggaggaagtataatttacatcaacggttaaatatagaagtagtactagcaaacgacatggagtatttaaaaaaaatactccatccgtcccataatataagggattttgagtttttgcttacactgtttgaccactcgtcttatttaaaaaatttatgtaaatataaaaaacgaaaaattatgattaaagtattttggataataaagtaagtcaaaaaaataaataataattctaattttttttaataagatgattggtcaaacagtgcaataaaaactcaaagttcttatattataggacggagagagtatacagagagtgagagagaaaaggtgaaaggggaaagggaagaaaattacaagaacacttcgttggctcgtacttccgtgtgtagaaacacactcctaggcgccgtttcagatgtgagcaaaggccaaactatgcattccgagacaaagcgcttctgcacccaaccctaacgaaagagttgtgaccgcgcgcgacatctcgctgccttccgatcgatcgacagcaagcagccaatgcgaccgaccgaaaacccgggtcgcacggcgctcgctggtgtggattgtggattttgctagcgcgcgcgggatggaggcacacggcacggcctggcacgcttagactaacacgctcgcttggtcagatcgatcgcacgccagcgcgtggattccgggatgcgtggctccaaacgtcctggttaagcccgcgctgcgctggaacggatcggatgatttgtgttgtgccggtgtgtcggcattgtctgcgttatattttctagcaaaaccatatatatccggggaatacatccggaatacagggaatgttatctaaaaaggttgtagggaatataatattctactccctccgtttcaggtcataacatgttgactttggtcaaagtcaaactacttcaaatttaactaagtttatacacaaatataataatatttataataccaaattagtttcattaaatcaataattgaatatattttcataataaatttgtgttgagttgaaaatattattattattattttctataaacttggagcagtttgactttgaccaaagtccaaatgtcttataatctgaaacgaagggagtcttttattaggtttcgactgaacttgtaggtgaaacctacccaatttaaatcttaaggttgacacggatgctaacatttacaccaatagtcgacaatgagacatcaatggtaactttatcaatctcaaaaatacgtgtatttatggctacacctatgcttgtggtgactttaccaatcttaagataagccggcccattctcttgaagtaggatgctcgtgagtatgaacgtctatgtctatacttatttttctttttaaaaaaggtattatatatagatcttcctgatcttaaaatttttagccgcagcaacgagccccagcttgctctcttgttggcatgcatatgctattgattctaatcgtgtccgtgtccgcgtccgcgagtatctatggcggtagtgataggttcgaacttaagtaacgtagggcaaatgggaggctgaaacgtgtgagggagagctctcttgctagctgcaccttgaggtcatcgagtggtgttaagttgactcttattttggcctggaaattttcggttcaaacgcaaacgtcacaaacagaacatcaccaccacaataccacaaaaatgtacacaaacatgtggtgtaacttctcggttagatcagatgacaaagcatgaaaaaaacctacaatgaccacgttatttttagcagtattatttacttttaacattatgccatccaaaggatggcacgtcctttcatggctacgtaaaatagtctcgaatcctccgagcaggtcaagtcttcgttggcgaacaaggaggcaatgcgagtttgctattggcttaggacaggctaaaggcaaccattgggtttgtgtgtgttttaagtatggtgagcgtagaatccaaggaagctttacccatattttagagccggagtcaattttgtcgcaactaatcctgtcgtgcaaatggcacatccggaatgaacatctttctgaaggagctgctatttttcaacgagatggattggtaaagaaacaagaacttgattaaaaaaaaaccacagcctggagctagcaaactgagacttggcattgcatagactagagactaatcaaggttatcttcatgccagaaagcacagcaccacgccggctcagagcaaacttgcggtgaaagggtccaaattaggatgattctgctttggaaagggtagctcacacttacacctgttccacgtactcattcaacccactaacaacatttcaccgcaaaactcactaacagttcgcttttaagtcaccgtaccaaatgttcctctatctcttgaacagtcccagacctctaaacaaccaaaccatcatgataaaccccatttggtcaataacagcaaatgcctagacacgtatcatccaaaagcgaagggattgcaaaatggactaccattcagataggggaactagatgactatcaatagcttcgtagtttcaaccttctttttgatgaattcacgaggttagcaaacgttgttgggcatctctagtccgctataaaacagaaatgtatcaatatttgaaaaagaatctccaagccacgggaacatgtgactgagttagtaagcttttggcatctccttcagaaaacggcaaggtagctgtagctatagttcctggtcaattaattggtgtgcctaaaacaaattcttgtctctttctctctcttctagctctaaaagaactcagtgttaaaaaaaaaaactctaaaagagctcctcgtcacaagctgtcaagttacatttaaggtccaaaaggttagatacagttacaccacactcaaagaacaggcatgtgatgtcctgcttttaatatggtactagcagtatcttaatagatcagacttgatatctcagtgagaaaatacataaatagaagaaatatagtgttcttaaggacatgctgaagactgaagagtcagaacagagacaacacattcaaagactcaaatggcatccttagcccccatatccagcatgattgcatcagatgtaataattcggatcgtaataaaatgaaactatagcccttggattttggtgtgataccatttcaattgtataagtattctgtaagatgctattgttataactttttggcagttaagccttcatgaccattgtcaccatcgatctttttcttactcctattccaaaagtccagtgatgtccaaatcatatgcaactacaatctataagagaacaagactcctgcaccaatttgcaacttgaaaaactgaatcttgtgaattgtgatagttttgtgatacaaagaatagccgttgtcatttgtcaagctttttagcattaaaagggcgctgaatatatgactagtcgtcatcagttttcccaataaacagcttgcctccatcttgtcataatcgaagtcacatgtttcatggttggccatggtagcacttgatcatatgaatatagaataggctacgttatgcagtaggcaaagttaggtaatgaatttgcgaaactccttttggttttaaaacacaaaccttgttttttggtctcagagcagaacaagccctcacggaagttgcagttaaaaaaggatttgagtcctgcataataatagacccatatgaaaaaaactccctcatcaaaatatatgagaaattatagacgagtgcaaatctgtagtacaaatttaagcatacacaacaacaacaacaacaaaaatactatttcaataatatagagtaagctcttttctacttctcaatgatgaatgggtgataatatgaccacattaaatactagaagcaacctgtgagcttcttatgtgaaagtctggatctataccaatgagctatataagtggacctccgagaaaaaaaaaatcctattcaaagctgaagtagtaacttagtgaatatgaaaaatatagtaattgtgacatttttgctatttaataatccataccgttcatttgagtcagtaatcttgagagatccatttatcccttgcaaacctacaaatatcgaatcagctcaactgcgtactttcctttcctcgtagtcacaatttccccaatctagagataaataataaataatttaaacaagtcaagcatagaactggttgatatagattcaagtgaatagggaattcataactttttaaaaagaaatatacatctagtagcattcaaacatcttccatagcatgttatattccctcatattatgtatttgcaaattaacacataatccttgattcataaaatcctattttcagcaaagcaaagcatttactttatcgatgtacatctggaggtctgatccacatagttcttgcaacattagtctaaagtaatatgcagcctataggacagtctacaacaatgaagccgttatgacaattgctcagaatgaacaaaaaagaagacgacgccatgaacatcacaacatcagtacacagtaaaggctgtggctttattatttgaaacttttgagctcatagtttcacaacaatacaaaatcttatagttttggatgtattctcaggttgaaacaatacaaagcaaaagcagaatggtatccaacttaattgatgtagtgatttagatccaagcaccaatatatttttgtaaggaagtaataaatatatataacactccaaaagttccatttcagaaaaaaggacatgccctgtgtcacaggcatgtggcccaagacctacatgccaatggcgcatggaatgggaattcttgaacgtcattctttggagtggcaaacacctgaatgccccttttcccttaaccccattcgtggaataccttacgcgccaattgcaacatcaaaatttatcctagaagtcgtctattaatgtggtgattgcatataattttttacctttaatctccccatcccactgacagaaacaacatccccagccttgagagtcactccatttttcgaaactggtgaccaattcacacggacatccccagcactggacaaacaaaagagagatttggatacatatatcaattgctttatgagcggtaattaaacaaaataatgcgtggatggcaccatccaaggtagaagggaagataacccacagtaaaccactgatgttaagataaagagatgttttaatgaacctaagaagatggatagctcacaaatcttacctgatcaagctagcaagctttgtacgtgagattttaaatcctgcactacccagggcatcaaccctgagtgatgattctacagttttaaatgacttggtcctgtggttcaaaggtacttttaagtgttgagtatctttgtccaggcatttatccaaaaataaataaaaatgagccaactttgagatgagatcagatgtcaagcaaaccttggtggttcatattctagagcaagcaaaggattctgtgtgcatgaaactccaactttctccacctgttgaatcaaacacaattcagagtaagctgcatttgcaagggtttgaaataacaacaaaaatacagcagtcaaagttcatgggcagagttagatcaatacaagactaacatgtaactaatctagagagttattctacgatgcaaataacctcaaaaatattggaacatgtgctgctattttaaatgtgctatgagtaaaaaaaaataataaaaaacacagtagcttcagagcttctgttgtctgcatagcatgtaatcaacataagtgaaaacatgtggggtaagataatgttataacttctgtagttctgtgtcatatataggtaagaaattatataacatatataaactcaccttttcaagtgtggaagtcagatagtcaacaagttcaggatcaacaaggacctgagcacctctctctccctgacaaaaaaaaaaaagatcacaaagaggcacctcagacggacaaaagtcaaagttcacaacacaatccagaaattaagcgattgggaaggcatgtgcacctgcaaaagtatatctccaactttatcccttgttattcctgtcccaagaatagcaccaagaaagtcaccatgagaacagggttccaatctgaaattccctgagatgctgagaaggcctcaaagttagcttatataaaagatggaactgcttatagtgcaaatttgagagaacctcaaagcagcaactacatctgggttgcttgtcatacagtccggatgtccaactgaaactcggcatcgctcagcctagataaatgaacaggtgagagtgggacagattaggtaatggaagctaataaaacaatttcctttgatgttactcaaattcacctgtgggtagcccccctgtgctaccgctttgatgtctgctaacttctcaattgccagcatgcactccttcactataggtggagtaagaaaattggtgtggaaaacatctctccgttgggaagccctttgtgcctgcataagttggataccatcataaattcatgaagttcaaggcaccatatcaacatgaaatactgcacttacaacttgaaacattcttattttgtggttagttacaaaagcaaactagttcaatgttgttgaaaggttatgtttgcaatcagcaaaacaatagtgagtgaatctgtctgatgtggcaaactactaatcatatcttgtttaaatgtcccttagctgtttttggctggtgtgttattagggatgctttgaatctggtttctttacctaataatctatgggagtgtatgagtctgctcaaagataggaaaaagtttaaaccttggatctctttaattgggggggtttgttgggctatttggatcattagaaacgactgggtgtttgaaaatattcttgtcaagtctcccctttatgtggtttataaatcgctctctttcatacagaagtggcacattttgctaaaggaggaagaccaggagctgctgggaggatggtgtgaagcaatcaggataaaactgaatcaagtcaggcctcatgtgctacctgcatcgctatagaatagctttagcctgagtttcagttttttctgtaagggtgtggttaggttgggagtacgttccttttgtctctggaaaactggtttccccagctatctttttgtgtttcttttattttccagttcttgtataagactctgttattgttcttgggcttttttctaaagccgggtcaatatattgatctgccataaaaaaaaagaaaaaatgtgtctgatgtgccgagagcaaaacaactaaaacacaaagcattttctttatttccttgagaccaatgtgctcatagtggcaaaattcactcgatggagtacataaactgaagctcataattgtttgtgaaatcgtttatcagggtggggggggggaatgatttaaccatgaaggcatttcatcagacacaacgtccataagcaacaaattgcactcctataaaccacctaatctagtaatctcaacaagttgatcttaataattgaggtttaatggtggaaaacaaactaccatatccaggatgctcctgagttcctcggctgcattcctatccaagctcgccttaaccgccgaatctcctgctgctgccgcggcgaaggagagagccgcgtgacaccgtcctgcaccacaacgagccatgggtagccaagcgtcagaatcgtcggacctaaccggaatcgaaccgagcggtgggtacggggcttaccgctagggaagaagtggtacgatgtggggatagcgcggcgtgcgaaagggacgtgaaggactcgccggaaagggctcgccaacgagacggcggcggccatccttaccaggaaccgatggggctgggcgccgtcgtcgcctgctcgttctcccctttgcctctgcccggcgggcgtcggctttgagcttaaccgggttcggttcgttggtggcaatagactcaggaggcacgaaccgtcagatttgcttcaagattcgcgcgcggatttccatcagattttgagaaggcgaagggcaccggcgccgaaatgcgcccgccgccgccgccgcgatgaccacgctcctgcgccgcctcctcttgggcgccaccccggccgacgcgttgctcaccggccgcctccccttctccacctcctcccgccgcacgccgcaccgcttccgccgcagccgccgctccccgaaccctgcgccgccctcccctgaagccgtctccgcggccatcgccaccctcccgtcccgtctcaccccgcctctcctctcctactccctctcctccgtctccgacgcccgcctactccttccggtcctcacccactcccttcgtctcgccaccttccgccctgacccgggccccttcctcgtcgcgatcaagcgcctcgccgccgccgatctctacgccgatttcgaccgcacctgcgccctcgccttctccctcctcccctctctcccgtcccccgggcccttcctccgcaccgcgctctacttctactgccagttccgcaagatcggcaaggcgttccacgtctacaccctcatgcgcgcctccgccgaccccgccgcgcgcccctccgccgacacctaccacgcgctcttcaccgcgctcttgtcccgcggcggcggcgacaccatggtgcactacatgtacatggacaccgtctccgctctgttccggcagatgctggaggagggtgtcccgccggacacgcgcgcgctcaacgtgctcgtcaagggctacgcgcagtcgctgcacctcaacgacgcgctgcgcgtgttccaccagatgcggcccgtctacggttgcgaaccggacgccctcacgtacagctacctggtgcacgggctgagcgagcagggccggacgaggaacgcccgtgaggtgttcgatgaaatgctggccaaggggctggcccctacggagccggcgtgcaacacgttcgtcagtgcgctggccatggcaggggaggctggggaggcggagcgtgtgatgtgggacatggctcgggcgggaagggtggtcgacgacgtcacgaggagggcggtggtggaggagctgtggagatcggggaggagggacgacgccgaaagggtggtgagggagatggaggagcgaggcatcgtgggtggcgctgagcggagagccttgctacgttcgctgcacgatgagttcggtgacgacgatttggatgttgatgatagatggcggaacacaaggtgattgtctgacagatggagagttgagaagcactcataatccatccggccatccatgtcccaaaaacatggcaatcaacattgaacactactaaatgccatgagatgtaacagaaaattttgtgataaagtatcagtaaaattcatttgcaatgatataagggttaactgcaagattgatatttattcatcattatcggttctgtgatgtctgaatcaccaatataagtttacactgtgcccttctagcactcgatcaaatgtatacaacagcatgacaagcagtttcttcattgcttacttgctttcaataagttcttctcagcaatattgcttcgagaattccaaaaggggaggctgatgagtgatgactggaaaagtttgaaattgattcttacagagttggggacaggggaaggcatgataatataactccaggaatgttctcccccgaccccaagcataaatttattctgtttactcttcaagttgatcggatggaagccattcgagggtgttgccagtaaacataggcacgatctctcctgaactatatgagtatgtatcaggtactttccaggcgctctttctaaggacaatctttgaagtgttccttggaaggccataaaaatctgggccattgaagcttgtaaatgcttctagcttatcaagagcaccggcctgaaatgcaagatatttcaaacaaacgtattagccacaatgttttctcagcattttggctattataatcatttgcaagttacactacaaattcgtggttttgtgatgcacttaacacactttgtctttacagctaactgacttgcaagctaaccccgatctacagcagaacgtctcttaacttaaaatataatctttcctatttatcagcgtgagagagaaagagagatacctgttcgaatactttcgcataaagagaaagagccacaggagcgctatatattcctgcacaaccacaggagcattcttttctccgtttatcatgaggagcactgtcagtaccaagaaagtattgtttactcccacttgttaccgcagacacaattgcttgtcctgagataggcaattcaaaattgtttagcataccaagttctccctaaagcagaaaagtggaatacaaacatatttttggcatgacatatatatacacaatgcaagtacagtgttgtcatagatctactttttcattaccatttaaggaacatctgggtcaaaggtcattttgttgaaccaaagaaatcttaatgtgcatgtacagccaagtttcctctatgttttgcctatacgattgcgtgtaattatagatatgtgaatactagatcatgcaggagttaggggagtaggacaattggaacatactatgagtttctcttttcagtactggtaagcaatagttgtgtggctgcaagccaccctgaaataacgcattcctgttgagaagaagatgttggggagtcaccgttgcagcaacatgacctgatgaaaatgaaattttagaaccatagatatgcacagaagtataatgctattgtagtggtgcacaccttctttgcatgattctacgaagttaaccgcatccatagtggtgatatgttccataacaattttcagctgtggcagtctttgtacaagtggtgccaatattttctcaatgaaaaccttctcacgatcaaaggtatcaacatgctgatctgtgacttctccatgaaccttaaggaaaaaaacaagggcataaggtcaattttactatctatacagctgacaatgcaagaaagtcactaattagaggcaacatcatttcagtgaattaggcattgtcaaggaacaaaggcaagtaaaagtagcattccgaagtaaaagtaggagaaaggatcgagacatgaataagaacttcaaaacaaatgggaaaaatatatgctgaaagaagagcatcagaactatacttacaagcaaaggcatctcctgcctagccatttcctcaagcacaggcaagcacttcccaaatatatcagtgacaccatcttgggagttggtagttgctccagaagggtacaacttcacagcaaaaaccacgccactcttttctaatgtcaatatgaaacaatatgcaacataaacatcacatacaaaactctgcaaccgatagactgggagaggaaataagaaggcaacatttataatacggcacttttaaatcatgatggctagtattttaagaacgtcaagtttgttctagcttctaagagatacaaatgcgactgccaaatcactgcacaagtgtacataagcactgagcgcgacaaatagacacttcaacttacagtagcaatgtagctaatgaaagaacggtgttagtgagagttcgtacttgcgagcttgatctcctctgggctagtattgtccgtgaggtagagcgtcatgagcggcacaaagttgctcccaggcggcagcgccctgaggatctcctccctgtactccaaagctcgtgctgtcgtggtcaccggtggcttcaggttgggcatcacgatggccctcccaaaatgcatcgcgctgccaaacagcacgcgaaacgatcacgcaagcagtcaccagacaggccacctctctgagacattacatcgaacactaggcgtgcgtcaccaggaaaacaagccacaagcccacaacaccaatcagaccaacctgtgggggagcacggccgcgaggacannnnnnnnnnnnnnnnnnnnnnnnnnnnnnnnnnnnnnnntgatggtgagctcctgcagcggcggcggcgacggcgacgcggccatggcgatcgagatcggtgtcttgttccggaaggagggaaggtggactagggccccgtaatgaggcgacggccggaggaaaggtccgggcaaatgcttcacatgcgggttcgcgaagaaggtggaggtcgcggcggtctgcattgatgattgggatgatgattgacctcgctttatgccgattccctcccgtagaagcgcgcgggtgtgtgcccgtattgtgggagacggtcccgtgggaaactgggaggtggagttcggtttctgagccgcaactgctcaggtgacaaccggacgcggctctctcggcggctccagtttctttttttctttttttttttagcgcagcccccacgggccggcttctcttgaccctcagatgtgactgaaatctaattcatggccctaaaccacaaaaccggatatctcgaccctcaaactcctaaaatcagtgcaatttgactccctcggtggttttagagggcggttttgctgacgtggcgcctatgtggcgatattgaccgagtcttcgttacacgtggcgttgacgtggcacttacgtagcattaaaattaaaaatatatatgggacccattagtcattcacacaaaaaggaatgtggggcccactcctccttccttcttcctcctccctatctccctcctctctctttctctccccttcttcccttcgaccggtggcgcgcggcggaagcgagcggcggcctagcttcggtcagcggcgggtggcgagagcgagcggtggccggaggacttcggcggcggcggggccttcccgaagaaccacgtcgcacagtacccgctcggcatgggccagcgcgacgagaagggcggctcgaagatcctcgcgctcaccgtcgacgccaagggcagtgtcaccttcaacgccgtcgtcggggtccgggaggcggacgccgccggggatgagatcctccatcgtgagggagtcgagtggcccgtatgccc

SEQ ID NO: 81266 - DNA, 16188 bp, Oryza sativa
gagggaaagaaaggaccttgcaatcgaacttgtccttccacttggcggaggagacgggtgtggagtggaaggaggacgcggcgagacgcgtgggatcgacgaggaggtgggtcgtccgtagcacggccctccatggcgccgcggcggcctgcatcgtagcggagaagaggggaacggatatggtggagaagcaaaggaaacctagctaattaggtagcgtgttcgccaactcctcctcctaacccgccattgaaaattggaagcatcttctgctacagtatattcgattctccctctccctcgccgccggccggccgcccgccgccgcttctcgatcggaatctcctctcctccgcgagaagtggaagaagaaattaggttgccttggtttaggcccatctgcctaattcaagtggatcttttatgggccgcacagtctggcccatgtgcttcttcttctctctctcgcttctactttgtcccggattgaagacttcattctcactaaaaaaatgaaatgaaagaaataaagagcaactactacactagcaacagaaatatcggatgatgagaactgagaagagagcatacacttttttgttttcatatctgagttaattgtactgtttttcccgtttggtttgctgatgatatctatagtgggtgagaagttgagggtgcttgcctaatttccaccaaactggcctttcttttgttccaacttatcaataacggttggccacatgcatacatacagaacagctagctagctaatatatatatgtgcattgcatagttatagttaaaagggaaaagggaaaaagggaaaggtagcaaagcatgatacctagctagatcaatcgatcgatcgatatatccataaggcatcagcctagctaactgtctggagatgcctaagctagatagctacatatatactgtaatgcactatccattatattgcaccgtaattatatactataagatgagcttttcatatgcgtcgattagtcgtgtatgcacagaaatgaaatgttatagtgcgtactagctacaaaattattaaagatgcatatatataagcctgcactcgatcagcactccggcctactacatgtttttgtggtacgtaagtgcgtcgctgtcaaataaagatcgatctagatctgctatctcttctagtaagttgtacgtatctatcgatcgatccatcaaggaacactaaataaaatggtgtttcttatggccgattaattagagctgatgtttcttatggccgattaaaatggacggtctgtatagctagagcctcgagataaagtatatagcttcccacttgcatctagctaattatgaaattaagtcagtcccagatcatgcatgaaacaaacgtacacagactctacctggagatcatatatataatatagatatatactatatatatgcacgtactaaccagctgaatctattctttcccatgtttctttctttctttaattcagttttctttcatcaaattaataaagttaattagtgacctggtcaaggctatggtacgttcagtaaagctgctttaccaatacccggaacctagatatgtgcatcgtatacacacgataattgttgggaccaaatgtcatgaagaaaatggggatagctagctaggccggaaaatactcttctccctgtttatccataagataaaagtgaacccgaggagtattcattggtactcatcgctactgtctcggtaaaaatataatctggtcttgctacagaatccagatggcttttatatagcctttcaaagatataatagtatatatctatattattatatagcccttcaaatctcagtaaaaatataattctgcacattaggacgactctctggacctctagctagtatcagcgtgtagaaatggttggagttgtccccctgcacctactaatggaatattaccgccgggccacgtagctatatatcaggcctcctcctcagcctggcaagttctatttgccctcctatagcaagctcaaatcccttctttctataaagttaaggtcaaaagcttaaacctcgtgcttccacgtcatcatcaaattatgaaccgttggatgaatacattagatcgcttctcagacgttcgatggaatgcagcatagagcccaacccatgccattagccaccggatgagtctcttcgcctcctcagtgccaaatgtggcccacatgaacacattggcccatctccacacacatctacatgtatccagcccatcaatccgcataaaagaactttatggctgaacacgtcttcagttgatatgtgctacctaaattatctataaattttggatagggttgctaaaaaaaatttctccaaaaaagctatttgtttctgccgtttcttcttaagattgtacctactatgtaacaaatgtgcggggcattctctagtaatatatgatgggtaaacacccagactcgaataggatttgatgggtaaacacaactttctcttgaacaacttctcttttgccttcatctaaacctgctagggaaacttcaagaagtattagccgttggttaagagtagctcgatgtcgtgttttggtcgaatacgtgaggtgtggcgtctagcctctgctacaataataatatattgtactccttaaatataagagattttggatgaatgaaatatatcctaatactactattactatgaatctatacactgtaaaaattcatagtacaaggatagtttgccggcccttccaaagccagcttgctagtctacatcaaattgaggggaaatgtacagaatctgactcaatgaaatgtgtttaatagtgagtaaaatctacacctcccaataacacacttgcgtggaataaagggatcgtatttttttccaggatttggttctgatgtcagcatatcaatgcgccattgctagctagtagaatatatgccgtttaccctggaactgatctcttttgtggtacgacgtgcaatactataatctctctaaaacttaattaacagggtaacctttcttttcatacggcaaacttgtgcgaataaatgatgaaaatggaggagggacctatgcattctatactctctttttttttcataacttattactccctccatccctaaatatttaacaccgttaacttttttaaacatgtttgaccgttcgtcttattaaaaaaattaagtaattattaattcttttcctatcatttgattcattgttaaatatacttttatatatacatatagttttacatatttcacaaaagttttttaataagatgaacggtcaaacatgtttaaaaattaacggcgttaaatatttaggggcggagggagtaattaattgcatcattcgtggctcatctcatagcatgcatactgcatactatatactagtacgaccacatatgtcgaaattaaagcggttgcaacttccctgaaagccatgggatgaaagctactggtagcacagcatgaagaagaagacaggaacaggaggggagcactttttgtttgaggcagacaagacgcatcgttttcatgctgcaacctcctatcaatcgatctctcaatgcacgcgcgcgtgtactagtgttatccatgtttctatgtggtttcatgtaagtaatctgcgtctatttttttctcttcttggcatgcagttgtactgctactagtgtggtagtatgattgattcaaacacatgcatggtgccacgggaagaaaactagagatgtcgtgtcacctttttttaaaatggggaaaagcagaaatttaacatcggtcggtcggtgtgtgtatcgtgcgtgcatgaatgaatgatgtgtataagcaagaaattaagcatgcagtggatggatggatcatcatgctgaatttggtatttgcaacctatagctcgcaagttaattaaagtcatgcgcgcgacttcagaagaagatcggatcgagcaaattagagcacgagttatggaatcttcacgtgcatcctagctagtccttcgtgttgattggtctgttgttgtttgatttgaataccatctcgatcgatcaccaattatgtacgtacgtatgactaacaaaatcacccggccggccggtcaccatgtacgacgacaccaccccacgtacgccaggtagctatagcagctattgaccaatgaccgatgactaaaattttgtgcacttactttaatacaaaattgacagttagactttaagtgattttgattaaattttagcttaaacgtcaagcatatataaccagagggactatatattatcaacaagatacatgtagacacctagccatgtaagagaacatgtgcatgctatattcatatatatgtccattattttcttcgacaaaaattggacgaagattaagattttcgtggcacactttttaaactgctaaacggtgtgtttcgtgcgaaaactttctatatgaaagttgctctaaaatatcgtattaatctattttcaagtttgcagtaattaaaacttaattaatcatacgttaataccacctcgttttacataaaaaaacataatctttatatttatctttaggagaaaagaacaccacctatggtagtataattgccccacaaaatacactgtattataaactgtcttttctttcccactgagctagtagctcgcaggagatgtcggtcactccataagttttaatcctttttatttttacacgagttaaaaaagacacgttagtacaaaaaatgaaggattccgatcacgggccacacgtgacaattgattttcactaaaaaaaagaccttttacgaggcctgtcctatttttattgatggccctcttagaatcccacctaataaattctaattttcacagagaacacccaaaaaatattgcctgcacactagaaccgcattaaaatagagcgccgcacagtcaaatacaccaagtccttccttgctagctctcactccctccttttctctcccctctcttgaccataatggcacctcctcctttctccagcttcccacctccgaaacgatgctaccagccttccttcacgctgtcctcctccgctctagtcttcctcttttgttgccctcgtttgctgcagaggattggtggccaccacgggtcatacaacacggttcaacggtaatgtgccagggaagatcagatctagcggctgttaatgaccaaatttggtaaattctatcactattggcgttgaaggtggaaatcagatcgaggtggaatccaagatgaagatcgttgcggaaacagagtaagaatcgactgtagtccaaatcggctaaggtcaggttggcagagttcgagtcgggcggggctagccgatacagccgattccgataatatgactcggcgtatgtcgtcgggttcaagttgatgtgcttcaaagatgactgccacgcatggatagagtcctaggaaggcaattgtatctattaattaggatattttgtgtaattttcttagagatatgtttgggcaaaagtctgccgtaaagacttatggtatcttagagtttgttagagataatagtcgtgtccgttatggacgtatcttgtaattctcgggtataagtagacccgagccctatgcaaaaaaaggactcatccaatacaatctcggcgcatcgccaccctttttgctttacttttatttcgacgagttcgtgctctcgggttgagctgcatcggtttcgatcttcaacaagaggtaaaacttgtcatgacgatttatgttatcaggattagtgcttccatccttatgatactctaatcttgtctatataattcgtcgagttatcatatatctcacataatcttcgataatatctctatctaacctataaccggctaacatctgttaatggaaggcagccgattaggttagacaatgatgttaacttagattatgtgatatatctaccactctatgaaacttccagcggcttgattgtctagatattgttcttcttttcatacttaatgctgcatcagttgagtttgatctattaagtcgtgcttagatttgcaatctctagcctgctttctggttgccgattaggtagtatcggagtttcagccgatcttatctgatttaactacttttattctatatgcttgatctatgtgttaaatctgccttttatgttaggatcttgtcgcatctaggtatattagacttatgtttggtatattctacttgctttaacatcttaatatagagtggtatcggagtattagccgatacatgctagatccatttgatcggctatgatataaatgtatctaatcccactattaatatatatttcgatttaagtgatttatactgtctcggcaaggcgaccgatccatcccaatcacttgatttaagtatatatcgatataaggattatatatcattaatatctatagccgatcgagtagatttagttctgatttgcttattgatatttgtcgatcgatgtacgcatgacatcggcttgaaataaatgatatgtcatcggcacctagccgatcggctatcatttataggattaattgcggtttctttgttctatttcttgttgattgcaggatcaaatcaactggcacgctcatacacccgaaggcgagttttggacctgcactggagttaagcagatctcccaggtctcgtgttttctgtcaacacgcttttggcacgcccagtgggacaaattagaagtcagaaatcaatcttcctcatgaccgagaagctaccaccgtcgccatcctcggctagtccgggtactgttaaagagacaatccaaaggttaggatttaacaaagtcaatgaagggaatattgtggctgttgatccggaaaagctcacacctgaccagaagaaggatttcgaagcaatgatgcaacaagcacgagaacagttcttcaggtcattcacacagactcgcaatggaacatttgttcaaaagtacaaggtaaaggtgattcccgatgagccggagaccagtatctctaaggaaggagaagaaaaaagagttttagatggctcggctcaagagaatcagggtgacggctctcagggggtacatgcagttcaaggtgatggtgcttatgagccacaaggaggaaatcttaatcagaatggtgagacagcacaagatttcttcaacaagatttcttcaacaatttccaagatcgagtggactacgccgtacacaacggtttgatcaatcaatctggagtgttagtcaacaccttgtctaacatgatgaagacgatagccgatgggtcaatagccgagcatcaagctgcaggcccggtctacttgccgagaggtgtttttccgaattatcgatctttgattactgatgttcagccgcttgctcaggcagttcttccaggtgcactatcggctcagccgatggcatcgccattgacttctttgcctgctccatcagcgtcgacaccaggtcagccgattaatcctcggctattgatgagggagtagccacagcatagcgggcagacggtaaatcggccagcacaggatcaggtggctgctatgtttccgcccctccaatctactgtcaattcgattcaacagactccactaaggcaataggttgtaccgccagttcagccaacagctccaggacaacaaactatacagccgattccgcagcaagccttgatgaatcaatcggctgggcaatcggctggacacgccctgaatcaggttgttccagagcatttggttcaccatatacagccagatggtacgatgatgcctcaaattgtgccggagcacttggtgcaaagtattcagccaaattaccagaattaccaagggggcaatataaattatcaatatcagcctccttcccctcaagttcagtatcagcaaggagggctaacccaaccccagtttgcttctcaatataattagtttgaaccaatacagcaacaatcgcaaggagcagttcaacaacgaccatgggccgatgtaattgccgatgtgatgagagaacaatttgggcttaagccgagagatactggaaaattgtatcggcaaccttaccctgagtggtttgagaaagtccctcttcccaaccgatttaagagtccagacttctccaaattttcgggacaggatggtgtgtcaacttatgaacacattagtcgatttttagctcagtgcggcgaagcatcggctgtagacgctctcagagtcagattattccgattgtccttgtctggatcggcttttacatggttttcttctttgccgtatggatcagtcaatagttgggctgatttggagaagcagtttcatagctatttctacagtggagttcatgagatgaagttatccgacttaacggcaattaagcaaaggcatgatgaacctgttcatgagtatattcagaggttcagggagatgaggaacaagtgctttagcttaagtttgactgatgcccagttagccgatttggcttttcaaggcatgattcctccgattagggagaaattctcatatgaagattttgatagcctgtcgcatctcgtgcagaaggtaatattgcatgaacagaggtctgcagaggctaggagaagctctaagagggttaatcatgtctgcccttacatgtatggatcggatgatgacgacgatgactccgaaatagctgcagtcgaatgggtaaggagtaaaaaggttataccttgtcagtgggtaaggaattctggaaaagaggagagatatgattttgatattaccaaagctgacaagatttttgatctgctactccgggagaagcaaattcaactccccgctggtcatgtaattccatcggctgaggaactaggcaaaaggaggtattgcaaatggcataattctggatctcattctactaatgattgcaaggtctttagacagcagattcaagtagccattgaaggggggaagattaagtttgatgattccaaaaagccgatgaaggtcgatggtaatcctttccccattaacatggtgcataccgttggtcggacagccgatgtgggacgagcgagaggttttcgcgtgaattcggctaaaattataaataagtatcagaggaaatgcgacaaacaacaagagaggcattatgaagaagataatgatggtttcgatcctcattggaattgtgagttctttcggttctgctggaacgaaggaattaggttaccatctattgaagactgtcctgggtgcagtaatattacagagagttcaagccgattgtacaaaagaggcaattggctgaagcaagccagagttcccgttcatcaaaggttgggcccggtaaatcaaaatgattacttggagggagacgagaacgcgaagactcagtggtgtccttctggtatttttacaaagaatcagaaaagaagggttcaaaggttgaggagcagggagcgctttcaggaggtcgaacaagaaattggtcatcggctgaggaaagcaaagccaaggaaggagtggcatgttaagaatcaagttcttggagccgatgatattgcagccgacgaagctaagaggttggcaaaagggaaaagtattgtaacaacgccaattaacatggtctttactttgccagccgaattcgggattgatcaggccgatgttgacgaactggaagaggaatcggccaagttggttctatcaccagaacgagcagtctttgaaaagcctgaggggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatgaagacgaacatggtgcttaaagactttggtggcaacccatcggaaacaaagggtgttctgaatgtagaattgacagtcggcagtaaaactatccctaccacattttttgtcatcgatgggaaaggttcttatagcttgttgcttggaagggattggattcatgccaattgttgtattccttcgaccatgcaccaatgcttgattcaatggcaaggcgacaaggttgagattgtgccagccgacaggtcagttaatgttgctagtgccgatctagctctttgggagatggatggccttgattgtttatccgggaagatttgggttggagattttctaaaagtgtccgattctgatatacagccgattgaagatgaagaacccaagctattattttgagggcgtcgtggagggttcaagcatctacgccaaggacacggtagatgatctcgatgacaagcaaggtcagggttttatgtcggccgatgatttagacgaagtggatataggtccaggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaaaccagggattagaccacaccagcagcctccgaggagatgcaaagccgatatgcttgaacctgtcaaggctgaaatcaaacgtttgtatgatgctggttttattcatccttgccggtatgctgaatgggtttctagtatagttcctgttatcaagaaaaatggtaaggtgagggtctgcattgatttcagggatttgaataaagctaccccgaaggatgaatatccgatgccagtggccgatcagttggttgatgctgcttcaggacataagatactaagttttatggatgggaacgcggggtataatcaaatctttatgaccgaagaagatatccataagacggtcttcagatgtcctggtgcaatcggcttgttcgaatgggttgtaatgactttcggcttaaagagcgctggagctacgtaccagagggctatgaattatatatatcatgatctgatcggatggttggttgaggtctatattgatgatgtggttgttaaatccagagaaatcgaggaccacatagccgacttgagaaaagttttcgagaggactaggaaatatggtctgaagatgaatccgacaaaatgtgcttttggtgtatcggctggccagttcttgggatttcttgttcatgagagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttggggggcagaacaacagaaagctttggataatattaaagaatatttaagttctcctccagtattgattcctccacaaaaagggattcctttctggttatatttgtcggccggtgataagtcaatcggctcggtcttgattcaggagcttgaaggaaaagagagggttgtgttttatttaagccgtcggctcttggatgcagaaacaaggtattctcctgtggagaaattatgtttgtgtttatatttctcttgcactaagttgaggcattacttgttgtccaatgaatgcactgtggtgtgtaaagccgatgtgattaagtacatgttatcggctccgattttaaaagtgagagttggcaagtggatattttctttaacggagtttgatcttcggcacgaatcaccaaaggcgattaagggacaggctgtagccgattttattgtgggtcatcgtgatggttcaatcggtttggttgacattatgccttgggtattattctttgatggatctgtatgcagtcatggttatggtatcggcttggttataattgcgccttggggggcaagttttgaatttgcctatgctattacacaccatgtgactaataatcaggctgagtatgaggcggttttaaaagggttacagttgcttcaggaagttgcagccgatgctattgaaatcatgggtgattcgttgttggtgattagtcaattggcaggagagtatgaatgcaaggatgatacattgatggtttattacgaaaagtgtcgaacgttgataagtgaatttcggctggtgactctgaggcatatatctcgagaacagaatatagaggctaatgatttgtctcaaggagcgtcgggatataagccaatgacaaaagatatcgagatagagattgctacaattacagccgatgattggagatatgatgtgtttcagtatttacagaatccatctcaatcggctttacggaaattgcgttataaggctttgaaatatactttattggatgatgacctctattatcggacgattgatggggtgttgcttaaatgtttgagtgccgatcaggcaaaagttgcaatcggtgaaattcatgaagggatatgtggtacacatcagtcggctcataaaatgaagtggttgctccgacgtgctggatatttttggccaacaatgctggaggattgtttcagatattataaaggttgtcaagattgtcagaaatttggagcgatccaaagggcgccggcatcggctatgaatcctattattcaaccgtggccttttagaggttggggaattgatatgatcggtatgagatgataaaagtatcttactggtggagctggtttaagggtcgaagtagccgatctcttcctcacagcgattttctttctctatgtttattaaaattgtgaggaatcggctataaagtaaatgactgcaaaagtggacggagaaagttgcttacctttgccaattgagctgaagcagaaggggatggatgagcctgcttaggtgaagccgatggtgttctttcagtatcgcttatttcggctgcagcctggtcgatgtcttcctcgatttcttcttcatccaaagcctgttcaatggatggatctagggcgggcagatcgtcagctgacttagctttctttgttttagtttttttcttcggaaccggggctgaagtatctgcagccgatgatctggttctccgcttcttgctgacatcagctggttctctgatgagcccttgaagaagtgctgaagacttgggggcatttaagccgatggtagaaggagatggcccacctccatttggaattagacccggagcatacttaatgaccttgtcgctattgctctggcgaggaggagaagattctgttgtctgcaaaacagaagaaaagttagtcaaggtttaaatcggctgagtgattattcaagtaagattgaagaaatgaagattaacctgagggatagcatcagggaataagtctatcatgtacatggaagccgattgatggaacagatgcagcttccattcaccgcaccatctgtcaaacgccctactcctgaaccttgccagctttatgttctcgatgctgcccaacggaggtccagggatgttcaacagccgatccatcattaaagttgaggagatgtcacctctgcattggatcttgtcggcaaagtacaggccgattggcaattgtcctattccaagttgtctggccgatgacatcggatgataaaactcataggagacttggatatttctcccttgatggatgccgactgggaggatacatgggttgatagcagtagtaaagatttctctggattgctgaaatttttcatgattaatatcctcgaacctgaaatcggctggcagttcgaaatccattgagtcagcatagaaaaaccaaactcgggcatctttttggaatccatcataaaagctgaagaaccagtccttcagaagttcagccgataactttgctcctgcatcggctggtgtagatgcatattctccgtatgacatacatctgcgatgggtgcgttcttctccatcatcttccacaatcggctccaaccttggaaattcagcttctgtcacagatggccgattgacaactttcatgactaccaggttcagccaggattgcaagagccaccatggtccacctgctccaaccactgagccgataattatcttggccaatgcgttgtttaatatctggtaaagatagccgagaaggattttgcctaagggaaattgtttcttcgttgctagggcctcggctatgaattgccagttggttgtaggaccgcagcttgatccgcagaaaaggaatttttccaaccacatcagcaaaaaagctacgtgttctctaggagtgactggccctttgcccatatatgctgtgatatatcctgaccaacccccaatgctcttagttttgaactcaaaagtgctcttggtgttcaggttcatggggttagctgatgaggttacatctaggctagtgagcatgataatatccagcagcgttggggtcatcggcccttggttgaaaagaaaagcattgagagtgttggaccagaaataagttgcagcagccatcgggggttcatctttggccgaatttgctattgtgagggctagggcttggctgattccgatctcatcccaatgggcttgtttgctagccgatatccgcgtataccatgcgggccagcttttctccagagaaggccaggatttgaaggtgtttttccaatggcttgtgtttggattggccgacctaaaaggggttctgttggtttcggctatgataaactcagtggtgtctagattgccgattggactgagaaagtattgttggtcatgcaacagactgggaaccgcaacaagattggaaagatgctacatgaatagagaagaagaaaacaagataaggtgagcgaaaactggtctgatgaacgcaaaaggggatctagccgatggggacttacctcagcatattcggctgatggtgcggtggtcggattggtggaggtcgacatcgccgcgggtgaagatctggctgggagtggaattgcctggaaatcgccctgcgcgtcgagtaggttgccggagagagagaggacgggatctgtttaagcggtgaagatggaaatcacggtgtgaagatttttgggggcaacggttagtatttaaagtagagcgataacggtcgggaagacaacaagtgcgagtttctttcagagtcggtatatggcaaatccgaaacattatccaatataccggacttggggggcatgtgttaacgaccaaatttggtaaattctatcactattggcgtcgaaggtgaaaatcagatcgaggtggaatccaagatgaagatcgttgcggaaacagagtaagaatcgcctgcagtccaaatcggctaaggtcaggtcggcagagttcgagtcggacggggctagccgatacagccgattccgataatatgactcggcgtatgtcgtcgggttcaagttgatgtgcttcaaagatgattgccacgcatggatagagtcctggaaaggcaattgtatctattaattaggatattttgtgtaatttccttagagatatgtgtagcgcccgttccgtcgtggcgcctagcgggaaaattatctcttaaaaaccctaattgcgaaatttgtttctttgcttgctgtctagtgtccgtgccatctcaaatctcaatccccgatctatcgtcgagtccaattccgaatccaaatccttccaaatcaaatccctccgcagaagtctattttgcctcccccggggtcgagggggcccttttatctaggtccatataggcctctcatctccatctgagactacatcagcctggacttaattgcccatattactatcagcattttgggcaaaaccaacaagtctctaggagtttccaactttcccacatcttcctgtcttcttctgagccctccaatctgtagcaacctctgcctgttgaccagttacaaagttgcttccacatttttgggtgtccctatagcggggccttactgcctcgggaccaatgtactgtattcatcagttctcacgctgctatgaagaaatatctgagactggataatttataaagacaagaggtttaacttactctcagttctgcattgctggggaagcctcaggaaacttac

SEQ ID NO: 81267 - DNA, 504 bp, Oryza sativa
tattatgctcttgcgcatgctagtgagatattactctgaccaggactgggcatgaatactataaaatgtcctggatatttgtttagtatctacctcatacaatgtgcggtagaatacaaagaactgaggcggacgaccatcatcttaaggctgacactctgctcctgcctcactagtgactggagtgcccttgggcacaacaactcgccaacggggagcatcagggcttatatgcttcgtacgaaccacacctttacccaccgtcctgctacgattctgcatgttcactggagcatgagtgacttaaatgcatacattctcatacccttcagccaaaggttaatgatgggcaacctctggatgcatggccctattggggctcttatgctgggacatgaagaagggatcaacacctcatactgaacatagtgaacaatcagtccatgcaacggggaagtgcaatgtgacaaaggatcgcgccagtcctgaacaccacacaccttc

SEQ ID NO: 81268 - DNA, 25171 bp, Oryza sativa
tgaagaaccctttcccggtaatggcgatctgcaacaccgaaagaagggcataagcctaatgaattcaatagaagcatcaacgtgaatagcatatgtttttccagatgattttgcatccacaccaagtcaccaacacaaagcaggggagacgattgatttcagtcatggagcaattgctccatgaacaagaatttttgtatgcttaccattatataggcatttcgattcacagacttgagggtccagtctatgcagcccaggcagcattgagaagaggatgatgtcattttaccaaagcagctttcacgagcggaatcaaatagcttcaacttgcgtctgaggcattctagtataaaccgcacccactcaacagcagatacaacaagtgaacctatagcaactgaaccaaggctgtaacgcaacaaccgcttcaatgaagaaacaactgtaacaaatggtatgtcatgctgcataggaatagctcaaatagtcagtggaaaggagaagtaaactaactgctaaatatagagtaaattttttaagtgcctcaattcacttacggatatttcaccacgtgcccaatagtatgaagcaactgatccagcaatcacggttgaagagcacgcaataaagaattgggttgcccagtaacagccaaataagtggaaaagaatggcaataccaatatgaggggtgtaatggatgctgtacccacagcagttgtcacagtttactttgcccaacttcagatcatatgagcaacaatctgtattgcagtcatttcggagaacttgaccagagctgaagagatggagtgtggcagaaaaccagaacatataaaagatagcgaggataaagtatggcacaactgggaaaataattagtgcctgaacttcaccaatgaccttcgcagcaacctgaagataataatttatcaggttagtgcttaggaactattaactatattcttgccttcaaagaggaggaatggcattgatgctgagtgtcttcaaaaccaagcttctgcttatacagtgtataatagttagctaatcaagcttgtacatccaatgattcacgtaccttcaggacaggtgttgctatcagtatacgacggataatagctatggaggtcagaaatgcaataatcattactactgtcatcaccactgtagcagcatgaaggtggcttatttcctagtaaaagaatgaacaatcaggcaacatgaagctggatattgtaaaaagtcaaaaaattggatatactcacccgcccagttatgtggacatatggatcactttcgccaattacaactgttaagggatcattgcctaaccagccagctgaattaaaatgtagccaattaggatcgtatgtgtgtaacatgttaaatggcatacaatggaatttcccttgctatattttggaattatgacatgcaaaagtgaaccatacctttaatataaaaaaacatggtaacagagattactagagcattgaaaaccactacagttatccatggcgtggcaacaacaaaataacgaatcagaagcaaccagataactgacaagaaaagagggagcagtccaccgcaaacaattaacacaggccatgacttcccaatgtcagcaacgtatctctgcagacgaaggaaatggtaattaatatcttcaaagacaaaatgggactccagtgctatatagatcatgttgcatcaggaatttctcaaaatacttcaaaaggaatatccatttcagttgctagaaagtaatatgcttctttcagagcaacagtgcaacaaagttcttttgtaaggataaaaagaattactgcagtgtaatgtacggtcagcgttagctataggaatagctggataatttgtcacttccaacgtaaatcagaaatgtttatgacaaaaaaaaaggaatgtgcagataataaaacagtgccaggaagtttacaaaccttcaggactgaagatttagaattgatggccttgtggattgttttatctatgagaatattttcgtcgatgttgataccacccatctgttgccaatgcttcaaagagacatttgatgctcgcgcaataaattggcagctccagtagactgaaggcaacaaagattttggatcagctatctcattatttaaacttattacatgaaggaataaagccctcaatttaatccatgctcacaaaaaatggtcgcacggaagtgctacaaacagagcaaagattaccattcacacttggaaatataacagggtagcatggaccctgcagttgaagagaactatttctcatatctggtgtgagaaactcaaaatagtcatagtccctgtcgatccaatcatcgacagacaggcgaatgtccccttctggataatcacaaacaaagtttaatccgtctgctgctggcatggggcactccatcaggcagatggctttggcatcagcaaggttaatcttgttgtccttgaccccactttggtacacctggtttgggttcatccaatatctaacatcaagctcatgcaaatccgggtcaccatgcctactgccacaaatgttccctttgtagtctagttcataagtaagcctgtgtcatcaaaacaatataagacatctgtattacttagatacacatgcagcatgtactaaataggagtagtatggttactcatcatagtgtctgaataatagtaaaatgatagccatgcaaaagttgcacagcactgagttttatccctaaacaaattttcttttggtcagcactcagtagtgggttttggtttctattaatatataaccgtagtgtgaattgcttttagggagcacaaatcctgtatagctgggctgtaagttttttttcggagggaatacaattccaaggaccacacaactctaatatataagagtaaccactaaaggcacattttctccctgcaaagcaaaagtgggattctttacctatccggttgggaggttgaaacaaagcaagcaaagattattcgattcagagtacaaataacaaagtcgggagctagaagtttcattccgaaataagcaagatctgctattaaagtatttaatagcctaaaaaaaagtcatctgaatgttccatagtagcaagtggcaccctcattttctcactctatgtcagttcaattagactgaaagcctgaaaataacacatcaagttgaagaattgaccaggatccgcgcgaaaaaaatgagccaacaagaatgcgaaggtatgcactaaacacccaaacacatccaacaaggaacatagcccgtaacacctgaaaatgctccgttcttggtaaattgttgctgtctgaagaacagctcaaaatgtaccgcggcattaatcaccacccagcaaaggaaaagttccccggatgaacgctcttagcatctagctacagggaaccgaaattaaacagcaccgacagcacagatcggcgaatcttgaggagaggagaggtgaaggcgagtgggtgggtcacgggtcacctcacctgagtgggttgccctggttgaatccgaagctggagttgacgatcatggcgacccagaaggccgcgaagagcacgaggaaggccaaatcccggcacctccggttgtgccgaatgatgccatccccgccgccgccgccgccgacacctcccagctcatcccccccgccgccgcccgccgccgccgggtgcctgcctatgatggcgccgagtggccctcccattccgccgcctccgccgccgctcgccctcgatccgatgctgtggtagctcgcggttgtgcttcttgtgagcggaagtgggcgagctcaagctggctggtggagtgatgagcttgtcagtgtgtgcagctagcttttcttttttttttttggctttttgctgctgcggctgcgtgaaaaggagagtgggagcaggagacctggaaactttaccaacttcacagatttcgcacaaatttttgtccaagatttgatggtgtttcaaaagatttcgcttagatttaaatccagaaaagagaatggatgaaacggtttggtgaagactggatcattaaccacggtcaatggagtaagcttcgcaattaagagcgagatttaattaatatggctggatttggttacctgttcgcggccgatgggttgcccgttctggtcaaatgaatcgaccaatcgtgtgggtgcagttcgtggagcacgctactgactgtcgtcactgcatgcatgtagtggtacacgttaattacggtgaaggtacatggaaaataaaatgtctttttctttttcttttgcaagagcaagtaaaggtttcggaggaatacaagaaaggtgtccctgtctttcggccttcactaacagagattgttgcgttggctcgaggatgggatgggtgagctaggctagtgcaggaggcaagttggtagtacaaaactacaaatgttgcataaacatactattagtactacccctctttcaaaaagactatagttttacaggtttatatctaacgtttcatcatccgttttatttgaaaactacaggtttatttgagaaatttatgattagtatttttattgttattactatatgataaaacatgaatagtacatgactattttttttattttttcataaatttttgaaataagatggacggttaaacgttggacaccaaaacctacaactacacttaaaatgatatggagatagtaatatactccctccgtttcaggttataagatgttttgactttagttaaagacaaactgtttcaagtttataggaaaaatagtaatattttcgaatcatggtaagtttattataaaaatatatttaactattaattaaataaaactaatttggtaatataaatattactatatttgataaaaaaaacatcttacaacatgaaacaatgggagtatatctgattagtactttacatcacatactgatagataatgatggggtgacctctatgcatagtatagtgttgacttagactaggtcttgtgagcaggccatggtatttcttacatatactacatgttgtatcgttggtattcaaagttgaaatatgtatattctctttcaaattattcgcctgtccctcggtagctctttcaaatgactgtaactctattgcttctttagagccaagtagtatctcgttgacgcgaccccatactttacagtgggataaaaacggagcggatagtttctgtatgctctgaataagaacgaatatggatacctttcagatcggataattcccagatagttcggatacgaatacgaatattttctcatggatacggatacgaatatggtatcggggtttctatcggatacggataataattcggatatccagtgaacagtgttattcggatatctacagaagccatgagacataccttatttttttataaatctatgacctttaatatagcttttttagattttaacagtagttcatatcttaacactagttcacactattaatattatttacctttttataatatatttataaattatattacattttatataaaatgagctaattatatatgttgatatttgtttctataagaagttgagttggttttcgtgttccgagaaaaaaattatttccgtattcgtgtccgatcatattcaattcttattcatattcaaaattatccgtatttgtttctatatatggcaaaaaatataaaaacgaacatggtatgagcattatccgtccgtatccgctctgtttttctccctactctacactctacaggcatacgcgtacccatcgtacatgtacagatgaattttgcatgggctctacgctctatctagcccaccgagcctagaggagggctcgaaatgggccaggcccaacggggaaaaaaaacacgagctcgtcgccggcggcggcgcgcatttccggcacaagaaacacgcaaaatcaaaacacgcggagcacatggcgaccatggcgtggaggttggcacggtgtggttttccatcggtttcggaggcaatgcgtcatcctcggagctcgctgctacaaatgcaacctcacctgcaccgcctgctcgccccagccgaggcgggatcgatcttccaccgtgccgttgccagtgccaccgggggtgggtgagcaccgtcacggcgtcacctcccctcccctccctccggccggcatgacgatcgagggaaccatatatggcgggcgcggcggcgatggccctgttgctctcgaccagcgtgctgctcgtcctgtgccttctccccgtcgacccggctgccccgccggtcgccgccatcccgcaccgccgatcggggcgccacgacgtgccgttcggccgtcacgccgcgttcggcccgttcgccaccgaggtcgagctgctgctccacggcggcggcgccgtcccggacatcaggacgtgccgcgacacgctcgaccgcctccccgactggtcccacttcgacgccgagctcggccccctggaacggtgcgtgcgccgctcgccgcgctgcagaactcggtggtcttccacgcgcgcacgcggagtgcttgatgttttgcgcgcatggatggatgcaggtacttcgggtcggacggggagctgaacgtgaaggagcggctgctgtacctgttcccgatgctggaccgggcgcccaaggacggcggcgtcagctgcggcgagctggaggcctggctgcgccggcaggcggcggaccgtctcgacgccgtcgcgcggagggagctcaagaggcacgacaaggacggagacggcgtcgtcacgctgcgcgaatacctcgccgtcgaccacgatcaacacattggtacggacaactgtaattttagtgtcagtgtctgcacggtttttgttgacgcgtcgccacgctttaagcacgttatatgcagtccgcagcggcacccgacaacacgtcgtcgcaagggaggtagatgtaccgaatgaacacccaggagggaccccgtcagagtgaacgcgcgtcagtttatcctagtctcggcaggccagctagaacattctctaacatcatagagacgagagacgataagcaattgggggttgagaggtgaatagacttgggtacaagtagcaagaggaagggagatgtagaatgtagaggttagggcattcacaatgtgggaatatgggtgggtattacgacaccaaagtagacctcatacattgtgaggggatttttagggtggtctctagctaaagttgtccatatgcttatagcctgctcttatggcattaaaagaataaaaaataacttcactctctcaatgacaaagagaaaagaagagatggatggagagagaaacaacgattttttttaaaaagtgtgggtcccatcttaaggttggtcccaccttaataccaccctagtacatacacactgctgatgcccttatgggcaatagattgattttgatgattgattggttgttttttcaatctgccttagcctctatagttataggaggggtgatcttacgtttacatgactctttttcacgtttggaaagctttacaatcaagaaaaccctaagattaaggaaagaaaaatgaaaaaactcaattcgattcgaactatgtgctgaaggtctgaccgcccagacatacgtggtctgaccgtagtttattgtttggtctaaccggctatacattggcggtcagaccagtcttcacgggaaagctttggtatttttcatatttggtttgaacttgctataaatctaaactagtgccaaatttaagcgttaacaatttcattgggttatgagttattaactgcatagattggaccgacacggagcacggcgaaccaggatggtggctgcataagttcataagcgcggatagagatcatagcggcgccatggacttcatagagctcaacgagtaccacactcatttctgaacctttttttagattgttgagtacatcggaaattcaatagattaaactctcctaacccttggtctatgtgtgttgcatatatactatagcttcttgcatccagaagatagcagccaggagaaagtgaaattatggctgttgaaggataaattaaggcaagcagtgtccaaacacttgcatatacttataatgttgctaattacggtccactaatatgataaattgatgtatttgatttatctttttcatctgcatggatgcatggaatacagtggaatggatcacgatagagacgggaaattaagtttggatgagtttatcagtcagtttcacatgatcgaccacaactccattgtagagcatagtgctgatgatgatactagttgtgctgaagctgagaagaagtttcgagagctcgattctaacaatgacgggtaatacttgaaacagaagaaaatagcaccactttgtgtagtgaatatttgcaagataacccttttttactccacctttccccttttcagctatttgacagtggaagaagcacgtccagtaatccagagcctcatctcgggagagttttcatatgctaaatcacatgcaaagcttttgatgaaggtgactaactaaccataccaaatataactagtaagcaattttcactatttaattgataaccactataaactacctttttttttggcaaatatgataatgacataggctgatgataacaaggacaacaagttgtcactagaagagatgctgaaccactacctatctttctacaatattgtttacatggatgatcactatgactacgatgacattggcaacaatatccacgatgagcttaggtgacaaatttagccaagacggtatatataaactgttccctatgacaaacaaattatcatgataaaagctgtaaattatgacaaacaatatgaacgtgtacatatgggtaactacacgcgtaagtaatctgacatttgtgcgtttatactttccaatggaatatataacatgtttttgatagggcaacaacaggtggtggacccaagaaaattccaatgtgtgcccacatcagagttgcaaatactgaccttaaagtcttaataaacagaaatacatattatcaaaagtacaatatgaatatagttcgagttaaatctattacattgatttaacttataaattctagttcacattgattaattagaaaaatcatttcgttcacccaaattttccgctgctgctaaattcaatgtaaaaaaataaatcctaacaccctaacacaaactacgaagatgaagttgaacagtacaattggaggagctttcagctgtgtcatcatgcttctatagaagattacaagggattgtcgacttcttgtactaaggtggatcagtttgctattaagggtttcaatatctacagagaaacaatcatctgcaaaaataaggaagtccgataggtgcattcagaaataggatgcccatggattacagaactggtaatcatttttttagcctacattgatgttcaacacaaacaaactaaacagtgtaaaccgtataggcagtacaagatatatctcctttcactaatacaccaacatctttttgacaacgacctattcgattcgatgaggttcataaaacatctagttcagctaacattgacatttgcgacgttgtctatgctacaaagagaacataatcgtgaacagttcagaacacaaacctctcatgttgacatctacaccagcagccagatgcttcgctatgtcatcaattactccttcccttgcagaaacatggatatcaccaagttctctgcagttacagataagtttgttgcaattatggaaacactgtgatgtgactagatgactgaataaataattcttattagcatcaatttggagataactagtagcatactccatgaaataattaatcatgtcattgttatttgctagtactactacgatttatcagccataagagataatgtccaaatacaatactacctgcacttgaatcaaggcagttttaatacataagaccaaaggtacagggtatacctcaattcaaaaacttacgagtcatttccctgatcttcctcctcatacattaaactgctaaatacaggccccatcggtcccttcgaacttgaagcagatattgtgctatcttcatctttctttttccgaaatcatgtaaaccagattatcaaacaagtcaatatcaggggggcaaagcctgacgctgatagatgcttgaactaaatccagaaaaaaaaatcagggagccagggagatcgaatctaccacttggcgcgggccttgagcttgagggcggacggctgtggcgcagtgcagggtccctcggtggcgatcttgtagagtccgtagagctgcagctgggtatcaactgagaaatccaggatacagtcacattatacgtcttaacaactgagattgcatttttcagtttgcaacagaaggctcatcctgccagcgtactggtctgatcgcacggccataagcaaatttcaagttccagccccaattatgtaagcaaatttgaagcgaacaatattcagacattcagacaagatataaccttcttcactatcattgtattagcaaagtatagtaggagtacatacgttagatcaggccaggggtactagtcacgctatagaccagactttcagcatcagagtgcactaccaaaatggtgaaattacccactagccagcaacaaagaacataatgacaaggcttctacttaatttctccattctgacttaattctacttgcaagaagaagaaaagtcaaggcccttgagttagtctatggagttcactctgttcatccagtgtctccactaggagagggggagcgtactgcgcgttcccttggtgctcttctgaatcttgacagaaggagaggattatggtgtcgatcgacatctcgacgacttggaagaaaagcttggcgactataaaaccaagtgcccatgatacctgcagtgtagcagcatcagaatatatacagacacctttaggtcttagcaatggaaatggcatttgtcagtttgcgagccgcaatgacagaacgatgaaatgcttaccactacaggaacaagaggagatgatatcttgttatgtgcagacttgtacttgtgagtgtctaacataaggaaggcaaagagcgcacagaacaagctcacacagagcttccccagaaagaggatgacgtctccaatgacgttaacttttccaatgcgcagtatgttattcatgatcaaaccagttgcgagaacagaagctttgaagaaccctttcccagtaatggctatctgcaacaccaaaagaagggtataagcctaatgaattcaatacaagcatcaacttggatagtgtatgttttccagatgattttgcatccacaccaaaacaaagcaggggagacaattggtttcaggcatggagcaattgctccatgaacaagaatttttgtatgcttaccattatataggcatttcgattcacagacttgagggtccagtctatgcagcccaggcagcattgagaagaggatgatgtcattttaccaaagcagctttcacgagcggaatcaaatagcttcaacttgcgtctgaggcattctagtataaaccgcacccactcaacagcagatacaacaagtgaacctatagcaactgaaccaaggctgtaacgcaacaaccgcttcaatgaagaaacaactgtaacaaatggtatgtcatgctgcataggaatagctcaaatagtcagtggaaaggagaagtaaactaactgctaaatatagagtaaattttttaagtgcctcaattcacttacggatatttcaccacgtgcccaatagtatgaagcaactgatccagcaatcacggttgaagagcacgcaataaagaattgggttgcccagtaacagccaaataagtggaaaagaatggcaataccaatatgaggggtgtaatggatgctgtacccacagcagttgtcacagtttactttgcccaacttcagatcatatgagcaacaatctgtattgcagtcatttcggagaacttgaccagagctgaagagatggagtgtggcagaaaaccagaacatataaaagatagcgaagataaagtatggcacaactgggaaaataattagtgcctgaacttcaccaatgaccttcgcagcaacctgaagataacaattatcatggttagtgcttaggaactatatattaactatactcttgccatcaaagaggaggaatggcattgatgctgcatgtcttcaaaaccaagcttctgcttatatagtgttttttttttgcgaggtgcttatatagtgtagctaatcaagcttgtatccaatgattcgcgtaccttcaggacaggtgttgctatcagtatacgccggataatagctatggaggacagaaatgcaatgatcattacaactgtcatcaccaccgtagcagcatgaaggtggcttatttcctagtaaaagaatgaataatcagacaacagggctggatattgtaaaaaagttgacaaaagttgatatacttacccgtccagttatatgcacatatggatcactttcaccaattacaactgtcaagggatcattgcctaaccagccagctgaattaaaatgtagccaattagaatcgtatgtgtgcaacatgtgaaatggcatacaatggaatttcccttgccatattttggaattatgatttgaaaaattgaaccatacctttaatataaaaaaacatagtaacggagattactagagcattgaagagcactacagttatccatggcatggcagcaacaaaataacgaatcagaagcaaccagataactgacaagaaaagagggagcagtccaccgcaaacaattaacacaggccatgacttcccaatgtcagcaacgtatctctgcagacaaaggaaatggtaattaatatcttcaaagacaaaatgggactccagtgctatatgaatgatattgcatcaggaatttctcagaataattcaaaatgcatatccattttagttgcaagaaagtaatatgcttctttcagagcaacggtgcaacaaaattcttttgtaaggataaaaagtattgctgtggtgtaatgtacggtcagtgttagctataggaatagctgggccacttttcacttccaacgtaaatcagaaatgtttgcgacagcaaaaaggaatgtgcaggtaataaaacagtgccaggaagtttacaaaccttcaagactgaagatttagaattgatggccttgtgtattgttttatctatgagaatattttcgtcgatgttgataccacccatctgctgccaatgcttcaaagagacattggatgctcgcgcaataaattggcagctccagtagactgaagggaacaaagattttggatcagctatctcatcgttttaacttattgcatgaagaagtaaagcccttaatttaatccatgctcacatggaagtagtacagactgagcaaagattaccattcacacttggaaatatgacagggtagcatggaccctgcagctgaagagaactatttctcatatctggtgcgagaaactcaaaataatcatagtccctgttgatccaatcatcgatagagaggcgaatgtccccttctggataatcacaaacaaagtttaatccgtctgctgctggaatggggcactccatcaggcagatggctttggcatcagcaaggttaatcttgttgtccttgaccccactttggtacacctggtttgggttcatccaatatctaacatcaagctcatgcaaatccgggtcaccatgcctactgccacaaatgttccctttgtagtctagttcataggtaagcctgcgtcatcaaaacaagataagacatcagtattactaaatagtagtttggttactcatcatagcgtctgaataatagtaaaatgatagccatgtaaaagtcgcacagcactgagttttatccctaaacaaatttcctttggtcagcactcagtagtgagttttggtttctataatatataaccgtaatgtgaatttcttttagggagcacaaatcttgcatagctgcactgaaagtttttttttttttgagagagagagagggaatacaattccaaggagcacacagtctcactccggtgctttctacttggagtagaaagtaatctggatcgttgatctcatttaatccaaggtttcagatttatttttactaccacctcacttaacggtagtagaatcgtggagggtattattgtctatgaaaaaatatttgcggaggggtacaatcgtcttttacattcactaaccctagtagggctctctcctccgtcgttcgttcctcacgccgccgcacgaagagaagtcccaaatcgcatccggcgccgacgccgagcgaccccgcctcgtggctcctcccttcccccgccatcaccgcctcagccgaccttgcctgctccaacgtcctcgcctcgtccgccgccctcacctctttcgccgcgtctgccgcctcaaccgccctcgacgattcctccgccctcaccggcttacggcctccgcctccctcgcctcttctgccgccctcacctcctccgacgcctcagcctaccgatagcgcgggcttggcgacgtggtgagtatacccctacatctctcggtagtcggtactgaaatcccaagctattactatttgctagtgagaaggtttgatatgaatctctcgattccacttttatctgttgacacactgtatcatgctactcggtcagcctgcgcaacgacaagcactgcagcatcgagaactccatgaagaacaactgttccatctgttatgaggtgtgttcttctaccagaacataacagtgatgctaccttctgtacctactgttcattaaaaatccagtctcttatgtatgaaactgtgatcatcgatcacaaatgcagtgctcatcatcacataagaggtaacgtcctgtccttccatttactcccatgcagatcagttactgatctttgattgctctattcgaatggtgtagttgaatgtaaaaactgaattctgtagtcgggttttgtatgactgattagatgaatgcttgttcttttacggaactatcaatttagcattggttagtaatgtactgatcagctgttttctcttcgggaaaaagaccttgaaaaacgaaaataattcgttcaggctgttagtagtaggttcagtacatatatttggataatgcatgacagaaatcttgaggctttaaaagaactacaatagtacaatgcataaaggaggaggcaacaactgtgcatgtttgtatgctaccagaaaatactagtatcctacaactcacaactgaattgtgaactagtatattgaaaaatttatagtaattccattacagctaacaaatgtgttctgttgagtaccctgatgaagtccactccctcgtgttgctggcaagcctcacagcattgttgcctcttatttggcatccatttcctgcaccgtgcatgttgtttggagttgagtttactcatgttattattgaaactagctgggtggcccgcgcaattgcgcggctagcacccaaacaaaatcgtatattttttagtataattttacttaaaatttattaaatagctatctcgttgtcttaagactttgaaagactaaactaaatagctatcatccccgtatttctaattatatagtttttaaaagtcacaccagctgctactccttacttctgtcatatccttttttatttgcttgctcgatctaccgctatttctattcattctccttgaaacctttaaaaattagatcttatagtttttagagtttattgtctcgttgggtttcgtttttataatttctagaagttccgtcaaacactgccattatacttctctacagcccgtgcactgtcttttctctttattatcattgggattttcaaaatcgaacatagctatcgttcgggttcaattttttactttctagaagtcccaccaaaccattagcggctttgccactgtactccttaatggctcacccgttgcctcccttctttattgtcattgggttttttttttactttttagaagttccgaacctttaaaaattgaaccttgtagattttagagtttattgtcttgttaggttttattttttataatttttagaagtccagtcaaacgatgccactatactcctctacgacccatctgtcgcctactctttattgtcattgggattctaaaaatcgagcataactatcgttggaattcattttttattttctagaagtcccgccaaccgtcggcggctctgcaactctactcctatgcaccccgcccgctgcttctcctttttattgacattgagattttaaaaatcgaatatgattatcaatggggtttattttttttgtcccggcaaccgccttgcctgtttgcttcacggcttgcctgtcgtccctccttttaatcgtcattaggattctatttggtgttttattaacagtttttatatgtcgtattaaccgtccaccaatgtactcctttataggcatgttacttaatttatctcttcaggtgttttagacggtcttttctttcaatagtttttattttatatcatcatttttagttatttacaaattgtattcctaattgaaatctttttttctttttataatttcagaatttatattttttttcaaatttttatttaatttatctcgtcatgtgttttagacggtcttttctttcaatagtctttctttttatcaccaattttagttatttacaaattttattcctaattgaaatcttttttatttttctaatttcagaatttattttttttcaaattttaattaatatcatatagtgtaattttaatattttttttttgaatttaagttgtttcaaaattatattcctatttgaactctcttttagtttttataatttttgatattattttatttttattctgaattttaattaatctcgtattgggttcttatatggactattcttttaatattgcttatttttaattccgaatttcagctatttttaaattgtatttctacttggacttttcttttctttttctttgattaatgtgagaatttctagcccccacaacgaacgtggtgcctcctttcaaggctgttttaataatataatagattggatacaggatgatatcctataactccgatgcctctgcaacacatctccggatcaactttcgggtaaacagctactaatttatctgtggcctgactaacattagttgctcataatattttctatcttatcttacaattagtgctgtgaagcactcctatttgtttagtttcttgagggaggctcgaagctgtttctgatcttatcagagactagagaagaaaggagaataaccagatgccaatgcgaggctcaaggagtattttaaaagtcatgtttttatgtgacctcaactgtgcttacatgtttattggtccaatgcctctctgacttctttgatgttggctcgaaactgggataaggttgtaattttgcacataggaaaacctaggaccttgaattgtatagttttagaaatcaagtttttatctgatctcaactatgcttacatgttctggtgcccttgtgacgtcatgttcggtgaatgagtgcaagtgctatctatactgttgctctgtgtgcatgtgtaaatgtcaatggttccacaaaacagttgatcagtaaaaaagcagctctttctgagattggacgatgtcaccccaatcacctatcggtagtgtactacacacggtccaattttgaacaggataatggtaatgttttgagtgttgctaacgccagatggtttttagaaaaaagtctagaagattttcgttcacgaaaataccatcaaggagtcacaccaaaataccagaaggatttaccatgtgagaaatttaccaaacaaattgcctgcagacattagcgaagcagagcgttgcgacagtgatgaacgctggctgagatctaccggaatagggcaacaacggcaatagtgctaaagtcagcgaaggatcgatgcgatacaagattgaaacgtaataaaaatcacgaatattttcctaataccaagtttacccctaatcgtagtactaacaaagtactaatatgcccttggaaatcaacggtttggattatttctagttgtagtatatactacaagtagaaagcaccggagcgtcgcccataggagtaaccactaaaggcacattttctccctgcaaagcaaaagtgggcttctttacctatcctgttgggaggttgacacaaagcaagaaaagattattcgattcacagtacacataacaaagccgggagctagaagtttcattccgaaataagcaagatctgttactaaagtctttaatgacctcaagaatgttccatactagcaactggcaccctcattttctctctctatgtcagttcaattagactgaaagtctgaaagtaacacgtcaaggtgaagaagaatgagccaacaagaatgtgaaggtatgcactaaacacctgaaatagctccgttcttggtaattattgctgtctaaagaacagctcaaaatgtacagcggcactaatcaccacccagcaaaggaaaagctccccggatgaacgctcttagcatctagctacaggaaaccgaaatcaagcagcaccgacagcacagatcggcgaatcttgaggagaggaggggtaaaggcgggtcacctcacctgagtggattgccctggttgaatccgaagctagagttgacgatcatggcgacccagaaggccgcgaagagcaccaggaaggccaaatcccggcaccgccggttgtgccgaatgatgccgcctccatctccgccgccgccgccacctcccagctcatcctccccgccgccgcccgccgccgccgggtgcctgcctatgatggcgccgagcggccctcccattccgccgccgctcgcttcgatccgatgctgtggtaggtcgcgcttgagcgagacagcgagcgatctgtagcttgggagcagaagtgagcgagctcaagctggcggggctggtcgagtgatgggcttgtcagggtgagcagctagctttttgttttttttggctttttgctgatgcggctgcgtgaaaaggagatcaggaaccttttccaagtttaccttttccaaaatttctataaaggcatcacgttgaatcttttgacacatacatgaagtattaaatataaataaaaagaaaaactaattgtacagttagaagagaaataacaagacgaatcttttgaacctaattagtctataattagccataagtgctatagtaacccacatatgctaaaaagatgatggatgaaacgatttggtgaaaactgattcattagagagacgctccggtgccctctacttgcagtattctactccaagtagaattaatctcgaccgtttattttaaagggtaaattagtaaagtgctaaaaccgaataggggtaaatctggcacttaatttttttctcatttgtgcgtcctatggtcaagcgtcgctcgatccctctccatcgaacagcagagtcgctctccatcaaaaaggagagcgcagggaaagaaaaagaaaagcagatcgcgaggtccggccaccgccggcgcttgtgcatcgcgttccatagatgtttcttgctgtaggtatttggtttccattcagcttgattgtttcatgtaaaatttaaatatattagttatatatctgaatattacacacgatggacaaatcgaaacactccaatccagcaatgacagatacaaggcaacggaagaataatccggtatgtttttttacgtagactttacaattgcaattacaacaagtaatatacattgaaccacgtacaaaaacgatgatatacacagataggcactttcaaaaccacaagctgttaataagctatagttttgaaaaaaaaaacatggccatcagtaacaagccaaagccacccaaagccatcttgagataatgaattcataggaattacaggacatagcacaccaggaatctctcaagcgttcattgacgtagtgatcattagcttgtccaccttgtcatgctcagccattctgaacaagctcacttgctccggattcagtttactggcattcaacttgaatcccttcttctaggaggaaaaattatgaccaagaactacagaacttgagtagacaagcagaaaaactattcgagaactagaggccaacgaaaaagaagattcagtgcagatgttcgagctgcaaacctacaagcagcaagaaaaacaaatcaaatctgacctgcaaagcagaaaaagagtcttctcatgtcagctaatccgttggagagcagcgctatagccagcgagaggagtcttggatgatgattcggaggtcgagagattggtggtcattggctccggaggttgcgggttccgcttgggaggcgatggattgggggctcgccctcgcggctgtgggatcaacggcgggtggagatggacagggctggagccgagcgtgggggaggaggccgacgacgaggaaggggatagcgaggtggacgaggtctcggcggcggccagtggcacggtgctgggtcggaggcggagatccgggaggcgaactcgtcggaaggtgggccgacgcgggggagcggcagagagggcgcagctctggcgatcccagacggagatgcgagctcgtcgagggcggctgaggcagccagtgcgacggaggcgagggagtaggaggcgtcgagggcggtggagcaggcgaggtcgtcaaggtggtgatgggagccgcggggttctctccgcatcggctccagatgcgcgattccggaaggacgaaaatatccctccgcagataatttttcctggataaaagtacccctccacgattctactaccactaagtgtggtggtagtagaaatagatctgaaccattggatcaaataagatcaacggttcagatttttttctactctaggtagaaggcaccggagtgagactcgattcattaaccatggtcaatagagtaaactaagagcgagatctactaatctaaagctgacggttaaactagcttttgattgggccacgtggcacccataagttatcaaattaatcctagatttcatcaaagaaaaaaaaaatcaaaagatagaaaatggcataagttttctatgacaattctaaaagcaagcagtaccttaatctagttcttaaaaaaaatagtaacttaacatcacaacatgtataacattagaacattccgatcaggtgggatcaaaaggaggatgtagcccatatatgctggtccacttaaaacttacatatagagacatttacttaaagaccctaatttttttatttgggagagtgatccagttgtagaaatcgcttaggatttattgccaatttacaacatatattgttgagaattatacatttccatgttattttttcaaataggaatatcgcaaatattccattccacacatcttttagaattaatcattaaaaattaaactaattttgtatataaccccatacatttaacctccctagcttttagtatttgaatttcacgtacattggtccatccatgtgaacaaattgacttatcttacaccacttactttaacttgattttgtggaatatgtctaactaaatgatttccagttgatacaattgccatgtgttccagaaataaatttcattccaataatttcatttctttttttatcagcctatttgcttctgcttgtatagagtaaggtattcaatctctcaagaaaaagaaggaataaaaatggtcaatttatatatatcgaacaaaaccaacaataccaccgcatgctatattaattggagcgctgaccgacgaacctattttctagttaacaatatggctggatttggttacctgctcaaagccgatgggttgtccattctggtcaaatgaatcaaccaatcctgtgggtgtatttcgtggatcatactaataagacattttgctcatgttgctaatatgactatagtgtgtacttcaatcattatggcatcttctcgaccttggactatcacgtagatggttaccaaagaatgcctctccttcatggtaaccttcatgaggaggtatacatgcaatcgccttttaggcgtggaacatttacttttgttttctctagttctatgtgccctagactagccggtttggtcagcgtcaatgcatcacgtcaatcgaagcactgagtaagttgttttgtactggttttaatacttaggggacgcgagatataaccggttttgcggttgagatatacgggttagattcagctgatagttgagggagtcaaaaaggactttctgttcatgtaaaataaaaaaaggccggatcgggtaaacgagttggacttatggtacttaggcctggccgtatttggttacggcttttctccttccttttccatgtgtagggtttcagccgccgataatccagagacgtagggtttggagagtgttcgagaggtgtcgatcgcgggcggcgatgagggacggcgagcgtgcggaggtcggggcggccgggaagaagaggaaggaggtgagcgcgtcgtcggactcggagccggccgctgcgtccgggaagaagacgaagaaggagaagatcctcccggcgtggagggccaatgcgatcccatgcgaggggggcgaggtcctgaggaggaagaaggaggcggtggcggccggcaagctgtggagcacgccggatatcccgggggcgatggggagccatctctgggatccgatcgaagtcccggcagagatgctggagctgtggctggagaggcaaaaggcgaatgcggaggccgcggctgcgaagaagaagaagaggaaggtgttcaagtgcagggtgccgaatagcctcgtcgaagtgatgatcgcgcggccctacaagtgcgttgatcacgatcgctctcaggaggagctggccgaacttactgtgtcacatcgccagggctacatcctcaggaagttcatcgatgaaaagaagatgaagtacgagcagaccctcatcgaccggtacgtcaagcagggctatgcggaggacgaggaggaggtcaccgatgacgatgacgattgacgacgaagatccagctaccctaacctaggtcaaatgtctgctgatctgctcatcaatggctatggtgtaatcatcatcagtatcatctcctatcttatatggtgctccacttaaaacttgcatacagatgtatttacttaggctctgatggggaacctagcgcatgattaattaaatattagctaaaataaatttaaaaaatagattaatatgattttttaaagtaacttttatatagattttttttgcaaaaaaacgcactgttagtttgaaaagcgtgcgcacataaaacgagggaggtgagttgggaaaggggagataagaccctgtttagatgggactaaaacttttaagtccctatcacatcggatgtttggacactaattataaatattaaacgtagactattaataaaacccatccataatcttggactaattcgcgagacgaatctattgagcctaattaatccatgattagcctatgtgatgctacagtacacattctctaattatagattaattaagcttaaaaaaattatctcgtgaattagtttttatttatgtaattagttttgtaagtagtctatatttaatactctaaattagtgtctaaatacagagaaagttaagtctctggatccaaacaccacctaagaacacagccttaatgaccctaagtttttttttattttgggagagtgatcccacggtacaaatcgctcaatttataattataacatactccttccattccataatataaggcacaaccacttttcttagatgttctacaatataacgcatgcatgcaagcatgcaattaactatgacatcttctccattaaattattattatttttaaatcctctactctcatgttatctaatcctattggatgcatgggttatatttattaggatgattcaaactacaagatgataataattattttttagtatttgggttaagggtggttgtgtcttatattttggaatggagggagtatatagttgagaattatatatttttcatattattcttttcaaataggaatatcgcaaatattccatttcatacatattttagaattaatcattaaaaattaaactattttttatataatcccatacatttaatctccctagctcttaactatatgaatttcacatacattggtccatccacatgaacaatggacttatcttacaccataaaaaaaggaaaaaggaaccttcatgagatatacatgcaagatgcaaccgcctcttaggtgtggaagttccaattttttttctctagttctaggtgccctagattagccggtttgatcagggtcaatacgctacattagttgaaacagtcgagtgaattgttttgcacggttttaatacttaggagacgcgagatataacccggttttacggttgagatatatgggttagactcggccaatagtcgagggagtaaaaaattgacttgttttatgtaaaacaaaaaaaggggccggatcggataaacgggttgtgcttatggttaggcctggccatatttggttccttcatcctcgctatcttttattgggattgctatatgtcattcgactgaaatatggggatgaaatcttacagattttggaccattggatccatgccaagatttgtgctccaccttctcccctccaactccggcgctggcgacacccgggttagggtttagggttggggtgagggtaggaggaggggttgggggagggggaagaggggggcttagagggatggccgtgggtggcggaggaccggcggtgggcggcgaggcggcgggggctaagcaagagtgcggt

SEQ ID NO: 81269 - DNA, 1373 bp, Oryza sativa
agggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccacatctgcagttaaaacttaaaacccattaatcaaagcctggagtaattgaccagtacgaacggtcccataaaggttcctgctttactgtgtaagtgtcctttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaaccatggtggcagcccataacaccaacacggcaccacccatcgtgcaaagccctcatggccatgccgtctgcacgtccagtgtcgacgaagcaatggcggagatagacacgtccactgctatggctctccctgacaaggccactcaggtcagttgtccatgcccacgctcttcttttctccaacgaggagcccaaccaaacaacgacaaaggtagtacagccatggcgccacgcccaaagagggccaagcttgtctcgccagcctcggattgatggcgccgtgattcacctccgcctagaaacagtactacaagtactagaatagcactagctaccgcaattaacaacgccattactgtacacttcacagcatcctacttgcagtagcgggtagctccgtactcgcccgcttgggttttgaaaaatgcgcggcgaatcggatctc

SEQ ID NO: 81270 - DNA, 523 bp, Oryza sativa
gatgtactcaaaggcctgagatggaggcctccactgcatccgaaattattgtatgcagtagcacaatcaaccagctgctgctcagaaagagagacaggcttccagtggcctgagtatatgctgcctcaagagaaccagtggtgctgccagaataagttaaaggtcactcaaatgatctgattataggaccccccccccccacccgtgactttccttttttctactttgtctgctataattgaaatgaagcaccttctctacaacggtcacactatataaagttataatcgaaagtaacattccaggaacattttcaacataggtttgtcaattggtatgtgaagcatatttgccactatacttgtggagtaccaagaatatatgccaaatggacgaaaagtaacagaataaattcatgaaagacatatgataattgaattgtatgcttatttgagagtagtgacagatacctctccgtccaaaaaaaaaagtccaattctaacgataaatctggacacctatt

SEQ ID NO: 81271 - DNA, 13239 bp, Oryza sativa
cactactgaattctcatcgctagtttctgcacgtacagaaccagcgagagcaggcctccgaaaccatgccccgctgcgacgtttgcacggacgggcgagcgatcaggattttagggagcgcaaggcgtgactgctcactgttcgtttgcttcatcttcttcttggtaccgtcagtgagagcaaggactgcatccacaatagcaaccaatggcgagaaaggtggcaccgatggagcggagaacatcaacaccaacggtggcaactacaacaataatgcctcatcctcaggagcgttctctaggtatattactctaattaccttagtgttaaacatgttactagattatactattattattagtagcatgttcatgtttagcactatcactggattatttcggttttcacatgtcgtgtttattatcttttttttcttgattaaaatatgccaaattatgaccatatttccaacaatccaaaaacaggtcgagggaggttctagcgccaatttggtgtagaagaagaaccctcatgcatcccacaacaacaacaacaatgtcaaacctgacatcaaacccaaggctacaaccaattttaagaagaaaggcaagagaaaggcaaagggcaactgctttgtgtgtggtaagcctgggcattaggccaaggattgtcctgagcgcaaggacaaaaagtctgcaaacatggtcattatcgagggcggaggaacatcggggtatggtaaatttttacctacagttctctctgtttttcattcacctgattggtgggttgatcctagtgctaatattcatgtgcgtgctgacgtttccttgttttcttcttatcaggtcgggagatgttcctccttgttgatgggaaacagatcgcttgtggctgttcatggtgttggtatggtcgatctgaagtttacttcgggaaggaccgtgcagctgaagaacgtgcagcatgtcccttcaataaagaagaatctaattagcggctctctattgtgtaaagatggttttagacttgtttttaaatctaataagtgtgttgtttctaaatatggaacttctattggaaaatgttatgacagcggaggcttgttccgtttttctttggatgatatgtgtaataaagttgtgaaccatgcaacaaatgatgatgagtccaatttgtggcattcgtgactttgtcatgtgaattttgagtgtatgacacgcttagctaacatgagtttaatcccaaaattcaatttagtcaaaggatctaagtgccatacttatgttcaatcgaaacaatctcgcaagcctcacaaggcacctgaggcgagaaatttggcacctctacaacttgttcattccgatctgtgcgaaatgaacggcgtgttgactaaagggggaaagaaatatttcattacattgatagatgattgcactagattttgctatgtgtacttattgaaaacaaaggatgaagcattgcattactttaagatctataaggttgaggcagaaaaccaactggaaaggaaaatcaaacggttgaggtctgatagggatgaagagtatttttccaatgaatttagttctttctacgaagagtttggaattattcatgagaggacgccttcctgttcaccccagtcaaacggggtggccgaaagaaagaaccgcactctaactgagatggtgaatgccatgttagacactgcgggactttccaaggaatggtggggtgaggcaattttgactgcatgtcatgtcctgaataaaattccaatcaagtataaggaagtaacaccattggaggaatgtgaaaagaagaaattaaatctcacatacctacgcacatggggctgtttggccaaggtaaatgtacctatagccaaaaagcacaaacttggaccaaaaactgtagattgtgttttccttggttacgctatccacagtgtgggatataggttcttaatagtaaattccagagtacctgacatgtgtattggtacaattactgagtccatagatgctacatttttttagaatgaatttcctatgaaaaaagcacctagcacttctagtcaagaacctatttcatcccctgagcactttacaccgatagaacacattgatcaaatgtttgagggaaatcttgaggaggaaaacattgtagatactcgaaagagtaaaagacaaaggactgcaaagtcctttggtgataactacattgtatacctcgtggatgacactccaagaaccatagaagaggcatattcatctcctgacgctgactattggaaggaagtggtatgcagtgagatggactcgattatatctaatggtacttgggaagtcgtcgagcgtccatatgggtgcaagcctataggatgaaaatgggttttcaagaaaaaacttaggcctgatgatacaattgaaaagtacaaggcaagacttgtggccaagggttatacccagaaggaaggcgaggattttttcgacacttattcaccggttgctcgcttaaccacgatttgagtactactcgctctggcagcctctcacggtcttctcgtccatcagatggatgttaagacagctttcctcaatggagagttggaggagaagatctatatggatcaaccagatgggtatgtactagaaggtcaagagggaatggtgtgtaggctgctgaagtccttgtatggccttaaacaagcacctaagcagtggcatgagaagtttgacaaaacacttacatctgttggctttgttgtgaacgaaactgacaaatgtgtgtactatcgctatggtgggggagagggagtgatcttgtgtttatatgtcgatgacatattaatctttgggactagcctcaatgtgattgaggaggtcaaggactttctgtccaaaagctttgaaatgaaggatttgggagtggctgatgttattattaacattaagctattgagaggagatgatggtgggattacacttgtgcagtctcactatgtagacaaggtcttgagtcgctttgattatagtgactgcaagccagctcctactccttatgatcccagtgtgctattaaggaaaaaccgaagaatagcaagggatctattaatatactcccaaacattggttcattgatgtacttaactagtgcaacgagacttgacatctcatttgctatgagtaagttgagctgatttgtttcaaatccgggcgacgatcattggcatgctctggaaagagtaatgcgctatctaaaagggacagtgagctatggaattcactatgccgggtacccaatagtactggagggctatagtgattcaaattggatatctgatgctgatgagataaaggccacaagtggatatgtattcacacttggaggtggcgctgtttcatggaagtcttgcaagcataccatcttaatgaggtcaacaatgcaagtagaactcatagctttagatactgccactgttgaggccgagtggctttgtgagctcctaatggatttgccagtttttgaaaaaccactactagctatcttgataaactgtgataatcaaacggtgattattaaggtgaacaattcgaaggacaacatgaagtcatctaggcatgtaaagagaagactgaaatcctgtcagaaagttgaaaaacttcggagtgatagcattggattatgtctagacggctaaaaatctggcagatcagtttactaagggcctatcgcataatgtgatagacagtgcatcgaatgaaatgggcttgagacccacttgaagttacacaatagtggtaacaagctattgggtggctgagaggagaggcccgtgaattaggatggtgaaacaagctattgggtggctgggaggagaggcccttagattggctcatttatctgatgtacttatctccttgtctctatggcaagttggtgcataccttaatatgatccgagtgacttttcttaaagtagagatgttggcctatataacatcttagaaggaacacacctatatgagtctgactgctagtcacagtcttatagatttgggtgatctctagaaactcatgaagaggcctagagtatgacttatatgctccaaaccgagtggatgctttagtagcctagtactagtaaagggctttggtgaagcttgttcacacaaaactgtcaattcaaggcatagtccattggtcagttgtggataagtgtagcctctgttcaaggtggatcttcaacttaacactctcctctagaaaatacgggtatatcaaaacagcagtggagctgagagcatttctcgtgcgccgtgaaatattggtggggattgttggatttatttgtgtttggcacatttattttcaattaaatctataatattcaaggcacgcgttaaatgctgaagaattaccggacatgatgtgtgaaaggtttttgttcaagaattgataattcaattgacacggaggattgatgactcaattagagaacaatataaatcctgactattactgttgattgatggtgttaatttggcaaattaacaacgtccattaccaataactgatgttgttcaatgggagtaatggtgtttcggtttcaacatcatctcctttacctctgtacgcatataatcagagaaggagctagctcctggatgtatggaacaaaaacacatcactccaccctgttgttgctgcactagtgcattctcatcgctagtttctgcgtgcacagaactagcgagagcaggcctccgaaaccacgccccgctgcgacgtttgcacggaggggcgggcgatcaggattttagggaacgcaaggcgtgactgctcactgttcgtttgcttcatcttcttctttgtgccgtcagcgagagcaaggactgcatccacgatagcaaccaatgacgagaaaggtggcaccgatggagcggagaacatcaatgccaacggaggcaacaacaacaataatgcctcatcctcagaagcattctctgggtatattactctaactaccttagtgttaaacatgttactagattatgctattattattagtagcatattcatgtttagcgctatcactggatcatttcagttttcacatgtcatgtttattatctcgtttttctggattaaaatatgctgaattatgaccatatttccaacatgttcatgttgatatgcttgagagatattagtgatggacttgcattcgtatgttttgctcactgaagttcaaatattgatttctgcaattgtagacatgcatgtccttttctgtatgaattttgcttttgtgcttcctttgtttcgcctagtgattaaaattttggttcgaaattttggaccccaccagcaagcaactatatatctcgctcgaaatttttgaacttctccaaatattttgtgcatgtggtcaagatttattcaaattcaatcaaaatttgttaagatttaaaataattctgagcaaagaagtactggaaacaccaaaattcgtataatttcagtgacaccaaaatttcggcccaaactaaaagtgcaaactttggtttgacctatataagttaaacatgcctttgcaggtctgctcccactgtgcacagcacaatcatctcaatgttctttttttctctaggctatatatgatcatgtctgttgcagctgtcatataagccttttctccataggttcatacaagcttacatagtaggcttaggtgtgttatatatatactagtttgtacctctttccaacttctactctctcgtttttcacgtgcacactttttgaaatgttaaatattgtgtttatttcaaaaatattctataataacaaaaggttatatttttaagttttttagctaataattagttagccatgccaactgctctattttacgtgaagggaaaatttttgaaccgctactatatattgaacacatccttaaaagacattgagaactttagattcacattatatgttacagttactattgtaattgtaatgttttttcttcaattaatgccccaacagctctagctagggcgctaggtggcggatcgtctgatattgcgcccaacagcaactcactagaatgctttagcttttgagaaggaaacaaataggtggaacactactcccagtggatgatcccgaagtattggcattagataatgtaacagctttgttgtgatctctagactatattcaatatgtagagtgtgatgctaccatcgggtaccggacaactagaataatcacatcatgtgagtaaagctgtataaactctacagagtctaaaactaatcgattagccatgctcacggttatgagcggcttggtgaaatgatacaagtatagtgttggtgatttactaaatgatttgtgaaatgggtatggtgggtaataatgatgattttgcccggtgcgggctgagaaaaaaagttcacttactgccatagaaggcacaagaatgatactatgatgatatttatgctactattattatggtttactctttgatttaaatattttgttgtaatatattattatttactattgcgaaacaaaattttctttatgctaaaaatgagccacaaatatagtcatctttaatctcagcttgcaatagtcctaggtttcccatggcttgggtaggacttgccaatatcttgtgtattggcccatccctcgttgtttcttttagtcttatttgtaggaagcgggtgcttccgtttatcggagtttctagggatggttcttttctagggtgattcttagtaggttgcatttgtgatttgatagatacgtataccggagaacttatgtatattttccgctgcgtttgaaactctttttgtttggccaattggtggaaccattttgtaggactgttgccacctctaagttataagagccactttatgtacttatgtgccatgtgcattatatggatttgataacaatgttgtagatgtttatatggctagttggcgggactagtacagggtacgtttctaggtatttgggaattaaatccccaggtgccgatagttttaaagtggatctgataccatggttgaggtaccaaatatgatttattctctaaataatatgaatgaattaaataatcaaacagtactggatttggtggaggtgttgatgggtggtttgaagccaaaccgagctatatatatataacaatcaaggatacacaaatattcaagaaaatgcacacaaatccaacataaaagactcaacttaaatagaaaaatattgagtgttgcacaacatgtaaaatattgttgtgcttcctctgctttggcctatgtaaatccagcaccactttggacatctgctactagagagaggctagagttcatacttatctcattgttttttttaacaagcctatacatgagcatgtcttttgcataaccatgataaatctgtttattattaggtgcattaatacaatctttagtagtcttaggaggcatcggtaagtttgtattcaccgggaaaattcaaacatgtattagattgtaatatgcttgctctaaatgccccaatagctgccgagcggtggatggaggtgaaactgaaggggtgccaatcactagggactaaacatggaaatgtctatggcctttgtcctgaaggactgaaaggagtcttttgtcgatccctgtcttcttggaaaaagatcactgtgttgataaacgagttatcatgcttatgcttggataattaaattggcccctttagccacagagttttaaaagaaatattgtacagttggggctaagcacagacatacaacagtagtagagaagtcttacataaaatacgttcaatggagaatttttgtcagatccatttatttatctccagctaccatccatgtgttatatatatgcatgtgtttattaacgcgtatgtacaattttgcctcttctatgccatcccaaaagtaaccatgttagtggcaaccaaagaaatcatttatttccttcttccctcggttttgacgtagctatatagagagaatccattatatgcccctgagtttactctagttcaatgatttcccatcgactttgtcttcctctataatataccaccgactttatcaattttttctataatatgccatcaggatggataattttcaaaaaatacctaaaatgcccttcaagccatacaaggattgccgattgattggctctttataagttttgaaaaaaatatgaaagttttagtgtagccttcttatacgatataaagttttttttatatattttaagatttttttcaaaatatttttatgtggtatatgaaagatgaatcacatacacaaaacatagctacattagaaaaataattttgtgtagcatatgaaagattatttatataaacaaactcaacgttacagtattttattagcatatgaaacataaattatattttcaaaaaaattaataaatgcaaattgaaaatcttaaaatccacacacactttatattatgtgtggggactatgtaaaaaaatttatattcttacaatacttctggtaggtaaattaattgtcaaccctctatggcttgaagggcactttatgtattttttaaaaaatatccaccctaatggcatattgtagaaaaaattaacaaagttggtggcatattatagagggagataaagtcaatagcaaatcgttgaactggagtaaactcaggggcatagaatagatgctctcgttcctatcatgacttatatatgttgcttgtctgctcagtgcttacaatatagtcacggacagtcatctgatttggtcttgctctaattatacacgaacgtttgttcgtccatccatatcgccagtggtagttagctaggtgcaaagcgtagctaggcctaggaggcgatgggaaattcggattcagcttattcaggatactgggtaatgaattatcagattgttgcacacatcaatacatgaagcactcaatccagtggaatggtttattgttgagggatatccatcaggttaaaagtgacattattattttatcatgttatcaacatcttttccggctaacaaacctttttttgaaaacctttccagctaacaaacctaaagcctaactgaggttcgccatgtataacttcttatatgtacatatggataatgtttgggcatgtctccatgtattgcatacatgccttttaatctttggtatgcacaatatactccctccatattttaatgtatgacaccgttgactttttgtctaacgtttgaccattcgtcttattaaaaaaattatgtaattattatttattttattatgacttgattcgtcatcaaatattttttaagcatgacataaatattttcatatttgcaaaaaaaaagttgaataaaacaaatggtcaaacgttggtcgaaaagtcaacggcgtcatatattaaaatacggagggagtatatattaggcttaggaggcaaggagtgtaatgctgagtctaccctctccgtcaccattgagattatcctatatatagttgaaacttgaaacataaacttgatatgcatttacatcaattcagtgttcaagcatagcaagtgaaagaaactggagcatttacatacgtttacatcaatttcgcatgtactataaaccaaccaggcaaccacatatgttttacgtgtagttagggaaacaccttagctttacttcaatttcgcattcaactacagtccagttctacgtgtagtcagggaaacaccttagctttatcatggtggtgtagttgtggtcgtatgttttttgcacactagaactcaaattttgtattttgcagttgcacacatggaggtccttttttcagtatgaattttcgcttctgtgctctgttccggcctacataaattcagcatgaaactttgcacatctgcttcgattccactgctccatctcattgatctctgcctgacatctctgtttcataggttcctagttattactcctagctcagtaggcttatgacacattgagaactattgatccgtatgcccatctaatagaacacttctcgttttcaccttaagaacaggggagagatggacaactgcttactaactgcagaggagtcttttttatagttcgggggggggggggggaggtgcttctagtaactcccttcctattaaacatctacagtttattttaatgggtagcgtggagattatgggtacccctatagttggccataaggcccgaggcccgaaggcccagcccacggcacgcctttttggcccggcccaagcacggcacggcccgacttgggtcgggcccgtgccggcccggctcgaccgtcgggccgtgcctgggcctccccaccagcacgctgggctggcctggcacggtcgggccggcccggcacgatgggctggcaggccagacccggtacacaaagtatagggactaaaaatagacatataaatgtcaatgtctaaagaatagggaccttaaatagacttattttagctatttatataccacatcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgtgtcggtcgggccgtgccggcccgacaagcctcggcccaggcacggccgggcctgggccgtgctgtgccgggcggcccacatggccatctataggtaccccatacctacacggtatggttatccgactagttataggggatagcttgtatctatagaatatataacggatcatgacttgggtattacgttaccttgtatattatagaacggcctaaagtcctgatttgataatattgtaaagtaaatttaggataccgataccgtattggttatggtttctatgttgtaatcctacctccatcctatataaggtgggcaggagaccttctagggggatattgacacccctgatcgtcggatctacaatacacttggcggattcaaattctcaaatagtaatagggtattacctctcattgaaagagcctgaacctgtttaaatcctttgtctccgcatccatccacttttagatctcgtacgctacccctttatattgctgaaatattgtttcgacaggtagtttgaattgaaagtagtggctttctacgttgcttggtatgtataagaggcattgatcaaatagaatctagcgaactgtgattaaaggtactagtgagagggtacttaaagttgtggatcgggtacgaaagtggaaggttagaatagcaatcggcttcccattatgtcctccttagttttagggcaaattagttcatctgttacggtaattttcattgaatcattattttatcgtctggttgaatgaccatttgttcgatttgtgtggtttttggctgcaacaattgacgcggaacaaaaatgtgatgtaaattgactaatagatcgaatctgatcatctgaagagtgtgcatgagagatttaatttgtcgttgtcaaatggaactagaaggcatcatctactaagaagagtaattctgcatcatccccacaatcgtgtagcctctgtatggtaaaaacagcaagtcaaccagaaatactcgtgattgaccaaatgaacgacggcatggatgcaacatctgatggcataagcaagcgatgcagagtaaagaacactccaggatctctttgccatctctttggagttataacgcaaaactagttgatcataaaggtatctaacgaccaacgattttttctgtaaacaattactacctgtatttgtgtcattgtttgttaccaatctacccttcgagattcttctgtaatcaacggtggatactcatttctacaagaggtatgggagggacctttcaagcaccgtaaaagatctcgttaattcctatgtttcaacattaggtaacataaacagaaagtaacgggtaactttagccgtgatagccattccaatgtttcaacaactaatccaatataagtaacttgttctgtttaccggttgtctaaaattggactattgtgagagagcacgcatcatctttccgtggaagacaattacttggttgtagtataaatttaataaaaagataagttctctaaacatcatgagcccatctctgtctactgaaccattcagggcatcaaccatgcagctaatactactacggaaatgatttttctgtacaagaacccctataggttgtagatgaaccataactggttgtgtttgcaaaaatgaacccctattttcgcacacgtctacttatgatgcccttatgcaaaaaatcagcttataaatagccttattgttgcttgttatctagtcagatcatgagttatcaaagtgagagagcttctagacgcctagttgattgccgtgcactctctctctatttttgtaacctataatattgaagttggcatgtgtgatccgctactctgctctcaatactaacagttgtctcgatactctttatttaagcccatttcctagtgttattttgctaacaggaaatatgaaatttcgtgtatataactaggctattgtgtatgcattgtcaatttgtttgtgcaactctttcttgttagctagtacattgtatatagaggcttaggaggtatcgggatcacaagtttcagaccaaatggaaggcattgggtttgaattcttataaacagagaatgaggattcacttatatgtcttccaaagtttgctactctactagagaagaccgcctcacagtatgtttcattgtaataaccctttaagatattgcacgcttgtaggattctacaatggaatttgaagttcctaagtgcagaaaatcaagaaacattacctattagcaaaatggactagagatttgcatgctagacttagagcagatacaatagcagactattagccaactataaacatattttaataagataaaagatgagagagaagagaagcgggctacaaatctgtagccagctgcagcacggactataagacgcaatatgtgtatgacgggtgggaccatat

SEQ ID NO: 81272 - DNA, 11381 bp, Oryza sativa
tggggcctgggaataatggtagaggtttttcttttcatttggccaatttttaaatgacatagtgttgccatacccgccccccccccccccccaaaaaaaaaaagtcattggctgctactggtcttagaacgacgcctttctatattatggaacattatggaacataatgttttgtgctctgcagagtttgaaatcgtttcttggagatgatcagctaaaggtgagccttttttagttatagtgttgcttgttcacacataaattttaaggccatgcaatcgatgatacatgttctttgcaggaatttattaacttcacgcttcattacattgctgacttggacatcccaatcaaaaggtcagtgaacaaacctatctactaattcccattgggcaacagctccttatggaccaaataactgtttcatcaggggtacattcatagagttccgaagtggaatgctgaatgtgtcgcccatagggagaaattgtagtcaagaagaacgtgatgagtttgaaaagtatgataaggtacaaacaattctttacaaagagcaataatttgttatcattcaggcaccatgaaacttaactgacttatttactataggtacataacattcggcctaaaatggtctcagtgcttcgtgaaaagttcgcccacttgaacttgacattttctattggagggcagattagttttgatgtaagccttctatcctcatacaaatgtgccagaaattattggtttcatgatatttactgctgtatcactttaacaggtgttcccacaaggctgggacaaaacttactgcttgagatatcttgaggaatttcaagaaatccatttctttggggacaaaacctacaaggtgatatgtactctttttagcaaaaaagtgcttcctactttatgtgtggttaagtattttatccatacaatgctagaataacaccttatatatgctttgccccttttatgttcactacagtatattcttgttgttatctgtctatcatattcaactatataacatttccactatttagttcttcgcctgacttttttttcattcaatagggaggcaatgattatgagatatttgagtctgaccggacaattggacatacaggtgtgctgtttgtttcataaaagctattattctcatgacattactgtatatgcgttggacttgaacttcttgttataacttaaaacttgtgtataagataggattaggtttattggacacaaaaattttataatgttactgtgagacattctataaccatcagcacacagtcgtagatcagactgtgaaacttgggtattgacccaaccagacaggctattccaatcaagcaatactgcacagatcatgcaaatgaatgttcagtagcagtatacttgctggcagtttccatcattagaattgaccaattcaggttaatgttcatgaataaaattcagtttgaaacaaccacaaacacttgggtcaagtcttgaataaacaaagcaataacattttcttctggaaatacttcacaagttccattatggttgagctgtatcctcttactaaataggaatactcttgcaagcttctcatatgtggctgagtcttgtttgccgaggttaaacttgctttaaatcttttctgagctaatacatgattgatgccatcaccaagctgatttcatcatttatatttgcagttaccagtcctgatgatacagcagagcagtgcagatctctcttcatgtcgaagtgacctgattaccgtgcattttatttattttacatagcattcctcacatttcctgtatttcccttttttttataccatacaagtgctgcttcttacagaatgtacttctccgtattcacaagtttcagattatatgtgtacactttggttcaaataaatgagagctggcattgtttaccccgtctggctggttttaaaattcagaggtgtaaaaggataaatatacgcggacgtttggttgtcactgttagttattttctgctaaatccattattcatatctgcgagcaaggcgtgaatgtgtggcctttgtgaatcaactgtagtataaacgattttcggcttggcttggacctgttaatttgtgattccacatgaagtgtaactgtgagttagctggttgaactgccagtgatttccagttttttttttttcaccaaatcttcatgcagcacagtgaacgccattgaacctctataaaagttttactttccacacacaacgtctacttattattgcaatttagctgtactttgcgtacagctggaacaacaacgttgtgggacaagaaagtgaaacagaaccagtagaaccagtaagtgaaactgaactgaagacgtagttatacagtagtataaagctgtatacacaagaagcaagcaagacagaaaaactcaacgatcgtcgacctgggtttcccaaaccgccggggctgggttaccgcgccccggcggtaagcacggttaccgcgcggtaaccgtgataaaccgtacgaaaccgtgcaaaatttatcaaaaatttaaattattttttaaatttatttgaatttaagaaggttatcgcggtatttatattaccgtaccccgcggtaagcccattaaccgcgataaccggcggtaagtcgaatcctgggacgtcgacacgcgcatattcacctcatgatcaaactgaaccaaatactgaactgaataaagcagttaacattccagaagtactacaccgtcaaccagacaaacatggaaggggacagcaacttaccttaacaagttcagatagcatgaagctccaaccaagcatctctcactcatcagagtggtcatcagttggcatcatgattcataaacaaacatgcaatggttccacatagaggtttttaccattacattgcactgacattgttttcatctaccatctagctcagataacctgacctctaagaagtactgtactgacccaataaagttaggacatggtcttttctccaaatgggaaaaccagtcaattaaagagaaatctccctacaaaagaaaacgttgacgactaataattcttaagtgatgggaaacttaggtagattcttccatcaagttagatcaagccacaagtggcctgaagtgaatggtgctagacgattgaacgccttttgtggccacctcctgactgtgcaaaatgatcctttgaacaagcttgagaagcattggacccagcagtacatttcttggagatggcatgaggctcaaagccaggtggaccagcccaagctgttggctgtgactcagaacaattggcaactttgttcgacgcagaagagcaatctttctcagcaaccaaatcgactgatttagatccaggcaacctttccttctgagatgtttgagcagcagaagcatcggttgcagatgtagtggtgacttggcccaggttctcagctgttgtattgtatgcggattcatcgtaatagtgcggccaataggacgtaggtattccgacagccgcctttgcgggatcatgcattgtgaagtgggagtagaaatgcgccatgtaactgctcatagcatctggatgaacaccagctatcctaacctccaacacatgcccatccagagggtaaccattcatgtgagtgagagccacagcagcagagtaagcatcagcaaacttgacaaatccaaatcctttgctcacaccagtgtatctctcaacaactacttttgcttgagtgatttggccacatggtaggaagaggtcgataagtctttcgttgttaacatagctcgggagatggctcacataaaggttagtcatgtcgatttgtccctgctcattagaagacatctgtgatgtcagagcacccttggctgcattggattctgctggaagccccgcgactctcacagccagtatgcttccaccaatctggtagccatccaaatgatcaattgctgcagcagcacatgaaggattatcaaacctaaccatgccatacctctgaaatcgaaacattctagcttgaacaactcgtccaaatgggcggaagagatcgatgaattgatcttcagttaaacttgatggaaccctgccaacatagagattggccatgtcgatttccttgattggcttgccacctgcttgtgaagcgttggttgtacataactctgatctcttgaccactaacctctttccttcaaccatgtatccatccatgtgttggacagctttggtagctgagggtgcatctgcataccacactagactatactccagattcatcaggactttagtgatctgaccaaagggcgcgaaaagattaaccatcttatcggcagtcatcgaccgtggaagattagtgatgtatagtctagacttgttgatgtcttgagtggtctgtacagctgagatggatgctgatggggaaaggcctgcaactctgacaattatcatttctcctccaaccaatgctccattcattgctgcaatagctttggtagcagattcagaatcagtaaacttgatgaaaccatatcctttggctgaaaaggtgtcaggatctgccaccactcttgcatgggtgatcttaccaaatggaaggaaaagctcaaccaacttcttggtgtcaattgacgatggcatgttacagacatacagattagacatgtcaatttccttgacggttctggtggtgctgggtgattcaacagctgaatttctggtggtgctgggtgattcaacagctgaatttggcagtgttgaaggtatgccagatactcgaacctctatctttcttccatcgacaagacgtccattcaaatggatgacagcctcagctgcatggtgaggactagagtactgcacaaagccatatcctttacttaagcctgttgtgtgatctttggccacctttgcattagttacttccccaaaaggcagaaaaagatgaatcagcctgtctgtgttcatggacaaggaaaggttgcacacatacaatttagccatgtcagtttcctttgaaggctgctggctattatcctctgatgatggaaaaccagctactctgacctctagagctcttccttcaaccaagcgcccattcatgcgcttaatagcttcagaagcacagcgaggatcagaatacttcacaaagccatatccctggctcaaaccagtgaaacaatcatccacaactcttgatctgacaatttgaccgaaaggtagaaatagctcgatgagcttgtgagaacctacagaagcaggtaggttgcccacatacagattagtgttgtccacttctttcagcttgccaccatcctgaggaaacgaaggtggagtgtgttcctgtttcttatggaggtgcttgtcctggtcatcaaactgagctttccttttctccaactttgcagcagcaaaactctcggtactgtatgtgtaacatgatacatcatcagcaaacttgacaagccgttttttgaacggtttcattcccatttccatgtccactggtatctccttttgcttaatgctgtaacccattttctgggcctgcttgagctcttgctcatttcgttccttcttgaaagcttgcagagcagagttctcaacagattcctcctcaccagccaccaaatcatcatatggctctgcttcatgcataagcttcctgcaagtactgcgagaattaagcaccagattgatgaaatgctccacatgaaatgtgtctttgccactttacctgtgcacctcctcttttggtactgaatcatcacagggatccccacatattgaatcatcattgccatcgtcttcatcatcataaaacacacgttcatatggttcttcttcctcactgccatcttcatattcagcaccagaattcatcttgtcactgaaaccctcctgctgagcagccaaagtcacttttccacctcgtaattgtgcctgcaactggttcacaaagaagaggttctgaaaaaaaaaagaggattaacaagtgtttgagtaacagtacacatgcaaaaaaaaaggaggattaacaagtgtttgagtaacagtacacatgcagaagcttagagcaagtacaataggagaattaagcaggctataatatatccatcatggcaaaaaagctgagttggcggagggaatcaaggacagagaacttaagcgggcgactatattagcgccggctgcacgcagcctccaagactaggtgaatttactgcaattggccatacccttgcttacgcatagtgattgggtactagctgttcaggataaatggtgattggacagcaatcagtttgtgcatgcagcttttggcctgcccaaggaagaaaacgcaagctacatctatatactatatagcctactaaatgacatggcgaattttatagccagcaacgggcggtattattgatcctgctcttataagaagtaagcaatgtgcctcccaacagagagctgtgaaatctgtttatatatagttcaaactcatgtaaatttgcactgcacaacttgttacttctcttgtagttctatgttgcttttaacatcaatgccaacatgttatagggcacacattggtgatgccatcatgacaccatatttcacacatttatccgtgcaaaacaagcaaacatacacacaccttcctaaaaatataataatttcatacgatctgcagcacagtgacaccccggtgagatgacaaagtgcaaataatcaaacatcgcgttacacatctctagctgccccattgtagcaaatttgtggtttctttgccgtcaataatccatgatctctgcatattatcattccatcacagaccttctattctcaagaactcaccatgctttataccaacacaaacagtagtaaagaaagcttctcaaggaaatatgtgcgcagtaacacaaacagtacacatgcagcagctataataagcaagcagtgtgcctcccaacggggagctgtgaaatctatctagttcctcacagcttggcgcccttgcctattaatctttgcacccatgtaaacttgttagtacttgtcttgcttttaatttgttcttaagatgaaatagtcaaaaatcccgacatgttataacttataagtcatctttttttagataatggaagctttatttaacttataagtcatacgctggttatggcatcaagattcaagaggcaccacaattttacataaccttcctcacaaaacaattaatactagtgatttcacacgatcttcctccaaaatattaccaaaaggaaaaaaacaaggaaacaatttcacaaaacccgcagcacggtgataccatgacatttttaacactccacatctctagttagccccctgcaacaaatttgtggtttctgtaacgccaataattaatgatctttacatttttttagcatttccatcacaacccattaattcgcaagaactctccatgctttacaccaacgcaaacatcactaaataaagctttcgaagagaacaggtgtgcgctaactgaatccttgcatcaaacacaaaaccctaaaaaaagaaaaagaaaaaaaagagcaaagaatcaaactataaccaaaccccacggcacaatcgcacagcacaaacaaaagaagcacgcacgctggctgaagatcgcggggggttaacaatcaaaccgattgcttcccagcaagaagatgaacccagaaggccaagaaccatgtaccatgttccaagcggatgaactagtacacaaaaattaaaagaaaaaagaaatacataccaaaatgccaggcttgttgcagcgcgcggggttcgatcctggaggggagtagaaggagagggggaagttggaagaaggtgagagaagggccaagcagtgagtggagcagtaacaatcccgagaagagaggaggtggtggaggtggtggtggtgattaggtggtgaccctgcgtctccctctccctctgtgtgtgtgtgtttgtattgtgcgttgagaactgaggatggatcgagagcagcagcagcatgaggaaatggattcattttctttcgcatggaaaaagaagggaaaaaggaacagtaattgcgtgcaggccctgtgcagtctgcgagcagggaagagaaaaaaaaaagaagatttgtcgttacacagggacgtgaaaggctgaagtgaaggccctgtatatagtctactcctacaatctacatgtctaaaataatataatagcaatctaaaattagatagaacattttagggtgtggatcccctggagttgcctccaaatccacacagtggatttacttaatctaagccatccctttaatttgatggattagattaaatccaatccctttttccctggttactactagcccattttctttcaaaagaaatactacaatgtagagtctataaaaaaatattatctagtacagtagagaacatgttacctttaaactttctgacaacaattagataagaacaaacaaaacaaaaacattgcaccgatagaagcttcttgttctgtcgattattagaatgaatgagttcgatacaggtctcaataccgttaatttcttaacaactcagttaaaaaagtttaaagataattattttttactccatgatgtataatgctcttccgagactattgatctgaatggacggacaacacaaaaaaataaatttagataggattatttctgttgtaaatgtgtaattagaaagaggtgacatggctacatctaacccatataaacaaagtaaggggtcagattggtccaaattcaccggttgaagttggaagccaactccaggggatctgcacccaacattttatagtacaacgaatttgaatattcttttattcagattcgttgtactataaaatattttatctggttttaaattgctatattataggataccggttgctatattatggaacggagggagtacacgtatagactgtattcatttctctcattgggttctcatgaaaacttttcttttttcatgtcaaaagaaaaactttttttctttcatttttaccctatagtaaagctataccctctagtaaagctactactacgtactccactggtactatttagatgatgtttggattcagtacctgtcatatcggatgaatttaaagtattaaacatagactacttataaaactaattacatataaatgagagctaattcacgtgacaaattttttaagcctaattaatccataactagcgcatgtttactttagtatcatataggctaatcatggattaattaggctcaatagattcgtcttgcgaattagttcagggttatataatgggtcttattaatagtctacgtttaatatttataattggtatcaaacatctgatatgatagggactaaaaaattttaaaaagttttagtcatatataaacaggtcgtacgtgttgccgtgttcatgctaaaattgtttagcgtgccggctgcaaactttgcctttctatcatcgataggtaaacgcgtgtggagatgggggctgaaatttcgggcggcacgccttagcgagaaagtatgaaacgatttacacttccttatttcaatgatttagccctattagctggtcttaatgcaactttccatatctcatagataaccgttatctcatactaggtattgggagagtagaaattttcgttttgagtccatcgatctcatcttattcatgtgtttttcttttgatatattcaaatggatattctgtattttataatatttagttttacacttgcatttctataaaaatccatgtttttttaatcctgtgtttcaaatatacttactagacaattcatgtatgaaaattttagatagaaattgctactcctatatgattattaacacaacccaaatatccaatccatatcaaatcagtcacacgtcacatttgcagtatagagtagcagccttactgtgctgttcactggagtgtgcagataaaattaaaatcatccgtgaagaaaaaaaggggtccaaatacaccaaaaaggaaagcatcttgtctgcacaaacgggatacacgaagatccacgctagtgaaaaggattcgcaacctatttactaatatatctttctacaagggtccaactgcaaaaatacctcccattttgggcctttttgggaaaaaccccaactcttcaggggctcaaacgcataattccaaaactttctcgtcctaatcgcgacgagctcgaaacgaacatggccggcggcgatggcggcggcggcgggggagacgagagcgagtttgtgggggtaggcggcggcggaggaggaggaggagaaggagaagggaaccagagcccccccaaccgtaggttcttcgtggccgtgcacgtcggcgccggcttccacgcgccggcgaacgagaaggcgtaccgccgagccatgaagcgcgcttgcctcgccgccgccgcagtgctccgcgaggttttgtactttaccctatcccctacttaccccccactcgcctccttctcctcctgctctcgtgcttggttggttttgtatggcatggagctcggattgacgcgcgatccccaccaagtgttccatctgagcaatggattttgactggcgagcggatttatgttctagatggggtattgattgaagtagtgtgaaaatgtaatgctcgagcggcgtccatgtagctttgcagtggtgaattcctaaatctcttaatacttttgcagggaaatggcacaagccttgatgcggttgcagctgccattcaagtattggaggtttggatcatctctttctacgtattgttacaatgtctacacgtactatgcagtttagttcaaattttacaatgggtgacaaataggatggtgtatgatatatggccacattttgatatgtcaaaaggggggaaaaaggaagagtggttctatagatcatataagcagggtttgcagacctcctagatataagcgaatcgagggtgatacagtgtacttgtatgtagataaagggctaatggtgtttgttccaagcaaaagttgtcttagtttatccattctcatctatggctgattaggatgatcccatcacaaatgctggacgcggttcaaatttgactgagagtggtcatgtggaatgcgatgcaagtatcatggatggttctactactacctttggagctgttggagctgtgcaaggtacttgtagtaatttgcgataaatcaatcctcctgtgtaaaagttactatttgtgttaccacacgtcttatttcttgtagatcaggtgtaaagaatcccatccaaattgcttt

SEQ ID NO: 81273 - DNA, 7691 bp, Oryza sativa
tcacagtatgtttcatggtaagaaccctttaagatattgcacgcttgtaggattctacaatggaatttgaagttcctaagtgcagaaaatcaagaaacattacctattagcaaaatggactagagatttgcatgctagacttagagcagatacaatagcagactattagccaactataaacatattttaataagataaaagatgagagagaagagaagcgggctacaaatctgtagccagctgcagcacggactataagacgcaatatgtgtatgacgggtgggaccatatattaattgtatagtaagcaactactgtattaattggctattagattggctatagatgaattggagctattagtgggctatactattaaacttgctcttaggtgtaacatggaggatccctataggttgtgtgcactgtatgcatgactctcttggttgctacactacaatgtttgacggccacatctgtcctttttggaagctgtgtcactttctcttttcttggaccatcaaatttttttaaatttacggggtatataatagggttcgtaggcattaggaatgcagggtcgagcttgcaagtgaacacgatatcaatcattccacatatatatagtaaaagtagtaaggcccaccatgattatctgctaggttgtgcatcgagagaatggaaggtgaaattggtgaggaaaaataatcgaggagggagacgagtaaaaataaaaagtgagagagagcatatattcctaaagcctgggaacaagagcattatccacaaaagagatatgtattgagtattgtctactgatgagatggctatggggttaaacataccagggttcaatttgtgaaactcaatagatggatgacatagttagagccgtacataattccaatcgattttgctatatatttatcgaaaaatttttctctaaaaatttgacagatgtaattacagtacaatcgtagtgtaattacactgtaacttatatgtaattacactgtaactatagtgtaacttgcatgtagctttcaaaaatctctccgtaacatgttatttcggtaaaatggaggtcgtgggaacaaattctttcacatatgtgtgtgctatgatttgttttcttcctcaccaaaacaaatcgtgtaatagatttaacgattcaaaattatgtgaaacttacatataagttacactgtagttatatgcaagttacagtgtaattacatataagttacagtgtaattatactacgattgtactataattacatctatcaaatttttggagaaaaatttgtcgacaaatgtataggtagtcccaattccaataatcgaagtgatgcactagcatttacataaacacatgggcacacaggagaaatatcgcttgtgcatccacgtttatcgctagcatccatgttttatccttacgtatatgtttatgccggcctcttccatgtattcttaaacttagttatgtccctaatgtcaatggcaatagtcatagaaaccatttactgcacttcctttgtttctacctacatatacaaagtcatcgtgactttgcttatcttcacacatattgcttacatatagtcatctatttgttttttgtaagttatatggatgttccatccacgtggcacggttgattcctaggtgcataaagcctagcaagtaggtttaggaggcaatggtaacttagaaatctctttgtgaagggaatgaagtactgcgatactttatggtttagcgtgacacgactccgatgagaacgctagggcaagcaacgatggtaaaatatgtaggagaaaggtgcaaatgtgcaattggcactgatgtgttgtaaagagatcatggcaattctaacatggctatgaattttttttttgacctacgaatgggccgggcaattctaatgtgtaattttttttttgaacttgtgaatagggattgcaatttcagaaatttcaaaccctcccggcaagtgattatctcagctgaattttttgttttttctcaattttttgaccaaatatttagtcaaattcagttaaattatgttaacatttaaagaaaaggtccaaaaagtcccaaaaataccgaaatttcagccaaaatcgaaattaaaaaccctgctcgtgactagtataaataggtgaccaccaaactgtgtaaaaaaaccgcatgatgcataactgaacagtgtttgtgaatgccactagctaccactatgatattagatggtgacagccaaggaaataaactgcaaccgcgcacaacacttcatgaaataagttattattattgtttaaagaaactgcaatttgggcatcactttcaattcgatactcgatgtatatgatagtttggataatgatccgtattgtccagtccattaaggccctgtttagatccaaagttttgttttcaaactttcaactttccatcacatcaaacctttcatacacacgtaacttttctatcacatcatataatttcaaccaaatttttaaatttcagtgtgaactaaacacagcataagtactagtgtagtgctacttcatggcctgaacccgcaggttttatgacttttaggtaggattggatgtgaaaaagcattgaaccggtagtgttgccctatcactgttaaagtgttaattcacactgaaccagcagtggtagcccgttccgtggtagtatcacaagtctattatataggttacatgaaatatctatttgtggcatgcatttttttttatttttgctcgatgtatgtctcccttgtaatcgaataaatgggttgtgacaccatatgtatccagctttgaggactatatatataatataagtcgcttgtttgccagtaccatttctggtccagaggactcctccgaatgaaacatatattctcctgttgctcactcaaatgtgaatttacacctcgtcatgtatatgaccttttgggtgtgcatcatgcagtaggtttaggaggcatccggatgtacatcagtaacttaaatggctgaaaaatgcagtagtgaagaacaaatcgcgacggcagcagcgatttgggtgatggcggctagggcttgtagcagctgctgggctatcgatctcttccccttttcttttttttttgttttttttcagttggtttaatagatatcctgatgaagatcgaatggcccatattaattcgatcaccgattactataaacttattgtctattttgcactactcggcgagctctacgcatccgcggttcctgatcgcctattcaaacaacggtttaaaaatttaacttttgtgcgtttgttctaatattccacgaaatatttcctgatcgcctattcaaacaacggtttaaaaattgaacttttgtgcgtttattctaatattccacgaaacatattaattggaaactcggggcattacattcttccccctttaattaaattcgccctcgaattcgtccaaccattctctagaacacagggtattacacgatgatctacaggctttccccaagctaggcgtaatctgaagaagtttgcagccttgtcccagtgtgctaacccattcaaacctctcagtcttaggctccatagttccataaacttcaatacatatatacactgcagtaaaaccttgaaatcagattctccctgcgtcccaaattagaaggcctatattttttctatacggtcttcaataacatacttgatcattaatttatttcatattatgtttcggacaaatataaaattagcatcacattaaagtactctaaaatataaatcttgcggtataacatgcataatactttgtgtctgtgtgtaaattgaagatgtttttgccgagattttggtacattatccgtgtttgaatcagattttaagttcgtttacttttagaaatacaaaagaagtcgtataagaaatctctttaaaaaaactcacttactaatttcagatgaaagtcagactcctaattatagctcatgattttctcaaagaaaaatatatccaagcgaattctcacagtcaagttcaccctagctaaatgtcacgccccgaactagtcccgactggaactaaaccgtgacgctccaaattaacctgttaatcgataccagtcctagaaaacagtgctggtatcacaggaagatagaatatcacagcaacagaggtctctttattatagagtaggagtacagtcatgttgggctgcggacagatcccgagctcacaactgcattacaaaagggaaacggaagccaggactcaggctaaacaacacaggcgcgacttgggaactaggccgaaaccctaaaactcatcgtagccggcttgctcctggaagaactcctcatcagcaggatccgcttcatcttcttcagcatctgggggggattatttatatagagcaagggtgagtactggagtactcagcaagccaggggaaataagtgtttaatgcaggcttcaaggagaggctggtgtttttgcaattgattttatttgaactcttttctgaaacaactaagtgagtgcttctcaaacgacacggatgagacagtgtgtctcgtccggtcggagtatgtgcaatgtattagtctttagattttgaaacaaggttggcacccggccaacagcttttcaaacggccacccgggccaacaacttccaaacggccacccgggcctagctgatcccatcagctgcagattttccaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggccgggcttaacgggccggccggcccaagaaggcggcccagagcggcccaagacgcgcgcgcgtgggagggaggagagagagagagccggtggaccgggcttaccacgcgcggtcccgggtggcacccgcttgtcagcggctcggctcaccgtgcggagggagcacgcggcgcggcgctagggtggggggaggatgcggtgcacgcgcgtggttcgcggtggacgcagatgcggcgggcccacgcgcagcctcacggctcgcggtggaacgcgcgcacggggaggggctgaccggggtcggctcgacccggtcttggctgagctggtgccgacgtggcgcctacgtggctgccacgcgggccggcgggaggtagacgacgacgccggccggaacggacggtggacgacggcggcgagcggcggagcgaaccacggcgatacaggcaaaagcgagcacaccgggtggttgcacgtgacgaggggagacgagccaacggctcggattcgccggaggaagcttgacggcggcgaatcgcggcggcggcaaccggcggcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagctacggggaggctactcgtgctactaccgaaaactaagggggagagatggagcgaggaggaagaacggagggaggcactaccgagatgaggaggggcgctgggacgagaggccgacggcgcgggagtaatctctccagcctcgggccgaggaagaggaagaagagggcgcgcccggagtccccttccgcgtcctagtgtgcaccgaatcctccggcacacatgcgacgacgaacggcgacggcgaacaggggcgacagtggcggcaagagacgaaaacgagggagattggagggggaggggcttgggtttaaatgggcggcaatgtcgggttgggagaggggaaccggcattggacagtcaagccggcgagctggcgctccggctagcggccaaaacggcgacaggaggtgacgccggcgagagggaaaaagggaaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgacggcggcgatgacggcggggcggtttggagcggcgcgacgacacgagcgacaggcgctgacgacggcgacgaccaggcggtcggccaccacggcacgcgcgcgcgggaaacaacgggcggcgcggcggatttgagcggcgtggcttgggcacgcacgctggcatgcggggccgggcggctgcgcggctgcaggcgcggcagggcagcggggccgggcggcgcggacggcgcagacggcgcggctctcgcgcacgcgcgcgtggcgcgcgggcggagctgagggggaggcgctgggcgcagctctcgcgcacgcgcgcgcggcgcgcgggcggagcggagggggagggggagagagagagagagagcgccggggagggagggggaga

SEQ ID NO: 81274 - DNA, 631 bp, Oryza sativa
gtggcgaccaccaccttcgggcactccgggatgggcgggtccaccgggttctgcgacgtggagcacgggctggccatggccctgacggtgaacaagatgtcgctgggcggcgtgacgcggcgcgtggtccggctggtgtgccaggagctgggcgtgccggtgcccgacgagttctccgtcgccggcgacaagggccccgacatggtgctcaacctcgcgccgccggagtagcaccaacctgccaggccactactactgacatttcatcatacactttgatacatatacacatgtagctaggtaagagtaaactcatgatgatataacaaaatgaggggaaaaattaatgttctttccgggtatacgtattagtacaatatagtagtacaaatttatgccatttggatgtggcttcgtcatatatactccaaattatacatgtatacaagatttttgtttcatttttcctgtttacatttgcaactgtgaggtgcccagtgatgccatgttggaaaattcgaatatgctgttgtaaatgatttgagattccagattagaacccgtgagtctgccacagatgtctgaatctagatgaggatgaactcagcgcttgcaaaacctgaaagataat

SEQ ID NO: 81275 - DNA, 14280 bp, Oryza sativa
ttgtccgtgacgccgtcgttcacccggaacagcacgtagtcgagggtgtcgttggtgagcccgccgtagaacgggtacgcgttcaccatgaacggcgcgcccgtcgcgcgcaggaagccgagcagcggcttcacgacggcggtgtcgtagccgtcgtggaaccgcccggcccgacggcggcgtggacgcggccaggatgccgagggaatgcggcgtcgacaccttgatgatctcgcggcggcgcggcgacggcggcagcacggcggccagcgccgcgtgcaggttccgcatggccggcacgaggctgagcagcagcgtccggttggcctgcgagatcacctcgtcgccgacgaggacccgcgagacgttggtggcctccgcgtacggcgcgacgctggcgcgcacccaccgccgcgcggacgcgcggctggcggcgaggcgcggaacgtcggcgttggggacggtgacgtccacggcgaggccggtgccggcgaaggcccgcagcgcgcgcgggtcggcgtccagcagccggacgcggtcgaagatggtgtcgcgggagaggaaccgcgcgacgtcggccggcggcggcatggtcgtcccccgcatgccgtaggtgacgccgacgccgccggcatccgtgcctattccaagaagacgaaccagtgcttacgtcatgtgtcacgtcacactgattcacacactggctcaaatttgcatagtgattagtgaccttacctttgacaatggaaatcgagagtagagcaactgagaggaggacaccaagcatgtttggaagcttgtgtgtgctttgctctagcttgttaattactgtcactgacaagagtgagtcttgatttgtgagatagtggcaatgcaatgcagcacgcaattcttaaaggatgggagcttaggttgttgcgtgatgacagagtaatctgtatcgtgattctttctggggagaggagatgttaaagcctaggatcatatgacttcagtatcgcttatgttttctggacagttcgtagggttcctttgtgttgtagatgaaagggattcttttctttggctttgagttgtaggtgtctttggtcgatttgtctgcgctttttgttcttgctcgttagcttttgtccctttcctcacaaacacttttgagacaaattggagatcggtgaagcttcaaattaagtggtctaaatgtgctgaacgatgcttatttcagccctacaccacacgaactctgttgaacaaaagaaacagagcacaaaagagagagggagagagagaagtgagaacaatgaactgttgccactgcaaacatagcatatttagcagccctacaccacacgcattcgtcaggtaaagccaaatcacgacgctgtaacatggtaacagaacgtataataaattttgagttatagccaaccacaagagcatgtatgatacaaggagatttccaacgaatgagcgatgaactgatcacatttttacatcggtagcacctaaagctgattctcccaagacccaaccccctggggtatcgagacagtgccagcttgttctgtagacaacacaacgagtcatttctattcacccacacataaacaagggcattcgaccgacgtgttggacgcaacgttttctgtacctcatgaggtcagttttgttccttcactaaagaatctgccattcctcctctcctgtttcacctgaggcatcgaggtcctcgacattgatgttgccatcccctgagatgcccaacacatcgtcctgattgtacatttgttttgacggttgaaccgactgcacaacagtgaagagtggtgctccattggctttatctactagctcagtggcgcgagaacagaaatcatcgaagtcatctacataagcaggcagacagtaaataagaaaaccaagattagagtgaacttaaaatgatgacgcgacatttgttcgacaatcacagttcacctttatcacggcagtaaaaaccaatagccaatgacggatctatcaggtctagggccaaatctcgtacagtgctgtcaaagtgcagctagataataagttttttcattattgaaaaattaaaaggataacgaatattaggtaccatttaccaaatcataactgcaattgcgaacatacctgcagtggtatgaagaagtgtctgcctctatgttatcagctgcaatatcaactgcctgagatgtagagaacaccccactgtaactaccatagctcaaaaatgaaaaacaaaaatagctccctagtcattacattgataaatacaaaatccatctacttctacaaggttactaaccaaaatggattccaagcaaaaagggatactgcaaaaatagccagataataacggtcgctgactgcatgcataatagacaaaggcgaacactaatataccgctttgctgtttttttgtgttgccattgttgtgaatgggaggacagggcaccattaaaaaggcatgaattacttatcacattgatgaaatcaagattctaaattacaacctactacatatgaaagttttacttattgaccagattgcagatagaaaaacacatctataaaattggcgctcatatatgctaagtaaataatgcagttttaccatctgaacttcatggggatctaggtagagcgccctgtcatcctgtaccccagcaatgtaggttgatgttccaggctttccacccaaaatccccaagctctgaggaaatgtgaacgtctcctttagtaaaggaatgtacctgatagtaagggcaatggcaggaagtgattaatactagaaacaaccatcagtagaaacatcaaccgttcaagggtgaccatatgaagcctacaaagaatgagatttaatagcttgctgcttaccttggattaattttgtcaagaccaagaaccagagggaccagcaaaagaatcggtgaccaagttgattgacctttgttgaaatcacagcaaagctgagcagcaacatcaatacaaacaactggagctccacctctttcaccatcttcatcaccggataccacataaagagccatagggaaactttcattcccatcaacaacttcatgttgctccctattggtgcggacaagggtttgccatgcccgacacatggcgtatggacccacccatgatccagcagccagaccataactatttccagcttgaagtaaattgtgaattgagaaagcacaagcttcagaatcaccaaacatgtgtaagatccctatatattctgggttatatggctgcatatgaacatttgatcattgtaaaagaggcccatcacctactacaactgaaaaaagaaaattttcattgtcttaagatcagcaggtagtcatgtatctcaccttctccaagggccttctccaagatctgccaagatggtggaaaatcaatgcctgcaaaaatccatccaagtacattttacaaatgcagtggtaaaaaaaatgctgttatttcaatcaaataaagtcgacaagcacctgagcaaccagcatctggctgcttctgaccatgcagccccagttcacatcactagtatacttggaatcagagatggcatcaaagcctgcaacaaaaagacagtgcaaacaactcacaactgatttccacacattaacatgctgtaccaggcatatggtcgtgtaaacaaacctacctctgcgataagtgatccatatccttgacgagaagtcctcaagaaatgtggcatgcccactttcggaatctgagtcactagacgactcctccgacgaaagcttgtaacatttaccaaggaaccacacatcacttgaagtgagaaccttggaggtgcccagaaaacgccacattgagccagagcacacgatcctcctcaataccctcgaccaatcataggatccagaggacgatttcggcgacttgtttgcggacgaatcctggtgcgcctcaaagatattgaaaggtgaattgaaaacgcaggacaggatcgaggttttcgattgtttcaggctacaatcctccttctgttccgagctagaagaacaaggtgcaatgttaccctcgcacaacggatcagatgaagacgatgatacacccctatcaggcaagctcgtcattacctaacaacgcacgtgtgcatattccatccgcaattgggtctcctaccgaagcaaaatcaatctcctgtccaagaacgacaggagtaccaatcaggtggtgttggcacagttccttcctttcacgattgtacttcagcacgcatcaaacgaatcttctgcaacgcaacaaactggatgggccaattattacatttattcattcattgcagagaaagaaatatgcggattagattagccacagcaaaagtgaaacagactagaacaaaactccgaacacaacccaatcaagcaagctaagagagtccatcaccaacaaaagaacacagcccaattccagatggatctctgcagttttactccacgcaggcggtgcggcgaaggaaggcttgggggagaggaataccttgggggttcgagagtcgagaccgaagcgtggctcttcagttgaggccgaagcgacgcgtgtccggcggagagcccgaatcgccgcacccccgtccgcgtgggggaagaggatagatagagaaagcacggcggcagcgaaggccggagcaccggcggcggggaggggaggggaggggaggagcagccacggcgaggcggcgaggtggggggtggcgtggcggacgcggggaggaagcgggagacgagatggagacggcgaatcgcggccgaatcggctggctcgcgaggaaaggaagagggagtttagttggtgggatggttaccctggccccaccagtcagtgaccgcggtgggcgacgggttggtgtgtctgttggttttgtggtgccgtggcgtgcaacagataccacggagtagaagtagaagaagatgcttattaatacgctggtattccctaattattttggtgtttttctttaagcatagatgctagtggtagcggaatttgcacgggcacgtcaaagaccatccatttgtgtttgttccaaacgtgcagaaaactaatcgtgtcatcagggtatctatccgtttggatttgcgtaccaagagaatttagtcgcatcgtttcgcatgctataacaaaataatgtacgaagatgtttttacgtttgtttttagcgatttaagagtcaatgctgaatatataaatcacaatgaaaagttaaaatcaacttaaaatttaaattctgattagaataaattgcattttacacgggggtagaatgtatcttgtttcactttacatcagagtatataaaataaaaatcacttcgcaagatcaacagagagcagcgagcagcgacgtgcgatttgagatttgacagttccacaatgaaacaacagtgcggtactttctcagttattagtacagatatcctcaaacaggacgcatataggcgagtcacactcacacatgaaacctgggaaccagaaagtggtaataactagcagggactacagcaaatggtcctcttctatccatactcacacccatacttgaccagcaacttaacatcctaacaaacgaacgaattaaagaagccaattcctatctgctgctgtcgccgatgttcctttctatcatcacaagtcagccgcaaggaagttgccaggcagggcaatctgccaatcagagaacagtgagttgtttcttaaaaacaagttcaactggcatcttggtgttctcatgaatcaagaatttagggtcaggagagataattaccttctcgcccggcttgaatgctggtagacctctgtatgggcaagtaccacatcgaaatgcatcgcccaacccacactgcaattatcatttcacacataagcataacaggaaggcaacaaatctgggtaacaggatgaaactatggattttcagagggagaggaccaaaggcaaaaaaaaataaaataaataacacttaaaaagcagtcatgctcacattgccacaagctgactgagggttattgatctgttctgatgtgagatttagcttctccaccttctcctcagcctcagcccggccacaagtacagttcttgcatgccttccttgtggctcccacctcacaatccccaactggtaaaacataagcaaaccttcaggatctacatattaaatttatagacgttgaacaaagctgaagggttctataaaacagtaccaactggaagttctggtttcttcaagtcgtcttcagtcaagaggctgtcttcatcaatcagttcagaatcatcatcaatctgaatctttggaagaccctttgtggctttcttgagggggaaggaagagcccatgctccaagagaccttctttgccttaatctgcatgtgattcagttagcactagaaagtatgacggcacagaagcattaacacatattgtggcactagatcactcacagtaacagaatgctcgctatcctgggaacttgcagcagaagcttgcacgtcaacaaatcctcctaacagtagcttgcgctgaatagagttattgggctgatgaagagaagatcagaagatcagggagtgcaaattaagcattacaaaataaagtatattggcaaaacagtacatacatcctgatcagagggggaactctgtataagcaccatgcctccagctttaagaaccctgcttatttcagttatgaacagatcgcccaagttttccactttcttaatgacagcaagaacagaaccaactgatgcatcatcaaaaggtaacttcccacctgaaccatgccaacatggaatgttcaaaacgagcttatgacaaaccaaaatgtatactacaaggataaggtatactaaagcataacagaaatcgaaactgaacatatagcagagcaaaacagtgtgtcggttgtagggtccaaattttggaatttagtagtcattggtgagaattgcatattgcatattaccactagatgaatttagataatcaatgcagacatatagggagatgttctccaatattttcccctcgtgattaatgcgagcatatggaaaaaaatttttccttcgtcaaccaatagcgctgtctcacaggtgttccctatttggtcctacatgtggtgaaatgaatctacatagaattagcatatgaagtataataagggggcgtcgtcagaaatgagctccaatcccaaacaggtctttcaaggagctaccatgaatcgattgaactagtgtgatttgtagggttggaacaaatcaaaaccaaaatcagcaaaaggacaaacgctggtaacacagcctaggcacaattccagattgattctaagcacgcaaagtcctaatccgagtagatggattcagtattcaaacaaatttcaggcgaaaagtattcaaacaacccaaacgagacgaggagaagctcaccaagcgaggcgcactgcgtgatgaccaccacctcctcccgcgagacccccgcggcggccgccagatcccccaccgcgcggagcggcaacgccagctcgtccgtcaccgcgagcgccgcagctgtcgccgccatatggacgcagatcgacgcaccacctgcaaccgcgcaagcggaatccaaaaaaagcaaacccccaaccctcaaaacgcgatcggtcaatcggtggagcaagcaatcaggaaccggaaccagatcgaagcagccagccgacgattcaaccggcgtacggatggaggggcagccacggcgaggcggcggcgagggagacgagatggagacggcgaccttgcgggcgaatcgggggctcgagaggaaagggagagagagtttagttggtggtctggccccaccagtcagtgaccgcgggggcgtcgggttggtgcatccgttggtttttgtggtgccgtggaatgcagcagatacgtagtagtagtagaagatacgctggtattcccattttggtgctttttcaaaaagttactcccccatcgtttggcttttttcttataaaccaaaacggtttattagggaataaaaataaatttataggtaaacgttttatatatgtgttcttggtgacttaaagccaatgctgtaaaagaaactacgttgaaaatatctcaaaatcaatctcaaatttaaatttaaaaattcaaattttagctttttctttggctgtttaggccatcagatgggagcctagatgtagtataaacctggtgtaaagggagattacattttatcaacgtgcattctactcttttgattaggactaataataagatgaaaaggagtccttttaatattcatatgcatcatgatttttttaatgaatcggcgagccgtcaatttcattgaacataaaagaagtaaacaaaagaaaaaaaaagatgtacatgtatcccgggctaactaaaaattaaccaatcatggagacttctcacgccagacccaagttttggcctcctccttacatttgccagtaagctggccattggaagcatgattgtggcccaagagtgaggcctaatcttgtttgggctgggatggctgaaccgtattgatctacatgctgcatcgttcaaaacttcaaatgcaagcacgcgtgaatccctcagccaaatactcccacaaacatttttttttcctttttcaagtcaccactaatcaaatcttatgttgtaaaccaacgcgcctattaacggattaccggatccgttccctgtccctcccacagcagtagagacgtgagatgatgtaaatcacccacgtctatccctttttttttatacaattaggtgaaaatatgcattgcatcaagccagtctccccggcatgttctcgtctcatgagttcatgtgccggttccagctcaacctaggccagaggaggctgctcggctcgtctctttctgcaagataaatgctaggaggaggtcattgacccgtacttaattcttctttttttttaattctcctcaataattaatggttattagtaagacacagactgtcagagtgggccatgctggctacttggccaccttggctggcaccttcaacgacttgctatatgagttggtgaagattactggccatactagcaaaggggaaagtgcctgtgcaacatcatcatcaagaagaagaagagatcaacggcaagaagactagcgactagcgagagatcgatcgaagagaagaggagagatggtgcacgggaagctggaggtcctcctcgtctgcgccaagggcctcgaggacactgacttcttgagtaaacacacatccttctacctcttcttgctgtgtttgcaaagcttttgtttttgattacgccatttcttctcttctttgctggttgactgcttaatcgtttctttaggattgtgaacctgacagattagatgcatgaacaaggcatcaatagatatcatgattcattaccagtgaggatactagacagagtgatcgaggaggggcatttcgcggttggttaagcaattatcagcatgttgttctagctagatcatgggtcaacggtgacttatagtgcttgatgtcctgttgttaatgcctaacaattgttttatttcacttcattactctaaagcaaacctaaaaaaaaatatgtatctgcatgcgaaaacgacgaaggatggataaaagcacgccagtatatcgtggagttttgcttgtgctgtcctgtcctacactcctactcgagtaaaaagttaaaaacatcatagcgttagagtgagaaagcatgtgtacgtaggggctagacatactcaatcacaatcttctcaaactttatctgagaatcactgttttttacgctcttcatttgatgccaatttgtgtgtatttttgccaaatcagacgacatggacccctacgtgatcctcacctgccgcactcaggagcagaaaagcagcgttgcaaaaggtattcgttaactgttagcacatactaattccattgcattaggaacaaggttcagtgctgttgctatggagcatcaactgatttgtactgtacctatacctaaatgggcgggaatacgatcctaatctgatgaacctcaatctttgctttcaaacgattcaggagcaggaagcgagcctgaatggaacgagaccttcgtcttcaccgtctccgacgatgttccacagctcaatgtcaagatcatggacagtgatgccttctcagctgacgatttcgtcggtgaagcaaagtaagcatctaaattatgggtgacactctgcattcttccattttagcagtgcacagctgaaatgcagcttctgaactcaaacatgtttatccatcttgagagtagaatcccttcttccatgagacaacatgagcttctgaagaaagttcagaagaacacctttctctgaacatctcttcagagtgatatttgtcagtctatgcatgtatggttcttgctcacctgtgcaaaatttcagcattcctctggagcctgtgttcctggaaggcagccttcctccagccgtccaccgtgtcgtcaaggaggagaagtactgtggagagatcaaggttgctctcaccttcactccagcagcggtaaaaacacttacctctgtctcttgcaacatcgatggtgttgttgccattgtgtctgaacatctggttggagtgtgtgatgctaatgtgctggacactcgaatttcttcaggaaactcgccatcatcacaaccacgagaacgagggggagggttacagcagctggaactgattgcctgctactaatgagcatcaacgagaggagatcttgtctcaagaattaatgtgcttgtcaacaatactccgtgctatgatgtcctaagaactgaaacatccatttatatgtatatcccagaccattgacttgctctgcctaaattttgtatattttttactacaaagatgtgatggtgtgaaatccagaatatttttatcgaatcatgcactttctttcatgacgagggcaaatctactttgcgaacgcgacaccgacgcatattttcgctgatataaaattaaccttaccaaattttgggaacaccaaaatttagcaaagtttgataataccaaaatttggtagggtagaagtgtgggtgttgtttgctttgctaccatgccaaatattcttgtgtagtgttatgtggagaagtttgtaaaaaatcaccgaattttggcatggcaagacatggacatacggggcctgttcactttgatgccattttcaaccttaccaaaatttggtaaggttgcaaaaaaaagtggctacatttagtttgctgctaaattttggtaactatataagaaatcctgcaaaaaatttagtaagttgccaaaatttggtaaggttttttttttgcatcaaagtgaacaggcccattgtggagtatttgggatgtgtttagaactttagattactaccttatcaaaatttgacaatattaaaaaatgcaatagagatcctctagcacgtgagacccacatgtcagtgagcagcgcaacacatacagttatgcagaagacattctccaaaacttggtacggtagaaaacgaaaatgacatcaaattgactatcccatcccaagtgttaacaaaggcaacccagacaaacaaaacggcccaccgtagcgagatgggccgagcaggccacggcccacaataaaaaacgtactcaggcctctcacagtgctcctagctggatcagtgctacaccatgccagctaggcttttcgtgtgcgtggcagatggatgcgcgccctagctgagctcctcgcccccaagcagagccgcgcggaacctggtccaagcgagggagcgcgcgacgccgaaatccccgggcatgcgcactgtgggcagcatcgcctcgcacacgcgtgccctagcaccgtgaaatcccagaatcgtcctcccaaaatccactcccgccgcagcgaagttcctcctcccgccacaacactagcgctcccgccacagccactcttcctccagacaccaagttaggcacgaaaattttcgggattggaagagaataactcaaataagacggattcaacaaaacaaatcgagacgtatgtacaccacatgatgaaaaaacaaatccgccgtgtccgccaaatccgacgccgaccgccgcatcggagtcatctcgccgccagggggagctcggggagaaggagggaggcctggagcggcagcgtccccatggcagcgctagaggaggcggaggagtcgaggtgcgcggcgacatccaccatggcggcggcgtctcaccgccggatctacgcccccaccacctcctcctcgtcgctacagggccttgcgccgaagaacgccgcgtccgccagatccgccgccttggccaggtcgtcgccgagctccgcagccaacactgccgcaccgagcccgtccaccacgctcccgtgcggggccagtgaagagggggtgcggaaggaggggccgcggtggcggtggggagggcggaaggaggggcagcggccatgcaggagcggaggagtaggggcggggcgggacgagacgaggaggaggaggagcggtggcgtgggaggaagtagagcggagaagacgatggaggaggtgaaagcgagaagagaagacgggtcgttgtccgagggtaggtggggaaattgatttccttcggtccccttcgctgccatccaccaagtcacgagcgttgtgggccggtttccttgtacagtgcccaaatccaactagtcacgcaaaataagatccttgtaccgtgggaaagggtgtctttgagctaaatgtctggggtaagacactaccgtcggtgcttgcaatgtgaatggcctcacctcaccccaatccataggcgcgattggtcacgtgacgtggcgctcacccccacctcgtcctcctcactctcccactccacgagacggcttgactttcttcgtcttctcctcctcctccgcttcgcctcctcgcgcagatcccgacgcacacctcgcgcccgcgccgcctataaattcccccgcctcgccgttgccgccgccgcgggaagcgaggcgaagcgagggagcgcgtctagatccgcaccggcgaaacgacccaagctgcctttcccgtcgccgcacgcatcatccgggctctgttgctgctgctataccgcgcccgttcgctgtagcagcaggaggaggaggaggaggagcggagtggtggcgatggcggcgaggaagaatgccggtgtcctcgcgctcttcgacgtcgacggcaccctcaccgcgccccgcaaggtttccccattctccggatccgcttccgtcatctcatctcatctcttcccgagcgatagtttcctcgctgcagctgcatcgtcgttgttgaatgaatcttgttcttctcttcttttttttttgggggtataggtggtgacgccggagatgctccagttcatgaagcagctgcgcgaggtgagaatggcgtctctgcgcttctcctcttcacttctcttcctcctggtttccatggaccatatgggattcatgtcatgttttggttatgtatgtattgggagcagcatgtcactgtgggcgtggttgggggatctgatctggtgaagatttccgaacaactcggcaaatcaggttttgaacctgtactctctagcttgcggatttagttgatgtgtgttctctaatccaagaacacattgcttatgctctatgaaacctctctgagtagctgcattcatccttgcaccgcagttactactgattacgattactgcttctctgaaaatggcctggtcgcgcacaagaacggcgaactcattggaactcaagtaagtccttaggcaaatatatgcattatatagtgtctgaaatttcacttggagatcatcaaattcctggctggggcctgggaataatggtagaggttcttcttttcatttggccaatttctaaatgacatagtgttgccatacccgccccccccccccccccaaaaaaaaaaagtcattggctgctactggtcttagaacgacgcctttctatattatggaacattatggaacataatgttttgtgctctgcagagtttgaaatcgtttcttggagatgatcagctaaaggtgagccttttttagttatagtgttgcttgttcacacataaattttaaggccatgcaatcgatgatacatgttctttgcaggaatttatta

SEQ ID NO: 81276 - DNA, 22068 bp, Oryza sativa
ctatagggcgaattcgagctcggtacccatttggttgggacatcatcctgaagcacagcaatctgttcttttagctctgcataacagtggagtggggggacattcaggcattactgctacatatcaccgaattaagggtttgtttgcctggcctgggttgaggaaggcggttcagacctatgtgtcccaatgtgaaatttgccagcaagctaaggttgagcattgcaagactcctggattgctccaacccttaccagtacctctgcaagcttggcacacggttacaatggattttgtggaaggattacctaaatctggagggtatgacacaattatgttagtggtggacaagttttccaaatttgctaagttcatacctttaactcatcctttcactgcatacacagtagccttggctttcattcaacatgtttatgatgtgtttggcatgccccaagtgattatctctgacagggataggatattcactagcgctttatggcaagaattgtttcggttggctgatgtgaagttaaacatgagctcttcttatcatccccaaaccaatggtcaaacggagcgactcaaccaatgtttggaagcatttcttcggtgtactgttcatgctataccaagcaaatggtctggatggctatcacaagctcagcattggtacaacactttgtttcacagtgtgttgggcaaatccccttatgaagtactatttgcaaggaagccaactcattttggcttagtggacactggtagtatcactgtgcctgatgttcagatttggttacaagagcgtgcacagatgaatgaggtgttgcatcagcagctcactcgagctcagcaaaggatgaaacaccaggttgacaagaggagatcagaacgtcaatttgcagtgggagactctgtctatctcaagttacagccatttgctcaaatgtctgtggcacggtgttcatgtcagaagttaagtttccgctattttggtccttttactattctggaacaaattgggaaagtggcatatcgtttggttttacctgcttctagtcatattcatcctgtagttcatgtgtcactcttgaaagtggctgtcaaacctgatgttgaggtcagtccagaattacctcttcaagaagctgaagttgcagttggtgtcctacctgagttgattcttcggcgcaatttgatcaaaagaggtaagacagttgttccatatgtgctgatcaagtggactggaatgccaactgaattggctacctgggagaatttgtgccaattgaaatctcggtttcctcatgcaccagcttggggtcaagctggtccttaagggagggggaattgttagcatttgggggtactctgttatgtactctgtttttgtaccctgtttctcacgtgactggttcagctcatgtgagcacgacattatcttgtaatgacctgggtgcatgtgtggatcccgtgtcgagctagcggtggttcaactgtacacaggtcgacacatttaaatactctgggtgccattcaggccagggttatgcaatgagaaatcaaacaaaacaactacctccctgtctctgttcttcttcttcctcctaattacccccaaatcctctcgattctaccccaatctgatcacccctaaagctggcaccacgccagattgaggagtgttcgtgacataggtccatttcatcccagcatattcagatatctgacggagcgtaaaccataatatatacttacgatcacaataagcaagtaatttaaatttatagagatcacaccatatgtaggaatacaaaaatcaaggtagcattggtaaatacttgcaagtagccaagctgtccagcatgaagctatgaagaacaggattttaaatttcagagagccaaagcgttttagggggctaccaaaatgtcgataattctggaccaagattattaagaaccctgcaagagaagtgttaataatgagcaatgaagcatgaaacttggccactctaagttgcatcatatatatacagttaacgtttcaaaatacatgatcagcattcttattctcaagcttgtaaatagaggtgatttaggaccgaccatttttcagattccagattcatttcatttattctgtgttagacgtcaatctacttactgcagattgatcacaatttggagtaaaatgtattgccacattctgcactgaccactgagagctgtaaggattcatataatctttgctccatttttatatctttgttataaggataattgcaaaatttgttcttgcactcgtcatgtgatgctgatgtgcagcagcactggagcttccacatgctaagtgaatgcggtcggctacagataggcatcaattatatatctgaagttctgaactgaaggccctagaatcaccatatatggaatgatcatcaattgaagattgcagtgttgctccagcgattttgctgtaggattgtaaaggactattctcaccccaaaagctagccaatgagatgaggggttccctcacttatatattaggtcattttgctcttcacaaccaatgtgagactattcaacatttgtttcccgaatttggatcattgtagttaggactgagaatcatcaggaaatgagccctcccagagatataccagttgcagttgggttgccgcctatatcctggagatgctataccatgtcatccgtttatgacggatggagataatacaaagatttatgtaccctcggacttcaggtctcaaggtggcattcttcctcatcgtagcgtaagccaacggtcatagtgccttgcttcatctcaccaattagattgaggtcatgattagcgtgccaagaacaccaaattatgggatcttgtattctccaagactgctatattatcagctacttgctgatggagtggcggatgcacatcgtcattcattcatggatgttcatgcatgtcaataccaaaaaatattttccatgttgtgcaacaagctaagattatattgttggttagtaaatggatcactcaatctacacgtcatgggttcaatattgccatttgcctcctttgtctcaattgaatttctctctttctttttttttcctcaatgttgcttccaatgttagcatttgattttctggacaagtcttgagcatccatctaatttttttttctgtacaagtcttgagtatccataattttttttctgtacaagtcttgaatgcccatcttgaaaaccctgcctactgcttgatggaaatggtaagcttgttaattgccaggccatgaaaagtaggggaaaaaaatctattttacatcttcggactctcaccaaattaagtgtagaaaacccagtctggtgtttaccgactttacaaaccgtttaattggacataaaatagaccctttcactaaagttatgctcaagaccttaataaagtgctatggctttcaattaaaaaccgggtctctgacctttcatctaaaaaaaacctcaaatgctaccagtcagattcaaacaaaacaaatactagctagtggaaattaagtgattgcacacaaggtatatattaacatacacaattaagtagggcaaagagtccttgcaagcatattttatttctagctgacttctagctgtctaacatttgtggacatgcatcagcttgtgaaccacaaaattagcaactcaagttcactaaagctacacaatagagcagtgcggattgcatgtgccatttcttagccaataattagtagataatcgcagaaacaggttattgactgcatggtttaacaggctcaaaatattcaaatattcaagagatagagcacaagtcaatgtgattattttcaaaatatttttaaaattttgtagaagtatacatgttttaaaaaaaatacaaaagatataccgtgccacatggccaacaggcgacaccaaccatgtcatccatccattgggtgacacagtgggtgtcaccaagtgcccaagctaaccgaagagacatggcggatggtggaaagcaagcagcgctctcagcaactggctagcaacaccagcattattttcctatgtatgggcgaaaagtgcggtgtcgcggcaacacgggaatattttattttttaaaaaaaaatcacaaaatcatgaaagaaaacgtgtacttttttattaaaaaaccaatcgatagttggaaaatgccattatacggcattgatttgaatcacttatatattctcaggctggcaggattgctacatcctgattgggccacttggcactattgaaatttgagataaatcagggaattagggatagtaaaaaaaaactaatcacaatctgcacatccactattaataacaagatagtaacaacatctagattcctgattctagatgcttccgattcaactaccctcaaaaggaataaattcctcgtagttatagctcatgcttgtctttttaatataactagaaaaatgcccgtgtgttacaacgggtgaagtatattttaatcttattgttgttatattgtttagttaagagttcgcttggatatatatatttttagaaaatcatgagctacagttaggagtccgatcgtatcaagttagcatgcgagttttttttaaacggatttcttatatgatttcttctgtattaccaaaagtgaacgatcttaaaaaccgactcaaatacggatatgtattttcaaaagcaaacgaacttaaaaacccgactcatacacagatgacgtaccaaaatatcggtaaaaatatctttaatttttataataatagagatttaagtgtaggcaatttataggaaagagaaacaattttatctgaggaggattagaaacattaatcggcaagtaccaggaaatcctttccttagtagcaccaaccaatagtagtgtggcatgtatcgatgccaatccgtgcacctatgtgaatacgtgaccaagtcacagccgtccaatcgattaaatgcaacagcaatcaatcggagtattcaactcgataccgacttgcgttgacgacgtacgaaattttgctgggaaaaacatctttcatttttataataggtaaagataggctatgttgctaaaatattttcttgaatatactaaaatgatttgctctttcaaatatgtgaagcacggcgattagtagcatatgaaaaagctagccggctattttatttatatatatatgaccatgaatttctgcacagtttgctttatttatagaaaatagaaaatgataattaatttgagtgaattgcacttagtacctggttttattaccacggtttcacatcggaccaggcattaacaaatgtttttagattggaactagatttttttactcaaagtttgcacatttggacaggtggccccacaagtcattcaccagatcgagtcttcttcctcctcaatctggctgtcccctctcctcacacgaccttgcaggatctgctagtgcagctcgtggacgacgtggggtatgccacgcgcacctcacacaagtctcccgtcgttgctgcagtggtctaccgcgtcgaggtccaactactgatcacaacgctgtttatcacctgtacgtccttccccccccccccccaacaacctcacacccattggccggacgacccatatgcatgttggcccaaaaccggaagatgttagcccaatcaggagaaagccatgctacatctcaaaagctagctcaagtgataaggggcttcccccacttttaagttggttcaactccccctagattagcaatgtgggactattcccaacaatgcatatgggagctacctagcttaagtaccagtaggcagtagtgccaccgcctcggctagatctaggagcacaatgtcacatagaagaacacacttcccatcgtcttcaacatcggtcatgcaggcaaggtagaggttaagctcgagcgcaggcattaatcatgagcattagatagggacacggtatatatataggagtcgagatggaggtgatggtggctgcctcctccagcgatgcgccccctgcccaagctccggccttgttggtccttcactggagctcaccttcgattggtacctgctgccccttgctcagagctgcattaattcatgcaagccctgcttgagctatagattacgagctccccgccagcaccagagcagggggcggtagaccggtggtgatggggtgatagcttgatctgaagagggaagaggacttgatctggtcagtggcttgtgaccacttgtgcaatgtgcgaagtttggtaccaaaatctagcccaatctgaaaacattcgatggtaccgaaactggggtaataaaatatgatcctaactgcaatacactcttaattaaattaaatgtatcgcgataagaaggataaatatagaatgaaaatttgtaatcctaagactcaatagattgttaatggtttatatatacatagattttttaaatttgtgaaagccatattccataaaatacttttcttttttttttaaaaaaaaaggaaagcttggtgaatgtatttcttgacacaagccaacaagaaataagtttttaatgaaattttaagggaattacaatattttttataaagtatttgtagagtaatttgtcggtgagggccaaaattaccgaaattttgaaccaaaatttcaaacactgattgtcactaccatgcacttactatatatgtaataccccgtatattaaaagatacttagatttttttagtttggattgacttgtttaaaataaagatgttaacagaaataaataaaagaaaatatctttagaagtgggccaacatgagaagactcatagacccagcccattagttctcccctaaaacgagagaggggaaccgaatcccacctcccctcatagtgccgccacccatctccctggccggcgcctccttcctcccctcctcctgtgttcgcatctctcccatctacagcaaattgctctccctagatctccaccttcatagcttggatcaagaagcaaagtagaaaaacggaacgaggaggaggagaggagtaaaagggggggttagatcggagtctcccctattgtcttctcacaagttctctaacgaaaccctaggtgaggcttatccccttgttgtatcagttgttctagcatggctttagtgctttaattcgtggttagagaaggctagagaaggagtttgggtagttgcggtttggtttgttgcagttctacatgtgggcagatttgcagtgcttcagtgtttcaatgtttcggggctctaattgttattttctgtgaaagtatacaactaagaagttgtagataatgtttggatgtatcttctgaccaaagggcgtgattttatctcaagtggtttaggagatataatttttttagtacgactgttgtttttgtgtcataatctggatagtagtagattgaactgtttttggacgggttaaacagtggaatcagctaggccacctatagacaaagttgtagaggtttttcttagctttccatattggtaaagtacaccctgattgggcgagtagaactccagttatggttgttttagtgtggacagtctgaaattctggacagattctgaagcctgcattcaagtgcaaattagaccatttaaatggcagaacaaaaatatgatttccacataagagttgtaggccttgttctgtagatttccaaaatgtatttatttgcggttatagccttttcatatttcaagatataaaggtttgaagcagcagtcttgtttatagtccaagcagcgttccttgttattgcgttgtgatgggatggggaagtagattcacctttttcattgttttatatgcatgtttgaatatgttttctgaggtttttttttattaggtggtggtccttcatatcgtgcatgataccaaccctttattagaggcaagtgcatgacaaactaattgtgtgattcatggattgtttgctctatctatttatttccgatatatttctatgtgacatgtgaccgcttatattcatattgttgttcgcgccatttaggttttcatgtctatcctatgtttacgacattattcttgtttcaatattccggattctggttctgcttaaataattcaaattctctgcttgccatggatgtgcagtatggtttcaatttggttctttgattccagtttcaattattcaagtaccatgcgtagtcatgggagtccaatttggttctttattcaagttcctatgggtaagcgttgatcacacttactcggctttaccggcaaatgctaggatgtattcactattgtctgggatggaaactactatttcaattcatgcctgtccgggatgggaactactatcttctttgacttggtgtttgaaaatgcgtttcctatcaacgaaagaaaggtttctgttcatgctttattgccaatgttgtgtatatgtgttttctagttccatattgtacttgctgagtatttttatactctctcttgtgtttcatttagttttaggtacatattgagaccgacatgcataggcgggaagtagcacccttatatacacatctacttgcacactattaaactatattgcttaggtccataatgacacttaaattatatcttggtttggtcttctaataatcttttagatttctaatagtttcttccccatggattataaggatggatcgtattatgagaatgatattgttattagtttagcttacaattgcctatcgtgaatgtccgtatttacaggagagactctgccgaaatttctaataattttggaagttagtggtttgagtgtttttttagtgtggcactctaggtacgtggctacatggggcgttacaatatatactaagagttgtaggttgtaaggattgatatatatagtattacatattatttacatctatattatgtcagctagttgcaaatttgtttttgaactcattatgtgatgctgttgtatgcaattctaatcaaagcttgcacatgcatatgctcactgaatgtcttcgactatagataggcatcaactatctgaactgaaggccctatcgatctgatcatctgaacaggatctaccgcaaatatcagttacttgtaggttcacctcacatacgaaatatatgatcaaaatataagggtagataatttacgaactttcgattcaagatgcttattcgtgttggtgcttgcccagtattaggactaaaagaaaatgagtcaaataggcttgggaggaatctgaggaactcaaagtcactagtggccactgtttggggtaattaaggactgtttggttcatgtcctaaattggccttaccagtatttaggccacataaatagtacaactggtaattttggtttgaatccaaactttggccagcccagcataatacaaggatgtggacatgtggtactggcaataaatggacccgacaaaattgggatggttaattttggcccttacctaaacacaatttcccaaatatcgacatgccaaaacatacctttgaccaaaattaaaattggtaaggctttgttttggcttcaaaccaaatcagctctaagtgatgagccactcggatggtctgtctagttttgcagtggtaccaaatctattgaaaatgagtttttatatattccggaatagtcattcgaaacaaaaataactctatcgtaatctaattgagccccatgaatgcaatcactcctcttacatgttcactctctgaacttctgaagcataaggtagtacattggtatcaagaatgcgctagtacttctcaaagagagaggtcatgaaatcaatataaaattggtgacacctacagcagaaatgtccactagtttgttctaataacaaccaaattaccaaattgtctagttgtgtagtccagtttgaagctttgaactctgtcataatatgtcattcgttgctgatcagtgaagaattaaactcagccggtttatgttgctttggattggtatgcactgggaaaatataatgatcaatatcaagcatggaagtgatgatgtcgtagggacttatatatagagactagcaaaatgcccgtgcttcgctacgacgtattaaaactacagtgctttggtacttttgtgtttttgttcttttaaaatatatgacgttgtccaatcggatagctgcataaaacaaatattttgccaaaaaaatacctaaactggatatattaatttgtctatataaataatacaacttaatataaagtatgtgcagcccaataccaaggtggcctaggaacagcgcccgacccgatgcgggagaagccggggccgtccgatctgatggacggtcctgattgatcccgacctagataaatattctgcagctcaaaccctaaccctaaaatcatttcccccgatccccttgctctttctcttgatctcaaaaagcgacggtggcgaccttccccccccccttccttcccccgtgagcattgccggcggcgccctccctcaccgcgagcgactacagctgcgccatcccccatcacgagcggcggcgccctccgcggcttcccatggccggatccgacagcgacaacgacttcccgtgggcgtcgacgggaagtatatattctctgataattcaatcagcaaagtaaacgatgataaagcttctaatccatctaatctccacattttttataataggcagcatttgccattaattagtgaagctaatttggaataactattacttggacaaattttcacatgctaccactttgagagatcattttggtggagagatattatgcagttcacagatatcttttaatttctggaatggcaaagttagatcagtgattttttcaagagttttttcttgcgcactcaacttaaaagatcagttacagtgttattgggcgggtactaaatcattttgccgcatcgactcatgtcaagactcaacaagacacagatcggacactgtgtcgagtcaatactgaacttggtgagagaagagagggatgaggaatagaaaatgcttgtagtttcacccctcgaccctcaaaatgaaagaaagtggcaatctgcagcttttgctttctttatgataccttctccactctcctgtctcctctagatttctttattgtcctttttatttattcttctctattcgagtggataaaggacacatgcaatagttatcatgtacaactgcaaacaagaagataagatcttttgtacaaaaaaatgtgtgacacattgttttagtgttttacttactaagagtatgttttatttgatgatatatatagtatttttactaaacttatatatatggggcgagtccctgaatcctatattttatagcataccaagttagacactcaagtcggactccaacatatcctggtaacacttcagttaatgtgattgaggttgtgtttagattcagaagtgtaaagttttggcgtgtcacgtttgatatacggacacacatttaaagtattaaacatagactaagaacaaaactaattatagaatccgcctgtaaactgcgagataaatttattaagcttaattaatccgtcattagtaaatgtttactgtagtaccacattgtcagatcatggagcaattaggcttaaaagatttgtctcgtaatttacgcgtaatctgtgtaattagtttttttatatttaatacttcatgcttgggtctaaacattcgatgtaatatatggtgaaaaattttgcaaggggatgcgtgagatcaatcaatacaagcatacggtactcccattgtgtcagagttttcaaattcaaatcatgttgtgtgtttctatctgtttataaatctgccccttctgaagccagatacccaaatggaagtcacagatacacagagaagggccattacatgtaataccggccggcaattaatgatcctcatgttcctgcaacagggaactctcttcacttaagaaaagtatctgatatttccagcaaaaggaagatagaagtgttgctctagccattttgctacccaaattgggtcatatcgttaggactgaaaatcatcaggaaatgcatccctccctctcggattgggatcaggtgcagtcgctatagcgaccgtaactttggcagtccctcgatccatgtcgtccgaaatccatcagaggattagaaatgccgtagacctctcaaccgtgtgatccatcagctacatggcctggtcgccggaggttcttgcattaaccggtgaggtaatgacggtctcggtgtcccggcaagacggtggtggatgccatgatgcacttcgatgatcctgtgaacaacgtctgcaatcaggggcggatctagaatgggggcggcggggtctcgagccctcactactggcgtgaagactatgagagccccacgaagaccccactaatttttttttatcatatatagatgggagaggggactgtacctctatctagtttgctcagattccactgctattttttctggatccgccactgtctgcaatatctgcatctgtgcttcactgaggtcagccaagcctgcacatttggagagttggacttggacattacaacagcagcgtttgtttcccatccacctatttgcgcattgaagtagacagcagtaacgattctgccgacttgggctttccaagtgctcttggataatgtggcaaccgagcgctcggaccacgaaggcaggatgagaatgccttgaccaatgaggagcacaagtaaacctcaattaaccttaatcttgatggaattgaacaatatgacgggatctgtccgttcatccgaattgaatagttgggttttcttgtccaaattgttactgctggaagtgatgaaagtacacagaagaagaaagagagatggaagaagcagatgaacatacgagataacgagaagcagcaaatgaacagagaaaagacttcacttaagtcttagccgtttgattcattttgagcgttatggattgatcaactgtcaaacttgcagtctctatcacaactgcacatgatcccaattgtgtcagggtcttcaaattcacatcgtgtcgtgtttctgtctgtttataaatctgccctttctggagaagtgggtgtcacagatacacagagaagggccattatatataccggccggcaatgatcctcatgttcctgcaacagggaactctcttcacttaagaaaaagtatctgatatttccagcaaaaggaagatagaagtgttgccgctgccattttgctacccaaattaattgggtcataccagttaggactgagaatcatcaggaaatgcatccctcttagatatatcatctgcatgcagatgcagtaggattttcgcgtataacctaagaaaaatatgtactttgttgtatgcttaggatggatcaaggataatagcaagaatgttttgttggactcgatctgacatagatgatccaagcaattgcattctaccctgctggaacttctagttttaccttctgatgatcatagtttgtttatcaactgccacagtgccttggctaatcccaattggcacaaggccatgactagtagcatggcaacttatatcacctggtatcttgtattcttttagacagcaatcacacctaatgattcctttggaaggtaattagcttgtagttgggccattaaaattaaggagaagtccatttcaagttgtcattaacttctaaaccgaaaaatattcatcattcaacattgcaagcagttcaccttttactcctcaaccaaaaccagaccagttataaccttttgtggtgcttacttgacatcccgatcagaaaaaaaaaacaaaaaaaaaaagaagtcccctatctctcccaatccttgtcgtgactcgcacccaacgcataggcactagacgctctgctgaggggtctgggcagtgtcactgtgatgctttgcagtggcagggtgaaaaaaaatacaacaatcgctctctactgttcgtattatacatgtattattagggaaaattaaagatgtactgtattatactacctgtattattaggggaaattaatgatgtactaataaccattgctctccactctctactgttagtattatactacccctattattaggggtaaattagtaatttactaatacggagttacttgttatttatgttttttcccggatagatcaatatatgatcatccattgcgctggcgtcgctcatatttcattgaaaaagctagaaaaggagaaaaaaaaagtttagtcattgctaaatgatgattataaccctccacacctctttttttacaataatatctctccacgtttctactaccactaattggtggtaatataaataaatctaaacccttcgatcaaatgagatcaaaggttcagattgatttctactaccgtagtgaggttataaacggcgatgcatggagtatcatgcattcatgcgcgtgtaaatcagtctgattttttaattgaggggtattaagtgaatggtttggataattgagggatgaataatgtcgagttttataagattatagggcacatttcggagtttcgataaagtttaggaacgtaaaatagacctctttctgtgtccttaaaattattcacaagtgctagcagccaatttcaaactaatagctgattctaagatactacacacaaatactcaagtactttttttttgaaaggtaccagcacaagaatgtgcttattcattgaatatagcaggagaaaaatacaacccctaggggtaaagaaaaagcagaaaacaagaaaagctgtacactatacaaactgcgggatgatctctgcaagacgcttggcgcatgccaaggcccacatgccagcctcttcttttatccttgaaaggagatacgaggttgcggcttccttatgatcaaatatcctcatatttcgcttcttccagacttcccatacgatgagaatcgagcatatctttatttttaggtgccttttattcttctaacttttgtggacatatgttagcatgtgaaccacaaaattagcaactcaagttcactgaacctacactaaaggggttgcaggtgccgaatttcttagccagtcaacaaataatcacattcatgaagtgttcaagagaggggaacacaagtcagtatttggaaaatgccaatatatataaggcattgatttgaattatgcaaattacttactcgcaaaagaaatcctgcaaattactcgttacttcccaaatcattaagccccgattgatcagggttcttattatcgagggcaacccgcttcagattgcagaattgatttgtgtattctgcctatataatgtgttttcactgccacgtactacactgagagagttgtaccttgtgaggattgatataatcttgtatatatttttttatatctatattatggttagttacaagtttgttcttgaattcgttgtacgatgctgatacccattgaataccctcgatctaaggcatcaaactatcaaaagtgaggattgagatcaaatgcagtcactgctaggactacaagttagtaactgcacagtatcatttttcagatcaagggtgcagatcaactactacagtattatcgctacagtagccgcaagatattttttccctgtgtgaacagtgcttcgaggatctcagcccttagatacaacttggatggtactgcacctgaaccaaatcccaaaagtgaagactataccctagctagcatcaacataaatatcggttacttaattgtatgttcacctcacatatgaaatattcagatataattgaaatgtatacgagctagcttctcttttcaattcagtaatgcctattcttgttgaattggcacttgtccactatgactcgaagataaagaatcaaatcaaataggcttgggaggagtctaggaagtcaatgtctccggtggccatgtttagggtaactgtccagagagcggtggtgtatggtctgtctagttttgcagtgggtgcttacaagcattgaaggggttcctacgtacttgcgacgatagctacccatactctctatttacagttgatacatctggagcttgtggtaccaaatctgttgaaaatgagcttagtatatgcatggtctgtcaaccaaaaggcatctaccataatatatttgaagattagaacacatctagcttacattttcactctcagaagcatatggtaatttctgacagagaggccagagtacatttgtagcaactattaattcagtgtagcatttagtagatatgtccactagtttgttctaacatccaaataggctagctgagcctatagtttgaagctttgaaattgtatcttagtgcatcattcattgttgatcaggtgaagaattaaactcactcagtctatgttgcttgcgctatccaaaatttctgactgaggatttccatgtatctgtataatggaatgaagcacacctagttctgaagtcttgaattatcaagtcatgacatatgtttatttgaaattttcttccttcatgggatcttcatgtgtccatggattgaatttctatgttactggactggccttttgtcttggaaggggttgaattttccatattagggagttgagtttttttttatggttcttgtttgagaaagtgatgtgaattattgcaccttttactgtaaatttatggtagtgtcatttcttaactcggccatggacataaatatatcaagggcatttacaaactagtacaagttccaactactacaagagtccaatactgaatgccagtacactatcatgacataaaaaaaacacatgataaaaccagaggatgtggcagcatggccactcctgcttgtttctaaacaatttggtgcaactgtgtcccagtgccagtgaagcaaactgcaagtatgcaaatatacaagagaagcattcagattatcggctatatataaatcatttggacacttgaaaactgcaacaaggaaaggttgtgtatacctccaggtatcgaggacgccgcgagaacatgttcttccattatctacaaaatctctggacaatctgctggtgagaatgggaggcagctgggaagaattgctctacttgggtgtttcttcatgcacaaggtatgcggactctgggtgaaacatgtagcaatgtactgtcacaagctgaacataagaaacttctagtagtctctgtttgacaaattaaacattgaaaaccttctaagactgccaggaagaagttaccctataccgaaccgtgctgatacttcttgtcattgaggatgaaatagtttttttttttttaccgagcggcaaatattcttagcacattttagttctttgagagagttcttcaatattcttcttccaaactcggcttagttatctcattttatcactctaccattgtagcacaggccaagtgaggtatgtaatgtctatgtgccgagctgccgttcatctcagagagagagatctatgcaactcctatatcacatcaaaagctccgtaaaaaggctactcgtagtcggagtcgaatctatgtattctctagtaactcaatcagcaaagtaaatgatgatacagctactgttgagacttggctgtgtagtacacttatggtgtagaggccatattcttaatacattatttaaaagaaaaggctactgttgaaactctgaaaacttcgaaatttagctgaacaattgactgaaatatgaagcacttccccccttttataattggcaatggactagagagaatatgccagagctgattgtgtggatctgttgaggaacatatgccagagctgattttttgaaggctatgttcctagtcataacaatcattttatacttccatttgtatagtgtacaaaaaatcagtgctcagatttctctcaaggatccagttcctttgccaattctctggctgcattagtgaattttgtgctccaacgatatgttttaaaaagtaggcaaaaacagagttttgcacacggggatttgtagtttatgcttatgcacaaaccaaaaaaacagagttttgcacacggggatttgtacattatactccctccgtacgggagtagattctaatccctcgaagggatatcctctcgtatacctttttcttctaaattcgatgtaaatagttatgaaaaattctgaaaaaaattaacaatgtagagtataatgatacctactagtccaccaaaattgaagtccaaagattttgtggatatgtatatatgtgttgtatgaatgttgtcaaattttttcagaattttttataaccgtttagatggtttttaagcaaatgagagaacatcccctagagggattataatagtttcctcctccgtactcgtaaagaaagtcgtttaggacaatgtttaagtcaaacattgggaatataaatcatgaataactttgaaaatgtaaaaattatataaatagatttatcttgaaaaatacttttataaaagtgtgtgtgtgtctataaaaatagaaacaagaagtcaaagttatattttgaagagcatgtcgctgtcctaaacgactttctttacgagcgcagcaagagtactttacaattttattagagtatgacattgcgtattagagtatgaaaatgcgttcattttttctcctgatttcaatcttcaacacaaacccagctccacggttcatcgcatcagcgttcatttttttttttcgatcttgtttgtgacggggcagaagaccatgatatggtctactatttcttttgggggtttgcaatatagagcggaacacttttcaaaggtctccacaatctaaacaagtttgaaatcatgcacatagtacaggtttgaatcatgtcaaaagtaccaacttcagatagaacaatgataaaaatggctccaaaaatgcttcaaactaagttctccatttgtatggtactcaggacaactgatggtgcaaaattttcttccaaaaaagggtctggataaataacattagatttttgatctagaagataatatcagctctggaaatgggagcatctaccgcttcccaccaccaccaccgagctttgggcctttcccaggcttgggagcattgcctttaccagaagccttctgcgattttgccacctctgccttcttcgctttcttctcgtcctttgtcttcttgatgcgctccttgatctcactgttatggaaataacattgataagtgtataatcctagaagggaaaaaggtagcatgcatagacacaataatgtgccgatcatcactagatttagagttcataaactaagacaagctaaaatgattttaataaatctttgcacagcaataatttcttactaccaggaaacgcaagctacacatttcaatacttgaaaacaaagagagccaatagcctgacactgctagcatggtaagatgagaatgtggttgaaatgcattggcttcttcaaatccatacatgaatggtgttaaaagaatccataaaccagagatggcatagaatagcataccgaagagcggattcccttgctgcatcacgaacctctggcttctcagctctcttcttctggatgacttcaagggtagcaccaactatagaccgggagtacggtttcttggtggtgcggcgcctcttcttgactgcctcggcgtgaatatcctgtaaaacattgaattacaaaagtaaacatttgaaggacaatgcattacatcacaaatttaaataaacaatagattaactaagataggtcactggtaccacaacattcagcatgacataaagttaacagttcacaacagccaaaaagtagttacataacatcctgaaccaaacagcactgttccaacaagtttgtctcagcacattcacaggcaacagaccatcggtacaagaaaccttccaagtgaaatatggatgacaaggaattgtcactcataccttcttgtgctgctttctgtacatggctgtccatgtaagcttggctggcttcagacggttgtggaagtagcgcttgcacttcgagtttgaaaacaggaacacctgatatagtttaccaaagaaattgatcagaaataggttagcttttgtcctacacatgtgtatccatcttgccaaagtactcacctgggagtctgcacggatgaatctgatacccttccctgggtaaatcttggcgccgctgaaacggcacagctctgtcctgtacatcagaattcccaaattatgtaagaaactttctatttgcaacattccagcctcgaaaatgcagcacagaatataatgaaattgaattgtgcagggtgcaaaatacatacttgagaaccatcttcgctgcctcaccaaaccttcaatgcctccttacctgcaaattacaacgtcaggaatcatcgctagagcagaatataaatgcattgcaatgtacagaccacaaagatctctcctcttcagcccaacactaccagaccccaatatatagcaatctaaattaacaaaattctagcatttctctatccatcaaacgagtacaagaaatgacgcataaagcaaatgcgattccactaagttgccattccaaatcagtgcccaaaaactaatcaaaggaaatctaaaacacatttgcagcattcggatgcacggacaacgccaccaccacaactccaatccagctgaaacccccattccccatcacagcatcacctcaaccaccaaaacaacaagccccacatctaatcaaacgcctcgatccaatcatacgcgtcgagaacgcgaacaaacctagccgccgcgccgccatcacacaacagcccgcaaaacctaccaagaaacaagcgcgggactcgaaacagcgaatacgctacatacacgagacggcgcagcaacgccatggcagcgagcagcgaagcaaatccatggggggaagaggagctcgactcacctgtgggagcagcaaaaccctagcgcctccgcgtccgcctccgctgcggcgcgcgtgggaggtggtgctcccttttatagtagggcaagcgcgcggcgggatggatcggagccgtccgatgcggtggggggacggaatggacggggtggatgagttggtgtgatgataatgggccgggctggtttgtcgggccttggtcaaagtgggccgtcggcttttcttctgtactcggaataagttcacttcataaccctcaaaagtgactcgaatctaattcatgaccctaaaccgcaaaaccggatatcttcacccccaaactattgaaaccggtgcaatttaactcccttggtggttttggatggcagttttgctgacgtggcagtattgactcggtcttctttccgcgtggcgttgacgtggcgcttaggtggcattaaaaaaaatatgcatgggacccattagtcattcacacacaaaataaaaaattgtgggggccactgacatgtggggcccatatgtcatcctctctctccctttcttcttcctcccttctctctttctttctctttctcttctctcccctttggctggccgcgggggagcacgggcggctggagctggagcggcagcggcggtagccttgccatcagccttgccaagtggagagaggagaggagaggagagcaggtgagggaggaacggaggtggtgggttacacgacaggcggggcggcgcgtgagggccggaagggagaggggagaagcggtgccgccgagctcatgttgtcgccgccggtgcctcctcccgcactcgcgctcgcccgcacgccgccggagccaccgctcgacccgctcgatgcctccgccgtcgacgtcccgcgcccaccgccgccgtcgacatcccgcgcgatgtgaggatggatgcggggagatggtggaggacggcgacgaggagctctg

SEQ ID NO: 81277 - DNA, 1666 bp, Oryza sativa
  unsure (1)..(1666): unsure at all n locations
ttagtggagccggaagcatatgatctagctagttgtgcaaatggagcgtgcaagtcagagatagtgattaggagctcataactcattgacgaattcagtcgtcgagcgcccggcctcctgcaaatttgtcaatttttaaacgttctcactgtcaatcgattcaatttcctcctgtgcctcgtgctgatttttttttcaattaaatgttgtcactgttgattcatttcctcttcttccaaatgatctgagctgtactgctgtgcctagtggttacagtgacctgagtagcaccctaagatcccgagttcaaatctctataggagcgaatttcagatttaattatttgagggctaagtagtcctgagtttaaatcttcatatgaacgaatttcagattgggttatttgagatctaagttatctgtttgctagaaaaaatgatctgatcagcaggaaaccactgtgctgtactgctgtgactggtaaatttcacgagtgacggatcatttggcaaaaactgaaaccaactgatgaaggattacgcgagttctgaagatagaatgacgcaatgatcgatcgcgccgccatacaaggagaacacgaaactgatgaccttcacaaaacgcatactttagcaacctatggactggactttcacggtcaatctttgtccggtctgaactctgaagcagcagtattaggttaggtgagacgaaaacgacggaaacctctgcgtctcacacgccgtaaaaactcaaacggatacgtggatcgtgaaagggattggtaaggttttcgattaatcttaccataccaagcatggacggcggattcagtcattcagagattggatgcaattcttttgcttctgaattttattattaatttttttggacgccttcacctgcaaatagaagaagttcagacttcagagcatggggagaaaaatgttcttgcacatgggaaatgagatagttatgcgttgagctttaaatttatgactgatgggcaagttttttcttgcgattaatgaaatcatttaagttcaatttggagaatgtgatacgtttgcttaaatgatgcttatggatgaacggaagaaacgagtgatgataagttaatatatgtatggaaatgggggtatctgaattataaggtaagtatggttgtaagtgactaaantgatagtgtaacttatctgtaaggacatggattgtaagtatggtatatgatctagtacagggggttgatttacaggatcggaagttcgcaactgatggttgtgatgcatcaaacgggcttgggccatacaggtcgcaacagtagttgggcggaaattcattggcccacataggtgtcctcgctagcccgctctgctcggccgatggntacggccctgtcgccttcgttcggtataataggtgggccgcagcacaaggaattgagagaggatttccgttcttttgtgggcccaatcctgcagttagtcttacatgggccgtgaattgggatgtgggtaggctaggccgaccaaccgacccagccgacaaagtatggggcaaaagcccaaagctgcatgggttaacctacaaaatttagggttaattcgatcatgccataaatatgtcatttcagataaatgatattataattcatcattcgtagctg

SEQ ID NO: 81278 - DNA, 556 bp, Oryza sativa
cggcgccattctagctaaatgtggattagagcttgagctagcttaattagctttggttaattggagtgatgggagtgtgtgtagatgaggctaattgcttgtgtctatttataatggctgtgattaggacttttgctagctaagagtgttctaagctgttgtagtgaagtttgagctggatcaaacatgaaaatggtgtgaatgatcagaaaagtttgtaattagcaatgcttaatttccactgtttttgttttgctgttatgtcttcctgtttttttttttctgtgcctgccctgaccaaatttattaagattgagagaaggtaaaacattttcaacaaacatactccctccgtttctaaatatttgataccattgactttttagcacatgtttaacctttcgtcatattcaaaaacttttgtgaaatatgtaaaactatatgtatacatataagtatatttaacaataaatcaaatgatagaaaaataattaataattactttaaatttttttaaataagacgaacattcaaacatatttaaaaaaagtcaatg

SEQ ID NO: 81279 - DNA, 28922 bp, Oryza sativa
ccccccccccccccctacccgtttcggaatcctgtccaacatcttgttaggcgaggataaagatgcgctgcaagcaatgtcatgtggccagaatgagagcataagtgataatccagttggtctattccacccacaccaaccgattcattcaccatgtgcacaatgtgcccaaagaaatggcactgagctcaccggattgcaacctgtaatcacaggagtaaggaacatacccggcggctttcgtgcccgtgctgctctttgatattaggctttagaaatgcccggctactccgattctgttaaggtactttcaactgtgctaatcgatcgatgcttattctgcaacttggtattttcagttcccaaaccaaagcatctcaaattctcaatgggatgctacaatacccagccaaacacttaattgccaaacttggaatctggaacaagccataaggccatggattatgcctcgttagttttagtaagaaagaacacacatatctagtttgcccatagacattcaaaatatctatactgttacgtcataattgcaataacattttaagtaactagaccatgtcaatgatatcaataagtgatcatgaacattgggttcattgtctctagaatcacgaccattttacttgatagtgtgataaatacgatttacatcattcatgttttgcctttttccctatatgcatagcttgtgtgctaacacaatcttcttgctgccaatgcattattcagcatgaacatggagcgcggaagctatccaaggtatgatttgatatcttcctttgtaccgaccacctgatggaactgattaattgttaacgtcaactctctcgaaagacagaaactcaaattagcagtttgggttgatgcttgatgcaagaaaagaactagtgtattcaatatcagtgctccattatgatactaataggtgccacaaggaatggttctcagatgtattttattaatttgacatttttcttcagggtacctgctttctcatatgaataatcaaaacctttttccttcaattaaattttatggttttctagctggactaccaaaatatggttttgttaaaaccatagtcacaaagttcctgggtcgatgggatcaaggaatggggtcgaggaacgtgatacgctacttgcgagaggtttttacaaggtggggacgaaaatgaccccgcgttttcgggacggggacggcgttcccgggtcgaggatcgctgccaccgaccccgtttcctgtgactatggttaaaacaagtataatattgatcttctagaggggttggcaagtagccaagccgaattatgttaaggaactgtagcacacgagtagctggccttttatttatcttatcaataatatcaatattttctgcccttcctattatataagccacattgattatgcttctgaatgttgataatgcaatacttttgtttcattcttgcaatacttttgaccttccaaactctcagtaagacgattgttctgacaaataattttgcaacagaactacgagaggtatgttgttcgtcaaaaacgagcagaaggtaaaaaggccctaaaagattatcttctatttggaaagagttcacctcatttacaggtgagaatttctgttttgagttgtcatttccagatttttgtccttcctctaactagcacaaataatctatttactcttcaaaaagcttttgatggtaatactttatttcttttaggataagatatttgcaaaaacaaccaataacatttgatgtcgcaatattacatgtgtttatccagggtggaagtacgggcagctttgctaattcgcatgatatcccacgattcaaaacctttaggaaaggatctcagtctcatggctcaacaaagtcgcgacaaggtgtacaccatcacagaaaatgtatgttcctcttccaaaacgaaaatagacgcgtactaccttcacttgaatctattcgtctggttttgagcatctctgatgtatcatactatcatgtatcgcattcataatttatctgccgctccagtggtatcttaaggtcatccgtggtcggttaactttatcatgcattagtatgattacaagtctgaactggttaagttgaggagtaggaggtgtctgtgtgggttgaacccctaaccgacatattaaccctgctccttaaaccaaatgcagctctaggctttttgctatgttatttctgctattaccttttctgcatatctgtaactgcacatatcaggatgttatttattgacttgaaaatggtgcaaaaacatactggtctgttcatacttcatattttagtgacctgcagagcatgcataattcgactgcagtttgttgtgtcacatggatttgtgctgttgctgtgacccactcagatcacttcaaattagtttacagaacaccataaatgtcacataggtgagaatgttcttataatattttgcaggtaaaaaagacagggagaggttctacaatttcttccgtgaggagtattatgtgcatcctgacaaaatctttgaagacatgttcggtgagaatcatcgttttacctggtcccatatatcgtgggagagttttagcttcagagattcatcgtccagatttcgaaggactggtgaatcgaagagagaaagagtttgtagcgatagtgacgatgaaaatgaggatgaaacaaccaacattgggtcacatgcacaccgggctattcttggactaccagcttgtggtccactaactctagatgctgtcaaaactgcgtaagttgtgaatttttgtaccattcctcgaattattgtcttgctatcactaccatttctgtatggcactacaagtaggtgctccactagcgttcacctgaattactttcggtgtgcagtttccgggcatctgctctgaggtggcaccctgacaagcacccaggctcatcacaggtaaccctttccttcttgtttgatttggagtaaacaacagcatacgacattgtcttgatgcagccaatgtactgattggtctgtaacaaatcaatgtgcaaaacaacggatggtaagttggtaaacactaaacagagggtataactgcatactctgttttacatgtgcccaggccgtggccgaagagaagtttaagctttgtgtcaacgcatacaattctatctgcaatgtcctcaaggctgcttagctttcctcttgcatcgatggtggttcaagcttgcagttgctggaggctgtgaactcgcagcaacagcatttcaaggcttgtagctgacaaggccaagcatgaagctgctgcattgtttcagagcatcaatcggatgacacattcagttcaccaactcaccaagctcagagaaggaaggggatttgtgctgttgtaacaaacatgtacgtactactaatcactgtaacaaacatctattccttcatttgatttgatttcctattccttgagcgaataaaacaaacactgttcacagaaacacacttttacacaaacaatatgagaaaagttgattgaagagcctatcacctgtgtttgccgtttcttcttgtgtcatgtgttgtgcggcactgtgtaacaagctctaactaatgacgatttgattaacctaaacaattgtctggacgatgtggcgtcatgttgtctttgggtttatgttatgatttggccgggagaaagcaggactggaaccaagaaatatgtactattggtacaatgaaatcgtcgccgtggtacttaaaagcgacgttggttgcataaacatcaataatgatagcaacaagcttggcagcttttactcacaaactaaccaatctccaagagagatcatagtactagatactgtagttaaggataaatacagttgcttttgccacagtggctgctggctgctgccgcgatttgagcgagtgaatgtgacactggctgacaattgagataatgcatgtgagggcctctcgctgaagggcaattaacatagaacattctactaataaatcacaatgaatacgacaagaaagagaaagagagggagggattacagtagagataaacaacgaacgactcttccatcatctgatctgatgatcaatcaaaatctcctactagtaagattggattggaggagtagtccagttgagaggagatctgagagctagaagcagaggatggcgacggcggcggcgacggagaaggcgaaggtggtgatgaggaaggcgaagtggatggcccagctgcgcttgaacttggccaggtagctctcgggcggctcctggtacggcacctccacgtcggcggccgccaccacgtcgccgccggacttgagcatccgcagcctgtccgccgccagcgccagggtcagcttgtggcaacgccgctggtacctagtatattcattcgcgcgccattaattgctgctaagtaagtaagcaagtaattaagtagtagcaagcaaattaagcaagaggcaattagagcgacctgaatccgttgaggcatcggaggtggtgtgcgacggcggcgtagaaggcgaggtgggcgagggagaggaggccggcgggggcccagaggtggcggcactggaggcgggacggcggggactgggcgacggcggagaggaggatggcgaggaagaggaagaaggcgaggaagaggcgccacagctcctgcttctgcgcgtccgccgcccgcttcttctccagcgtcttgtcgaagtgcagctgcaccaccgcccccagcgcctgcgccgccgcctcccgcgccaccacctctcctcccccgacgtacgcctcgcccatcgccatccccatccgcatctccaccatccgctgctgctgctgctcgtggtgctggtgatgatccatctctctctctctctctctcttagatttctctcttctcttaccactactagtatagtgctcgctcactccctcacctgcacaagcagcagtccattgctttttactgatgaatatactgagatgagagaggctattagcgttagcagcaaaagctgatggccagtacagtaataatgagaagagttgctactaacactagacgccatccatgccacgacgaccaccaccatgcttcctttctgttccattcgctgctgttttacctcttcatttcgcccatggagtacttttctagtgtctgtaactgtaagcaagcaagtactcgatcgccttgtagaaagaaataagacaagatgataattaatttacgactagtactggagtataaattctgtgtatgatccatctccacgcttgtactagctgagatgggcaagtaggagtactagctaggtaaggaagagtagtagaagagagagcactgcattggatgctcgagcgtcgtgtaattatttgcgagcctccctggagcagtaaacttggctgttgttacctgtgtgaccgaccgaccgaaaaaaccgagtttgagtccaaaacgccatggaatcgcaatcgcaatcgaatcgatatacagtacagtatagtactagtatggtcgagctatctatctatagtcaggagtgaggaggcaaagcctgctgctgtcaaacatgaatgagcccacatgggggcatgagaattggactactagcacggtcactgtaccatctctctctctctctctcgatcacttgtggaaaagtttatcataaccaactcgctaggatctcaatctataacccagtggtggaaaaaaagggggcaattataaatttattattggtttgaatcgttattataagattaccgctataaaattacaaaaatatcgtcaaaattatcgttcaagtggcatccttgtaaaattaaaaaactcggccactgatttgatcttacgatctaactaaccgaattttattcaattaccaacctcagttaactagattgactgaattactcccagcaggtccaataggcccattaacagttcgatacattacacaagcataccaaatacctatatctttacctagcgctgcgacaccgtctaatcccgatgtccgcaataggtggtggcgactctacccaactcaaatgacgtccccgcctttaccttctttgcgacgaatccgtcccattgggccgccgtctctgcctccacctaaggatgaaaacggagcggatacggtcggataattctcataccatattcgttttcatttttttttaccggatacaaaaacgaatatggatagctcgaatacggaaacaaatacggattatctcgaatacgaataagaatcgaatgtgatcggacacgaatatggaaacaaatttttctcggaacacgaaaaccaactcaacttctaatagaaacaaatatcaacatatataattagctcattttatataaaatgaggtataatttataaatatttcttaaaatttaaataatattaatagtatggactagtgttaagagataaactactattaaaatctataaaggtatattgaaggttatagagttagaaagaaatgaggtatgtctcatgggtcttgcggatatccgaatagcactgttcaccggatatccgaaatattatccgtatccgacggaaaccctgatatcatattcgtattcgtatccgggaaaaaatattcgtattcgtatccgtatccaaaatatctaaaaactatccgctccgttttcatacctacctccacctccgttgtgagccggcaacgtctgtcgacgctttctttacctcggacgtcgtctcaagttgagccgcaactcaggcacaccgcacactgacaaactgcgcgtttcctccaatcttatggcgacaggctgcactccaacaacgccttctccactcgagtctccaacaacgttgctgaatcacgacatgaaaaggtctagtacctactggcacaacggtgaccactataccttctttttgtttcattttttttccgttgccgttttgcttcttcatttcgcccatacttttgtaatatttgtaagcgagacgctcaattttcacatttccacacaagcaagcaagaaagaaagaaaataagataaaaaaaatcctaataatttactactagagtataagggtgtgtttgaggaaaaggagattgggaagatatgcaaaacgaggtgagccattagcgcatgattaattgagtattaactattttaaatatcaaaaatagattaatatgactttttaaagtaactttcctatagaaaatttttgtaaaaaaacgcacccctatatcacacgaacaaacgcagtcaaaattctgtgtgatatccactcttgtagctgagatagctgagtagaagtactacggacaacagaagagagcattggatgctcgagcgtcttgaggatcagaaaagagcatcgtgagaaggactatgcagcttggagcggtcaacctgccttctagtttacctgtgtgaccgaccaaaaaccgagttaactccaaaacggcatggaaatatggaatcgcgatctaatcgaatccacttgaactgagcttggcgctgtcaaacaagagcccacatggatggacatggggatcgattggaacactgtactaccaaccaactcggcaggcaatgtcccgagccctttttcgaatgttgatcggcctgtctgcgaatgcgatgaccaacacaaaccgcatcaggtcaactttaattcagtagtgtactagttgagcaggtgcaagtaatttcaagcaattcctctcaaataaaacattttaaaacaaaagccttgaaagggacatgattttctaccatcacaaagaaagaataaaaagtttctcccttagtgatgagtatataaagttcaggggcgatattggatattcccacttgctgccaaaacatgggagctcccagtccaaagattggcacacaagacgcgcactagccttagcacaagtacttccattaggggctcattttgtattaaaacgttggaaggagggagttaagtagaaattgtcatcccacccgtctttaatactgtttcctcagacggagggtgcagtgcagtgcagggaatcatttcatttcttcttcttcttcgccgccgccgccaccttccaccccttcagccgccactccaatccaaggtatcctctcccttccccctcctcatccgcgctatttctcaggacttggatttattttctgtgggttgcgtccaatctgagcggaagctatattacatcgagtttagtttgttgcggatttggtttctgcttccaaagggattgggtggggttcatacatgaccctggatctgatctgagtgtagtaggtaggtgttaagatcaatcggatcaacgactgtatcttgttcggatgctcatctcatggatgttagcctcaggtcagggggttgtatactgtatacagcttgactgtatttagttccggtaggggaaaagaaagcaactttgcaagttgcaactctgctttttgctagatgtttgctcgacctgctaggctgcagctcaagctaattaaaaatatattttttttttcattctgatagcagctatattgatgcttgatctatggttcctattatgatatgatcataggaggatgagtgaagaggacaccaatgctgctgctgggcagcccaggcgcgcccctaagctcaacgagaggatcctgtcctccttgtcgaggagatcagtagctgcacatccgtggcatgatcttgagatcggtatggaactgtctttcccatctctctttatggctcacccacaacactatgtggcatgcatcatctcacttaatttggttcaacaggccctggtgctcctgctgtcttcaacgttgtaagtgtcatctctgcctttacctatacatatgatgccagagtgcgtgcaaaataagtttccttggcgggctgtaggctgcacaattttgccgctagacgggttgaaacatgttgaaatcggaaataatatctgtccaattaatatcgactctgtagaggtccgcgacagcttttggtgtttgctaaatttacagttcaataggtgttgtactttccagttacaaagaagtaacatgacactctcaaggaataaagaaattcactcaccaggcaaagagcatgatgaatgaataattagaattcagctcttcataccaatttaatcaggcaagagaatgggggccactgaatttaagttaaacaaaaattaaagacagttgcaacatccttggtattgcaccaaacctggaactttaagtggattgatcaagccatggaacaacagatgccaatcataaataaacctagttggaaaagtacttacatttataagttcttaacatttctaaaccttctgctgatctccatcagtttctcagcaactttgttgatatcatggcatcaagcatctatcttttgtgggcgcagcatgtgccttctgtaaatcttggtagtagcaggatgatgtgtattaggtggcagactggtaggtgtagccatatgctgccatgggaattttatgcttcttgaactgtttatacctttggataaattgtagctaggattttgattcgaattaaaatagaaccactagtagactcatgggcacgttgtgaatttcacctttccccctttttctactattaagattttcactgaatattttaactttactgatatttgattctggtgcaaacaacaaggattttttttttgtgggggtaaacaacaaggaatgttagtctgctgggaaacaattgcttatgagtcaaaacaagtgtgtcgagtggttttgattgttctgtttaacgattctagaagctttatctacagtcggttcctgacagtgcatgcaacctacatggttaatggcttccatttatatcacaccacaggttgttgagatcaccaagggaagcaaagtgaaatatgagcttgacaagaaaactggactgattaaggtgtgtgttctatttgtaaaatgattgcttgcatatcattaccacaactctatttcaagaacaatatggactaatttcataattattttttgtgtacttacgtaaggaattaaaagtatgcaccaccaccatgtacttgtgttactgtgttgtattatttgataggtctgcatttgtaagctgtaggagtttattcttgtcaaagaatattacatttttgtaactgtgcttcataatttgacaggtcgaccgtgtcctatactcatcagttgtgtatccccataattatggtttcattccaaggacactttgtgaagacaatgatccaatggatgttctggtcctgatgcaggtaactccattgtgcttcttttcttttaaacatgcaaaacagtcctttgcattattaactgatagtgtctgagagcaggggatcagcctgcaagtcctttggcattgacacttttgaacaagcaccagtagttttttagttgcacctcaaaaccattctcttttttactacagtgtggaatatattgtgccattatctcgtggtaatgtgttcttttaatccacacaggagcctgttattcctggttccttcctccgtgctagagcaattggccttatgcccatgattgaccaggtatattttctactgttctgtttgtagcaaagggaaaaagacctgcacgggttcactctttttgttttgttttttttttactgacgatattggattttgtgatcagggtgagaaggatgacaagataatagcagtatgtgctgatgatcctgaataccgtcattacaatgacatcagtgagctgtctcctcaccgcctccaagagattaaacgcttctttgaagactgtatcctcatagtccgttttatggtttaaattgcatatcccatatagtatagtattggtcatgcatacatctgttattgtccttaacaatatgtttttagacaagaagaatgagaacaaggaggttgctgttgatgcattcttgcctgccaacactgctcgtgacgccattcagtactccatgtaagttctctgttctgcagtgaaatataagtccataacaagatgtgattgtgtgtgttgtggaataggtatgaagataccactattccttttggcatatattgacacatatttttgtttatttaatctcagggacctgtatgcgcaatatatcttgcaaagcttgaggcagtagagtgctacccgatctttatcgtgaaaatattgtatttgtgccaactgcaaaactggagtagagactttgttcacaaaaatggagtgctatggggctggctatgatttcctttaccctccagctgtgtatcaatttgcatgtggtttcatacttacaaattatgaataagtgaagtttgggcagacatgaatttgttctgtgtcatgcttctgtccctccggatcgtttattgacatgaattactgttcttgttatattatttctatctgctctaaggctgtgtttgagaaaagcacaagggggagaaaaatccctcgttttttacacttacgcttcctgaaggttaaatagtgctttttttccttcaaaattttcctatagaaaagttttaaaaaatttaatccattttcaagtttgatataattaaatacttaattaattatatgtactagtgacttatcttgtgttgtgtatattatcaatctttttattacgggatgtgcttctatgctccgaaaaaaaaacttgcacgaaagttaaagcgaatcagtggctgtgattaaaagggagattagcacttaattatcattagcgaggggtaatttcgtctaaagattttcgagcccatatccagcccagtccgatccccacccccatcagtccaccacggcgccgctcctcaaccgcaccgccgcgctgattttcgccttgccaccgttgctctgccctcttcttcccctcgcaacgccgccttgccgcccggctccctccccacgctgcttcctgcctccctccgccaccgtcggtgctgccatcgctcctccacaacccgcgcgtcggcggcgtcgcccaaccatcgtcacctattgcgaatgccattctctcaattctattgaaaagtggcagcgctgagactgcatatgaggttttcatggtgcttgtaaatatgtacaaccaaatttgcaagtcgggttgcagcaataaggtattgactctgttctgtaacttgaaggcaaatctttgaggagacaatttaaggctgaaactgaatttactgtcactcaggccatagctactcagatatccttttaactgaagaagagggcagagcagcgacggcaaggcgaaaatcggcgtggcggtgccgttagtagggggtggggatcgcttcagatggactgagctggatatgggctcgaaaatctttgcacgaaattaccccctcactaatgataattaagtgctaatctcccttttaattaagtgcaagttttttttttccagagcacagaagcacatcccttttattatttttttcaattctaaaacacaccctaattgtagtgcgatgattttgctagagcgtcgaccatcgattctctgtatgaatttatgaaaatctaaacggtgtgcactagttgttttaacataaaatctaaactgagaggcttctcgctttagtcgtatcacgcgacgcgtttcatagccgatcgatcgcgcctatcgtccatccacgtggccacgctgtaatggcgcaacgagaaggattgatatagtgtgtgccttatttctcaatagacatgtatatctttttcctattcaaataaagttttctcttaaattacttatccgatctataatccgattacaccattgtattcgttacaattaaatcttcacaacaagatcttgcatgattatattacgatgaaaaaatatttatatttataaattacttttattatatatgtaagttacttttatcatatatatataagttacttttagatatgactaaattatttcttagtcatataaaagtaaattcaataaagtctaaaagtaatttacatatattataaaagtaacttaaaacaaaatggaagtaactttatcacgacattagaagtaatatgtgatctaaaagacataagttttttttgaaatgaatactaccaggcatttgcccaccagtgtacctttttaaaaagatataagttattaaagaaattaaaaaagatacatattattacatttttcaagttcaaaggagatggagtacaaaccagctaccactatctgtgtagtcacgtccaataaaaaaaagacatgcattaaagttacactccttttgttataagttacttctataatatatgcaaattaattttaggttttattgaatttatttttatatgtctaagaagtaatttagtgaaatctaaaagtaatttagatatactataaaagtaatttatgttttttcatcaaaatataatcatgtgagatcttgttataaagatttaattgttatgaacacaacggtgtaatcggatcgtagatcggataagtagtttaagaaaaatttttatttgaagtataggtggatagggtctctcatatatggagtggtagctggtttagacaatacagctaccactcgctgtgtagtcacatccttattttaatcgtgtagctctaatctcaccgtcactggttggtctaatcttgcaactcttatctcacccgtccgattatagcaggtcaaaccacgtgctgagaagtgtgcacaaacgcgttggcccccattccgcaaaaacccatcgcagagctcatactcttcttttgtgatcccatcgaaaaaaaaaataaaacatcaaggttaatatattgatttagttccgtccattagatgctgtccgatacaaagttattcccattttaacttctaaatcacttctactttattaaaattattttctggatgaactattaaaatgattgcttgatgacatataatgaaagttttattgtgtttttttttaccctgcaaaactataaattttggatttattactaaattcttttgtgaaaattctggctagacctccgcgacactccgtctccgacgcgagggaggctacgtggagcttgggaagccggaggggctacgacagcgaactctggcgtgaggtggtggatctagtgctgcaccgaccagatccggtgcccccacggctagatccggcgtcgagtagctgatggcgggaggtgacatccgacgcggggaactacactaggaggccagcgcgggtggcatcggcggcagtaggagaccgacggctgcaagggatggcatcattggcagcgggaggacgacgtcaacaaacggtaacaggaggctaagagcaagtttaatagtagagctcactagttactattagtcaatgttaaagctaacatgtatagcaggttggctataaggctatctttattttcttcatcctctctctttctctcaccatgaatttaatacatatttcttagagtttgtgtgcagttagctcttgcatgagagccaacactccacacttttatttatctctctcttccacataagcatatagcttgtttatagcccactattatccttgctctaacattggcaagctgatgcgggcggtagcgggggcggcagcaaaagcgagggaggatggctcgtcggttgcaacggacgggcgacaacgggtgacagcagacaacaacgcgtgaagtgggaggtccatgctacaggacgacacattttctgtttcttatcccgtttccaatctcgcatcttctcattcccatgtcatgtgttacctaggtcaatctcgcctcttctccttcccgtgttatgtgttaccgctcctagccaaagtcagaagatgcatatcctcccttctcagtccagctcttcctccctcccgttcctgttgaagtcagagtacgtatctcgcgctagatagatagtgcacggatttattcgaaataataaaattttctgcgcaattgcacgggtgcttcgtggacagatagtgcatgggttaaattgactctttctgattatatttgttgtcttaaaaaaagaatgattaacaaataaattacccacgcacctacattgattcaaataaacgtgcatatatacatatgttctcaaatatgttctatatatagaattgtacgatacacttttacccacatacataaacgttctatcccccacacccacacactacctcccacctcatcccaaacacacacacaaaaaaaaccacacgcgcactggggggagggggggggcgcacatacaaaactacacgcacgctttgggggggggggggcacacacaagagagaaaatccaattatgtaatgtacactattattactatatgcgtaccctccaatgtaaagtgatatatgctcttgaaaaattgactgggtacgttgctattagtgtactaaacatgtttcaacatttcaaagtttcaactaaaatcaggactgtggtacacatagcttcatcggaacctagaaaatgtccctgaacttaaccatcctttcatgattatcttcttttgtttcatgagaaatgtaatgaatatgaaaccgattgttctagatgtacttactaattttctgtgaactgcatcaatgacattttctaaaaaaaataaagaaataaaaatggagcattttaacattgtctatgccgggacatgatggcaattttgacgatatatacacttggatttcaatcaagcaaagcaatcaaatcgagatctttatcaattctggaatttatgtttaccattgattggaaaaacaaatcttgggataccgtcgtcagcttgtggccagtcactgcagacgtatatgtgtgtatcacacattaattagccttattaactattttgttggtagaaacgcttatataagcagcagttagcacccctcgatcttcaaacttgagcacaagtgttgcatctgtaacaatcagtactgtaagtttggtctcgtatcgatcatggccgccgccgccgccgctcctaacggcaacagcaacggcaaccatcatggcctgcagggcgacggtgatctacagatcaacgacatcgaccgagtcttggagagatctctcatacgatgagtaacacatctcatcttctatctacttgttgcatcaatcctttttttttgtttctgtaacatatctatacatagagtgttgttacggtacagcggtcggtaccggtactgcccggtaccaaaatcctggccgttggatctggcccgatccaacggctggtagagtttggtaccggcggtaccaattctgtccctgtgcagtaccacgtggagaactgaggtggaagggcaaaaacgtaacttcacgtgcaataaccggatcgggagggatggacgggcatctcgaaccctagaagcgctgggattctcgatcgatcgccgccgccgccgccgccgccgggaacgaggacatcgacgccgccaccgccgccgggaacaacgagtttgctgctggcgtcgcctgcttcaacgtcgccgccgctaccgccgcgggaaggacgacatcgacgccgctgccgccgggaaggacgacatcgacgccgccgccaccgggaacgacgagttcgctaccgccgccgcttgcttcaacgccgctgtcgctgggaaggacgagttcgatgccgccgccgcggcctgcttcaacgtatgtcggaatccaccgctcgccgccacttgattgcttcaacgcatggctggcgctactctcttccgatcctacccatgccgaaacgaacggtagatgcgtactggtaccgagcggtacaatttgctggaccataaaaaatctcctatacatatcatgcatgtctatgcaattatgcatacatgattgtgtgtactacacacagataaatatgtgtgttgatgtaagtgtgatgatcgaaaatgtgtgtgatgcagatcagggtgttggatgagacgatcaggaggcttgagcagctgttcaggttcacccaagcaaacaacccgggccctgctgtgctgctgaggatcattgggaggatcaaccgtgcaaacgccaggagatcaacgctcttcgcccagctccacacctacattcgccgccgccgccgtcgccaccaccagcaacaggcgcctccgtcgccacctgccggcggcaacatcgccagcaacggcaacggcgccgccatcaacaacggtaacagcaacaacgctgctgctggggctcctcctgccgatgcatgagctagcattgaccctagcttgatgccgtgatgctgatggacgcatgtagctggagatgatgagtgttgctgtcgtttctttgctgatcgatgttttctagctattgaagttgttactagaagtcatcaatttatttctaccggtttaatcagttttctaataattaagctagcagttgggaatgtgcaatggatttttctaaaagataaattgaatatgtagctggagagatcgaataatttttgtaactcgccttgcctctggaattgatcaatcgggtgatttctgttataaaagatacagcagaacgacgactaactttctcgatcgtttcagttattgatcacctaaaacacgctagatgacgacataagaacacacgacattaatttgttaatgaggttcagctgaagcttacatccccagggctttgattatggatatttttctccaaccaatatagctactagccgctacgagtccatgaccacgccgccatcatctccctgcgtgtctacgctacattgtaatcgctatggttatattgtggtgcccccctaagacatggttacatggctacatggctctatatatgaaattggttctaaaacatactccatccgtcccaaaatatatatagcaacttttgtttggatgtgatgtatcctagtactatgaatctcgacatgagacatgtctagattcgtagtactaggatacgtcccatccaaccaaaacttactatattttgggacggagggagtagataaggtcataacagttgttcaatataatgagggaaatatcttctctagatatgtaaactgagttcatcttagttttgtccttcttgtttatgttattatgtactcctacgactacagcatcgtaatgtaccacgatttgatgagtaatactccaatattcaatagttgcctaccatagttcgcgtaataagaaaaggaatactgataaaatcaacataacagagtacgttagactaaagaaagttttgcatcgggctgacaaattccaacctagatggtgtacacatgcaaagcacaccctctcaacctttatacaaccactaacctgtgtgcaaacataagagtgatatataatcaagattgcaccgtgaaccatttcccgcgcaattggatgaagtccttataaaataataaaaaaaggttatgattctagtatgacgactatataattaaatgaaccgatatatttcccgcgcaattacgtgaataaccataataacgaaccctaccaattatagctgacaacgtgtgagtaaacctattacgtagtttcgtgtaaaataaactccacttttattaagttagagtagtaattaatgcacaatatttccatttgtctgtattgctggtgtccattccccattatttttcttgtgccatatgcgtatgcaaggtgcggcctctccagtggccacgtcagccatatctcacgtcatgctaataaagaagggtgcggggtaggtgggccggcccattgatcaggcattccttcaggcttctcctagacaaaaagttaaactgggcctagttaattagcccgttctccacaaccagatcaaacaacagccacgacgtcctcgcaaatataatggagaacatccatatctccgcgatggtaaaaggaaaggaaaacaaaatatctttgttatactccctccgtttcgaaatgtttgacaccgttaactttttagcacatgtttgaccgttcgttttattcaaaaacttttgtgaaatatgtaaaattatatgcttacataaaaatatatttaacaatgaatcaaatgatagaaaaaaaattaataattacttaaatttttttaataagacgaacggtgaaacatgtgttaaaaagtcaacggcgtcaaacatttcgaaacggagtagtagatagtgggcgacaagacaaaattcttattttcttaagaaaagaaaaggagtgaaatgaggtttagaataaataccagatatatataactagtttagctgttcaaagggaatgtggcgaaaagcaagcgagagcaggcatgcatgcatgattgcccacagcaaaaaagcttggttttgttttgccattaatcgctgttcccaaggctatatacatggcttgatcattagtaacagctgtatgttcaagctgtgttaattatatatggcatcgatttggcgatatatatatatatatagagagagagagagagcgcgcgcgcgcgaagcaaacattataattaaccagagatcgattggtagcttcaaaaacttaaggaagaaaaacttaggagtaatttgcatggattattattattattattattattatatatatgtatggagctgagtacaaggcttaatggttttacttttgctacgtaaagtcgtcgatcgactattagttagcctcgataggcagccggagcagctagacaagcaatctcttgtaagcagaggagatcgaggaggagaggaaagatcgaacacgaagaacgcgtgcatgtgcgctcgtatatatcatgcgctcatggcgccaaaacatcatcgtcgtccacatgcatatgcagttttagtttagtttaattaatgcagtaagttttaaaaaaaaatgaacttagtagtagagcagagagcttaattaactagctagtgatcgatcgatcatatgccgctggccttgaagagcctcatgaggccgaaggtgatgcccatggcggcccacccaccgagcaccaccctcgcgctcgaccgcgccaccgccgcccgccccagcaccgcgcccacgcacccgaacgccgccagcgccacgctcgccaccgccaccaccaccgcgatccgcagcctgtagttgacgatgaacccggccgccagcagcggcaccacggcgcccaccgagaacgccatggccgacgccgccgccgcctgcgcggggctcggcagggccttctcctcctccccgccgcgcttgccatcgcgctccagctgcgccagctccacatcgcgctgcgagcacacggacacgaactccccgatggccatgctgcaggcgcccgccaggaggcccgcgaagccggagatgaccatggcgcgcgcctccgccttcacggcgcccacccccagcatcagcgacgccgtcgacaccagcccgtcgttcgcgcccagcaccgccgcccgcagccagttggcgcgcgccgccaggtccagctcgtcgcccaccgccgccgggttctcggcgtcaacctgcagcttgttgctgcttgatctctcgttgttcatcatggccgccatggctgattggctggcctgttagcttaattaattagctgagatcgatcgagtggatggatgggcagtgtggcgagcacgcttcttggcgtgttttatagtggttttcaggaggttttggtgtggctattgcgtgtcgccaactaattttaaagctactacactagctgcagtgcagtgcatcgttatatatgcatgatcgatccatctctttttagctatctacctctctagaccaacacccttcacttttgctcccctgtattgctcctcgacatgatgccaccttccacgaacatttaaagtcacctattcttcaatatcggtgcttgccgattgtgtatgtgcaaattacatttatatctaatattaataattattcattgacttaactgacaattacttaataggctatatatattaccaatatataaccagctgatgtgtttgatttgtcgccaaaataaaccttaccatattttggtattatttctcaatatgtgagttgagtatagatttaggattttatgaagttgtatgtatatacattgtatgaattttgataggagataatactttttagcaaacgagtggacatccctttgagaaatcaaaagaactagcacggtagcccgcgcagattgcgcggctagcatcattatattttctctcatatatttagcatatatattttctcattattttattaaaatatattacaatgacaacataattttaaattttgcaataacttttaatttcaaatttcagttacttctaaattgtattcctatattgtctttaaactcttcttcccatgtttttcttaatttcgaattttatttatttataaaatgcatttttatatggactctaaacactacttttcattttattatgtttattccgaattttagttagttttaaatacctatatagactctagactctacttctaatattccttattttttaattccgaatttctatttttttcttaattatatttctatatggcctctatactctacttctaatattcctttttttaattccgaatttctattatttcctaatttcctaattgtatttctatatggactctatactctacttctaatattcattatttttaattccgaatttcagttatttcataattgtatttctatatggactctagtctcctcttctaatattccttgtttttaattccgaatttcagttattttctaattgtatttttatatggactctagtctcctcttctaatatttcttattttttaattctgaatttcaattatttctaaattgtatttctatatggactctagtctcctcttctaatattccttattttttaaatttagaattttagctatttctaaattgtatttctatatggattctgccttttctttttctccgattaatgtgagaatttccaggtcatgagagcgaacgtggaggctcctttttctattcctttaataatataataaatttcccatgcatttatatcttcaaactgtactgttcagtgaaatttgtcataccagtcgattgcactgatcgattccctgttctgacttctgaacaccatggagtgcaagccatatagtaagtgcctagcacgtactagatgatgcttaatttcagcttcaaggtaactgtgcaagatcccttgaagacaaaagaggcctctcgtaccttaacttactacatttggtggactactctaagcagaagatcgactcgtttgccattaattgtacctgaatgaaatgattacattagtttcactgtgcaacatatgcgctctctttagcatatactcctcctatatgcatttcaaagtaaaggagcatatgccatgcattgaagatcatgcatgttgctagctcaatttactactggtagatgaagtactatacttagaatcagagaaaagcccaccttaaattaacactaccttaacgttgtaagcaattacatatatatcgaagttatataaatattctttgtctatatgagtttttcaattttaagacatctttttttatttcacgccactacaccagggctttaaattcctaaagacggtacggtatactgaaaacaattgtagctagctagctcatacagtcaaagtgtgcgggattcggttaagttgacaggggaatgttctccttgtcggatgaaacctcattatttccttaattgtcacttcatatttacggccagtgcttgggagtggaattgcactttttttaacatgagaatccaagaaggaacaaattaaagaaagaaaagacaccggtctgtattaattctagaacggcttcgatcgagcccaatggacgaatctgcttgctctcatcttgcttccctcacagaagagaagaaaaaaactatacatatttatattagtcaaaatgtatgtagtagtacaaaaattaatgtcaaggtgtgcaatgcaaatcagttaaattaatcaaattgcaggcatccctctcgtggagactgttgtctttttttatccgagcaaaaaataaaggaaaaaagctttgagcggacattagacatgaacttttggagggaaagatgacaagtggtgaacggaaacacaactttgcaaatggaaaaaaagatgaagaagaaaaggcagctcgatggactccctgccatgggcaaagatcaacgacagaagaagaagagaagacaagagttttcaaagaaaacgaagaggacgatgacaaagtgcagcagagcaggtcaagatgttaggtacgctactcgatggcactcatccatcatccatgtatgttggagattatggagaaataaaaacaatctagtggagagatttgttgtattgattattcgtgaaaaatcgggcgagatctagtgagtgctgaatcggcagccactggaccataggtcgatcagagaaatggtacgtagctgctgcaagcaacggctcgcccaaacagccgaccggaagaacggcgtgtggaaagagctagcaatcagagtaaattaagaatgatgatgatcgagctagccgccatcacgcgccatggatcatcaattggtaatcaagtgatcagattgattaggggttaagagttcagacagacacaatagaggattaataataggcaagcacatatagatatgtagatatagtgcgggataagcatggcgtccacacgaaaggcaccactctaatccctctttcggttttatcaatcttatcccgaattctggctggctgctgctgcctgcccatatctttgtgttctgctccatctctgctttaccatctcattctccactctatgttgttgtatcatgccactggtctctctctctcgctttctctgatccctgcttgctttttcattgtagactgactaatgccattttcctgccttgatcgatcatataatggagcattttagctgattgaggatggcccttggggtcgcccaagcgagcatgcatgcactgcacgagcacaaatgcagtttgtttgttcagattaattaaaaaaacaacaacaagggctgcctcttgcaacgcatgatcgattgatcgttgaaaagaaacatgaaaagattgagatttttgccggccagaaacaaaacatcgctgtgctcaccgcacctggacgggatccggatctgactgcagttctcatcaacggatgcaaatcggacgatccagactgtgatcacactgttcatcatcgtactatagcaaaaacatcgtagcaagggatactattcatgctgttactgtaacagtaaatctaaaccatcgatcataaaaataaatggctgagattacgtacagttctcagaatactgtcacaacacttcttttagggaatcatttggcgtgctttattaatatacaaacattgttacaacattcactagaacgtttagaacgttaacaagaaaatatgggcctcatcaaaccaattacaagaattcctaaacttaaaaaagtaagatttgctagaacatgtgccacacaattggcttccctattacaatgctcaacagagattttaacaaaatcatatatcaaaatctggcattcatagaaaattgccgtagccgttgttaccaaaaagcacccatcttacatcgtctctaccacctgtaaacaacctgatcgggtaataatgcagtcacaacacttatctgaatccaactcgacggttgtaacttgtaaagccgccggtttagactactataaaggagatggagggtagtgggttgtacataaatgggcttggcctcttttccaattgtagtggcatacggcccacttcccttttaagccctcccccaaacacccgacactgtactggcctgcatacgggcattacgggcacggacggacaggtggaccccacctgccattggcttccaagtctactccccacggtgggaagggaggcagcaagggatcgcgacgccgcagccgcaacggctttcccgtcagactcacgtcttccaccagcgcctcccttacacgcttcactgacagtgggtccagtcttccttgggacccacatgcatagggggccaccgcgcgagtaggtgaacccaccgtatagtactagtattataatccgctctacagcctggctgaaatgacggaaatgcccccgggctcctcctctgtgttgtgtagttgcgcaccgctatctcggctcggctggctccagttccccaccaaactctctctcgccatggccgcatccgactccgactccgacgccgacgccgccgccgccgccgccgcctcgctgctgccggcgcccatccacctcctgccgccggacgcgctccacaacgtgctcctccgcctccccctccgcgacgccgtcgtctgccgcccggtatcgcgcctcttccacgaaaccctctcccacaacttcctcgccctcctcccctccctccgcctcctcctcctccgccacccgcgccccgaaggcggcggctgcctccacgccttcgaccccgaccgccgccactggctccgcctccccttctccgccttcctccccaaccagtccttctccccgtcgcctcctccccctctctcctctacctctggctcgagtccccttcgcttccccgccatccctcccctcctcctcctcctcctcctccaccgcctccaccgcccacccgcccaaatcgctcgctgtctgcaaccccttcgcggggacctacagcttcctgccccctctcggatctgcctgggcgcgccacggcaccgtcctcgctggccccggcggcgtcgtcctcgtgctcaccgagctcgccgccctctcctacaccccatccggatccggcaagtggatgaagcatcccctctcgctcccctccaagccgcggagccctatactcgcctccggcgctgccgccgtcttcgcgctttgcgatgtcggcaccccgtggcgcagccagtggaagctcttctcctgcccgctctccatgctcacaggcggctgggcccccgtcgagcgctccgcgtggggcgatgtcttcgagatcctcaagcgcccgcgcctcctcgctggtgccggcggccgccgtgtcctgatgatcggcggcctcaggtcctcgttcgccatagacgcgccatgctccacggtgctcatcctacgcctagatctggccaccatggagtgggacgaagctggccgcatgcctcccaatatgtaccgttgcttcaccggcctctgtgaggctgctgcacagggtaatgccatgcctactgctgttgctggtggcaacaacaaggtcaaggtgtttggcggtgatggcaaggtgtggtttgctggaaagcgggtgcgagggaagctggcaatgtgggaggaggatgagctaggcaacagcggtggcaagtgggactgggttgatggtgttcctgggtacagtgatggcgtataccgtggctttgtgttcgatggtgggttcactgctatgccctgaagtctatggagaacacataccagtccggtgcgtgactaaatgcgctcaggttaagattttaattgattcgggacatctatccattgcatgcagggggaattgacatgtcaaagaattttatttgcattgtacttggttcgtagcatcatgagatactttcaattgctgtacttgttaaaagtgaaatgttttaaatatcttttcagggtttgttgcttcagacaataaaattcaggttacttttattttgttttgatgatttcgtaggggggaatatgtgtatggtgatcactctgcttgttacatgaacaaggtgatcacatcgttataataactttgctgatcttgactcgcgacactacttacatattagttctcagtagtcagtacataattagttttcctactggccgcatgaagtggggaatcactatatataaagttaatgaattcaggtgtgccctagttctttctactcagtactttaatgttatcagcagtcatagcaagggcaggcaagtatacaatttttcctctgtgtgtgtgtgtgttctgtacttactattgatcttttgaatttatagtttcctagggcttggttggtactctagttatttgtcttctgaaatgaacatgaaaacaagtttgttaggtcttaagcttcatttgttctgaccttagatgtgctattgggatgccttatatgaaatatcatccagcagagtcagggatgctaaaaataggtcctaacacaagcatatatatatatatatatatatatatatatatatatatatatatatatatatatcttcattcagcatgtttcacatacagaatagcttttaggtattccaataccataaacgtgtctatgttcttagttaattcagcaataacattatatgttttatgctgtgttatggttcttaattccttatggattcaaatatctcaacacactcttttgctgaattcctctgtgcttgtacattgttcaggtggtgatcttagctaataaaaattatagaaaagcttttgacaggttttgttatgtaacaaggcatgtccatataattgataacttgcgtgctctcttgttgacagggtgtgttcgctagcccaggatcccaaccggaacagtgatcgtggaaaacggggcggttcattagggcgtgattaattaagtatttcattagggcgtgattaattaagtattagctatttttaaaaaaaaatggattaatttgatttttttaaacaacttttgtatagaaactttttgcaaaaaatacactgtttagtagtttgaaaagcgtgcacgcggaaaacgagggagaggggttgggaaccctgggcaaagaacacagccatagtgacgtgcaagcacctcaacttttttttcctcgaaaatgagcatctcatctttgaattcagaaagtcaggagtctacacaaaagagcatgcattcctcttctgctctgtgcttgcaggttcaggtggtgaacattatagaaaaggttttgtcaggttttgtttcgtaacaaggcatgttcatataattgataacttgcatgctcttattgacataatgacatgcaagcatctcatatttgaattcagaaagtcaggagtctacacaaaagtcaaagctagggtacagctgcactaattatgaactgtatgaagtggtacttttagaaatatagtgtagtaaggaagcccatttgccaaagattgaaacagttcatggtcatgcaaccttgggttataacaaactaatttagtccctagttgcaatgtgatgaggtgctttactaaacttaacgtggtgaacacattatttagttcttattttagctttgattaaagacacaaggagtataatatgcgttgcgtatcttcgttttgggccgtgcttattggtcagtgctacaacctttagttctaacattggttccagaataagtattatctttgttcatgaatgctttcagcttttacaattgtttgcttaggtggagtaaggttttaagtgatatgatcttttgtgttgacgattcatctgcctgtctcaaacattatgggcattggtctggggtcagggataaatggcatatgaataaggagtttgttgcttgccttaggtaaagataatatatgcatttttcaaactagaatttggtatttgttaagttatagataaagttgtagctacagtataa

SEQ ID NO: 81280 - DNA, 33052 bp, Oryza sativa
tcctgcagcccttaactaagtttgtaggcaaatatattaatatttacaatactaaattaatttcattaaatatatttttataatatatttgtcttgtgatgaaaatataaattcttttttctataaatttgatcaaacttcaaagtcaaaacgacttataatctaaaatggagggagtacttgattatggtttttctttgtcaagatttcaaataaccgtttgacaggttgcacatttcactatagacttgtcaatctcaaatacatgatgttccagtctatattcgaggtgcttatagggatagattatgtgtttgggtgttccaaggggatgactgtgcgcgcatgtgtacgagcatctacatttgaatgagtttcttttcaaaaaagttgaagattattttattccgtgctaaatgttactacctctgtcccaaaataagtgcagccatggatatccgtgcccaacgtttgaccgtccgtcttatttgaaaattttgtgaaaaaattgaaaatatttagtcacacataaagtactattcatgttttatcatctaatagcaataaaaatactaatcataaaaaattttcaaataagatgaacggtcaaacgttgaacgtgaatagtgtaaaactacacttattttaggacggagggattacatgctgagtgatcacagtttggagcactagtaggattgatactatttttgcttctttttttataatcgtgatgtcacactgatgtgcagcagctagcttgcacgtgctcactgtatgcgctcgactattgatagagtgtgcagcccggcccagcaaccgtgggtcacccatgttacattgggcctgcttcaccacagacccatcggagctacaactttaggtcctagacttacacaaccaaaaatgttagtctgatgggtgagtaatgctcgacccatggaaattggcttccaaatcagagctctgatatcacttgttagagtgtgcaacccggctcagcaagtatgcaacccggcccagcaaccgtgggtcacccaggtcacattgagcatgctcaaccacaggcccaacgggaaccacaactttaggttctgggcctacacaacccaaaaaactagtctgatgagtgagaattgcccgaccttttaagtcgtgctgcccccatcatcaattatcgatatgtgactaaacccaacaactatagatatggatcaactatataaattgaagacccttacatcacatacatatatcaatgtttcctaaagaaacccataaataccagtgagtgtgtaggttcagttcacgttacatatgaaatatatataataaaatgggaatgcatgctatccttgaaagactggtaaggtcagataaaatttgcatgctatcctattcttgttgatgcttggccactatgactcgaagaaaaacaatagttgaataggcttgagaggaatctagaaagttaatatctctaacagcaacagttggggctcactgaagaatcctgctggtctgttttgttttgcagcagtagcttcttccaaccattgaggagggtgaacggtagattacgccagcagaactcaaataatcaaatcttgatagattaaaacatatcccaacttaaaaaaccaatggaacgcacgttcggcggtctattcgacctaccaaggttagtctgacagcagttcacttggcgatctgaccgtcaacctaaaaacagtatgacaaagcttctgtaaaaactcgatttcacttaaaccaaccattggatccacttgtaaactttacagaataaactaaacaaaccaagaaacaactccactggaggtatttgcaaactaataaacggtttaagagaaaacaccctcgaaagtcagctgcctcagaatttcagcaaatctgaacaaaacctaaaacttaagcaaattcaaataaaactttccagatctgatctatgaagtattagaaaggttttagatagtttaacttgaataaaatcgcattaaaatgaagaatatcaagttaatgccaaaactgaacaatatcgtaaaacttatgaaaccggaagagatcgtcgatgccttgatgattgaatataatatttattgctcaagtattatttacaaggtgcagacacaacagctcttgaggctagctaatcatacattgtttactgttaatatgcatctgaagcactccttgtgaaatatggtcgaaaggatcttaatatgtgccagaatggaatggtagtacccagaattgttgtcagtcggttaaagaattagttagctttcgttagtcctgacaggacactaattagtcactcctcttacatgtgcagtctttgaaccatttggtatattgaaatcaataatgcctagaagtaacgtgtgaaagcatttgtgctcccggttcgtaaccccatgtactcccggttttgcaagcgggattatgaatccgggactaaaggtgggtatctttagtatctaggactaaaatccatatttagtcccggttggtagatggatagggccacgtcacgattgttttttacttattattattatttttttgcttgtacctattccccacccaaacccacccaaaccattcacaaattatacacaataaaatcatccacaaatcatacacattcacaatccacaaatcatacacatccacaatccacaaatcaatcacaaaatcatccccaaatcaacaaaaaaaatctccaacaaaatatacaaatcattcagtacaaaatatacaaataaaaaaaattcactcgctgccgcccggccgtgcaccgccttgcgcccggctgccgccgccaaggagagttcccaaatgacttcataattaaggagccactcggtctacgatggcgtggtataatatatttctttccaaaccgaataatacaacatgttaaagactatacaatttcatattatatcataccaatctctaaagggtaacaataataatatggtgtatttataagaaaaagactatttacaccttagatgaaacacccaaaggttaaaataattaagaagctcacgagaggagaaataattatcatcaactacagttaggtggagccaggcaattaattgtataacatttaggatacatgatacctttggacccaacttctatctatctattatatactaaaagtacattaaacttcctataaacgctctcgagtcgccaagtggcgcttctacaaacactcctggaccgccatgtggaccgccatgtggcactatctaatctcaccgtcgattttcacttaaattgatggacccgttaatttagaacattagattagatctattattaaaaaggtgatagtttttcctaaaaaatatgcaactggtggctgggaaaaggaaataaaactaaatgtccgtacgtaagtataattgaaaaaaaaacaaataaagcttcccactgttaggcggaagaaaaaaaaacatctactaacgataaaagatgataaagcaaaaaaaaaaagatgactcatccatcctctcctcaccaattcaattatctcctcttcttttttttaactaacataatataactattgttttatttataattaaataaataaatcaagataacattagctatattttactataaaaagttaaaatacattatttgatggtagaccctatcgtttgaatggcaactaaataacaacgaaaaattaatcgaacataatatgtattatgcgatactaaatcactatacctaacaaaaatcaattaaaacgctctagagcgctcataaatcaccatataatatgtcctaaaattataagaaaaaaaagcaaaatttgatacaggacacccaaaaaatgtgtaattggctgggagacaccgtaaaaacgtgacatggctaatggaaactataaaaattatgtaattggctataggacaccggaggcaatattttatatttccgagtcaaaacaggtgagaaactttttgaaatggtgagattgcccctaacacagagcgtcgccgccgcctcgcccaccgtgagcggcggcggttgtggcctaccccaccgcaatccgccgcagcggcgccatccgctacttccgatgggtggatccggctgcagaaatgtcctgcgggttgacggagcgccctcggcgacggcgtgtcttgagccgctggagcttgtctctcctctccatcttcgtccgtcacctgccatctctcttcggacgacgagcttgtcgccggtcagatattacgtattgctttgtgatttgctcgattccgttggtttccagctttcactcctgtggatcatcccagctgattttattaagttcgattcagagtctgttggtttaatttttagctgattttgaatcaaactctttttttttcatataattgcgtgtgtgtggatagagggtaccgcttggtcggatagacggacaaaaaaatattgtgactattggaaagttactattttttataagtagttaagatatggataaatgtgaatttgtccatatttatatctaaattttttgacacagggagtaaccaacagcctttttcccacgaatagaaaaaaaaagaacataacgaacactgactacaaatcaccgagcgacacgtggctggacatacgaggtgctagattaaatttgatcaattaaattgacgtatccaatattttatctattagatctattttttaaaaataaaatcttaagttatcatgtctcacgtcctataaaaaacggataaatgaccttggaaattcttagaaaaaatgaaacaccctgtcatcggctctcacttaaatcatttagaaaaattagaaaaataaaatctccacctcctcctcactctcacatctacacaaccctgtcaccccctccctattgttttatttattaaattaaaagagaaacaaaaaatatgtttgatattattttagaaacaaagtacaaacacgagcgcttacaacgtgcgcgcactcacctatgtgaacacacacatgcacatacccccatgagtacttctgatagactaggatgacatattttgagatggacgaagtcactacgtacgtctcgctttcgacgggtacgtcacctactactgaaagaatttgtaattctaggacatgaacacgagtgggaaaattccatcacaaccaacgtttacttcgtagtaatgttggatattaaaacaaccataatttttaaactacatttctggaatactcctatgccctttaaaccggtggaatcattatttctaacagttagagctatcttatataagaaaaacaaatgtgtatacatggtacatcacatttaaaatattattgtgcaattatatttcgctttcacattagcttgcgtggtacttctgacccactctacattaaattatcatagatggatcggctctcaaatcacatcaatcatattaggctatataaacccatatatttagtggagcttcatgtcccacccaattaatcctcgaagaaaccatgataatatatatgcaattaaaaaaagaaaaataccttagttttactttgcacttactcttcgttgacatgttttctagggaaaataagtctaccttcttttcaaatgatgaagaagattataaataattgtttattgatattacttaaatatgatataatataaagctaataggttagaaaattataaaagaaattaatgttgatgaaaagaatttacggagaaatcgtggtagatgttcaccggttaatattttcatcttataagcgtctcaatcttagcatacgacccatgcccgcgctaagcgcgggctatcttcctagtttgataaaaaaggccttacatattttacaggaacatcgatccatccatgaggctagctaccaaagctgttgctaaagagatttaggacagatacatatgtgtagtatgggactgggaggcattgtggaaatttcgcatgcctatcaagtgtggttttgcacgaaagatggtggtgtgtcaccgtgcccaggcattcgtcgcactgacagcccacatcatcctgccactcagcagcatttgcaggctatccaatatttgacagcactatgcaatatatgaaatgcatgtcgctagcctcgatggtagtgtttgcattagtaatatgagtgtagagagaaaaatcaagttgaattgattatccctatcatttttctcaattgttcttttcaagaagacacaattagtaagtgaactgtatgtgttcagcaatactaacgcggtaggctcagttcaacagactacgtacatatgcttctcatatatcacaatgaacaagctaatttttcaaatcaagatcacaatgaaaaagatttaaaaagtctaaagggaaaaaaaactatattgtacatatataatctgatataacccatctctaacggataaagatcatgcaacacaacatatgctaattgaaccttccttggactgggatgcgtcaggattatgcatatgtcttatgttttcgcatcatttcagagataactgacaattgtgtttcccacgataagggtgttgcttgtctggttcatcaatgtaacattggtcaaggaagtttgtttctacttcagatttgaatcaaggtcgcgtgcaattcatgccagcaaattcagatattcaaaacggagcctacatatacgtgatcaaaataacaatgtaattgaaatagatatgattgagatcacaccatacgtaaaaacatgaaaatcaagggatgatttgtgatatatatgtgtttcagatgagctgtctaacaatagcaagtacactatagctgtccaacatgaagctcaagctaccaagaacaggattttaaatttttcagagctgaagtgaccaagcttgagaattttggtccaaagttattttaaaccctgcaagaacaatgtcaacgagatatcgtgaagcataaaagttggctagtcatgtcagttacaatgcaatgatcaactttcatatacaattaacgtttcaaagtacttaatcaaggttcttagtagcaagcttaatagtgatacaggacaaaccatctgcggatctgccagattgcagactgcatccttttattctgtcatatatagatatcaattaacccacttgtgtgagtcatcgcaatttgattgattgaaaattacaatcactctgcaaagtagattgatgtctaacacagaatatataagtcattaattgccacaaattgcactgagagtttgtaacttaattgcaagggttgatataatctttgcattagtttttatatcttcatgtgatatacagcagttcttcaacttgcacatgttcactgaatccgctatcgagatcaactatctgaactgaagaccctatatatcatcaccatatatatcaacgagttttgtaggttcaattcacttcacatatgaaatatgtaactaaatggttaggctagataatgtacaagcacctcatgtatgcatgctgcctattcttgctggcttttggcgactctatgagtctcaaagaaaacaggagccatatacgcttgggaggaatctgggaaaagtcgatgtcactggtaggagtgatcaggaatacgaacggatgatcagttgaatttggtatttctctcgtttcttataggcatgatcttacaaccactaaattgtttcttgtgtgtttgctgggaggctagcttaaacagtagatgcatttgaacttctgaagcttgccatgcccaatttgttgacaagtagcttaatatatatgcagaattggatcgcaaggcctctaccgtaatctatttgctctatacaaccttcttaaggtggccactctcttacatgtgtccattctctgaaatctatggtatattggtacaataatggctagtgctagcttatgaaaaagaggttttatcagaactaaaaaccagttaacattgataatacttgcagaaaatatctccaagtttttttttctaatttccaaatagtctagctttgtctagcatgaggctttggaactctctcctagggtgtgttacactacaaaggttggtacagctgcattttaaagagaggtcgcattcagtaaagatcagaatatcgaagagcatgacacggcgggagcatgtacagtattgttggaaatatggtgtatattttaatccaaaatgttaagacaataattatggcatgaacaatgtggggtgatctagtgacaacatttagcataaccagaagcatgcttacagtaccataagcatcatgaacataccaagaacgcaatgcgaccaacagaacaaacagaggtatgaacgacagtaggagagagacataccccgagaatggccctccgctggattgtaaggcagaactgcctctgtcgatgttgaagttcgcaaaagctctggctcccagagctccatctccagagacggcggcagcggcggctccggctccaggtgcagacatggtggacgacgagacaacgacgaacagagcagtcgtgtagagcagtcgtgcgggaagcactccccaataacttggtcacccgcctacccggtgcagatctcaggcgaaggtgtggttccggaggccctgctccttccgatctctcgtgcgcacaagcgattgcgatcagaaacgaggaagcgaaatagaggcagcacagggactagcggcctccttatataggaggagagatatctgccagtttagcggcctccttatataggaggagagatatccgcgaatcgttctgatcggactagcggcctccttatataggagggcggaggactagccgcctccttatatagtaggagagatatctgccagtttagcggcctccttatataggaggagagatatctgcgaatcgttccgatcggactagcggcctccttatatagcaggagagatatctgccagtttagcggcctccttatataggaggagagatatctgcgaatcgttctgatcggactagcggcttccttatataggaggagagatatccgccagttgccgcacgcgcgtcgtgggatcgtgcatgcgccgttacggaggcaatcgtggtagcaaaaggacagagactgacgtgacgcacgccccgccccggcccggccaggcacacgcgcgtggctttccgattcccacctcaaccggtcaacagagagcctccaataactccctatttaagttgaggtactcctcgcttaattcctgaggtgatattgttatccttaacacttattatgggcatttgagatttaatagaataaattgggcctagcccaatctatctatctattatatactaaaagtccattaaacttccttcaaacgctctcaagccgccacatggcctcctacaaacactcctatgtcgccacgtggcattttataatctcaccgtcgattttcttttaaattggtggagccgttaattttaagcgttagatctcccttagagaaaaatcatccccactatttttgagaaaaattaccgtatttgctttaactaatagatagaaaaaaaaaggagaataccataataggacaagaggccagccagtgaggatcgggcagggtacatacgttcttttattttctggtgtcatacgttctatttttttttcctggtggcatacatacgttactacgttagttttttttagcctttttttttagcaaacaatattttttgctttacacattcggcaaacagtactattactacgcatacgatacgtacacgtacgggagtttagggggaagtgttaatagatataaaatcacatgttaccgatttaagtgaaaaccgatggtttgatttttttttctcataatttttaatatttattttaatttagagatatgacatgtagtgacctatgagcatttatacgagcgccacgtggcggcttaaaagcgttcatggaaagttcaatggatttatatatactaaaagccaattaaactttctatagacgctctcaggttgccacatggcctcatataaacactcctacatcgtcacgtggcattctataataacaccgtcaattttcttttaaattggtggacccgttcattttaaccattagatctccatctcaaaggaaataaatctggtatccccacaactaacaccttacatacatgaggtaaaaaaaagcagtacgtactctttccaccctccgaatctcccctcctctcctattttctagctaacttatcctattttataattaacactcaatatataaaaaaataattcaaacatctaaataaccctcaagttacaattttattctcattttttgttaattgttctgttatttataattaaatataaaattcaaaatccatattgctcatattttgttatctaaatattagatcatgcaaccattctaactacaaatgtctaggcctaatggtacgcccataaacacttctaagtcatttgccacatgacactctattaaattaaaaaaaaatctataagtgtgacaaatgaaaacaaaacatctaaccattagtttccacttgaatcaatggatccactatcttatatggttagatctatctttaaaaggaaatcccaaaagtcccaaccgtttgtcccgttcctctctccctaccattcattatctgttctttttatctccatggcaactaaatccaaaattatctttacgagaaaaaaaacacccacaaatggactccgcctaacaagtctagccagcttttcctttgtcatgtgcttctcttctctttctcctcaagctagtacttataaaaacaacctaaattagactttaaaataatcgtaaatttttaaatcttatattcaatttatgacatttctaaactattgtaagtttcaattaaatcaataatttaatacattgtggacccgtctatccaacttgaagcctccaataaataaaataaaatactaaaatttctaattaaaaattaaaatatcccaccttaagtttttaatagcagtcaacccattatttataccatgctaaatagctaattgccttcctcccaactccttctgtttcagattataagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatagaagtagttaatttctcttaacatttaaataggggctatttacttatacttagatgcgcttttatgaataaatgatctttttagagataaatagacgttcctaagatcatcataacatctaaattatacatattatatctgatgtcactaatagattagagtaaaagcttttaattatatcttttttcttgtcataacatgtaccctgtctaggatctatttgtcatagacaatagattgaaaacaatcaatggatacttttatcccatgccaagttgtatggccttaacccacttatatttccataccaaattgcagagatcaaaacatttaagggatgcttgatggaatggaaatctagaaaaaaaatagaaaaataacatgataaaaataattgaagactgaacttttttttcttctaaatttaactttttttgaatttgaaacccattctaaatagcaatgttcaaatattttaggagtactgatacaatgaaaataactaaaattttaaataaaatataatagaaaattggactttttggcattatgttggaaacaaaatctaacataatttcagttcgaagtatacaaccctaaactacaacttgggagcaataaaagtctcatttttaatatattttctgatttagaaaaacttttactgctaaaccatagttttatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaaaagatatgctaaatattaaaaaaataaatgcattatgtacaaatgcattatgtagaagtgatatatagtttcatatatatatatttcttataaaaccaaatttgcacagttttaagtaattttagtttagaatttatacaccagcgatggttactagcattcagagaaacaccacacaaattattgaaaaattaaacatgtttacaatagagtaatcataaaaattcctaataaaatttctaacacagttaaataagatgcccgcgcatatgcgcgggctaccttcctagttattctaacaagtatatgtattatatataaccactgatgctagtttttctcagtagcatgcatatttatatttcgttggaaactctcatatagtcaactgtaagcaatcaagactgtcaaaaacctgcatacagcaaaattgcagcttcagtcatttgctcatatctaccataattggatgtcagcaggattgagatgcatcggcaaattagccctcgcgtcatcggtagaaagtgctacattggagcacttgtggatagcaccattgaaccaggcaatctatattctcttctctttatgcagttcatggaaactgctaagacgatgagtccgtgatcaactcctatttaggaataacccgtaccagtgacggttttattcagttaggcaggaatatatctgtgaaccagcagtgatatgatgagccggtttcaattggcttttgtgtgatagcataaactttgtccagaaaatgccgcaactaggttttgtatgcagctagagatttgatcaggtgtatgtttaggtgaattacaccattgtgaatttgggtgaataacaccattgtgaataaactaaatacagatatacttggtgatgtttttaatacaaatcgatcttattgccaatttcatgaacatgaacatgaacattcacactgcttcgttattaaaaaccttttgaaatcgattaatctttaatatagtctatgccaattaatggctagatatcagcacaaatcattcacggtttataattcactactacatagacgatttctctgtacgagcatccctatagtttgcaggcaaacaataactgatcgcgtctaaaaatcgacctgcattttcacatacaactctttaaagacctgcgtgcaaatatcaattttcgctggtgaacctcttaacacacccgtatgcaaaaaatgagtctattttgacatgcggatctcttaagtgaccacaagcaaaaatagatattcgcatgcatgccccacgctttttcccgcaccatttttttaactcccctctttctctccaccacaccttattctctctcttctcttcccactcctcctagctaactcctcctctccctctcccctcttccaatctcttcttcttccctccccccttctcttctccagtgggtgccagcggccagctagcggatctgccatccccgccctcaagagcaatgagtccgtcaaccctgccctcaggagcggcggcagcgggagcgggcagatcagtcgcccaagacctcgagagcggtggcggtgggagcgggtggatccgccaccccgccctcagcaggaatgatggcgcagatccgccgccgctgctttcgggaatgacggcggcgggcgcagcggcccgacgacgacggcaccggcggtgacgactacaacgacgatgaaggtagcgactagggtttcgagcgattttgtttctttgggatttttaatttttttcgctgaaactattttcacgtgcggtcgtcataggtgaaagaaagcgagaaatcctatttttgcatgtggttatgctaccgcatggaaaaaaatgacgattttgcacacacctaagtgcatggaaaaatatgttttggccgtttggaaaaatcgttgtgtaggtttgcaagtcttgaatggtttctcacagacctgttagagtcttagagattagttaattagacttgacacttggttgtccggtggaagtgtggactattttgcctatttactatcagaacatacaaaggattaaacaataatacgatgttgtttcaacagtgtatatttaagatggattagaattttcgcagactataaattggaatccttatgaattttcttggggaaatgggattgattaaccttgatttatatgtgtactagcaagaggagaacaagtacttctcctactatactccctccgtacatagtccgtacaaaatacttctagtatttgaaatttgttcacaaatataatgattttattgtactactttccaacacaactacctatcgtttaatgaatggcaccatattcttttcccttcatccttaatgtctcaatagaatttaaaagttattgtatttgtggacagaggagtacatgtctagctaggatcaaaaatttcgatgtaatcaatcaaaacacacacagtgtttcccattttgccaccgacatactcaaatttcatttgaaatccaagaccatgtggtgtaaggtattagttttgcaaatcatgagagttccaaaactagtttcccaaaactatatggtccttgattcatattcattaaattcaagattttcttagttgtggtcttttatatttgccatgaatctgttgtataaaatggacaggtgaaccctctatcctatatgtcaataaagagtgcgtctccggtgctttttacttagagtagaaatcaatctaaaccgctaattcgtttttatccaagggattagatttatttatactaccaccttattaagagtagtagaaacgtgggagggcaaattcgtccattgaaaaataaacattgatggataaatttgtaaatacgaattggaaactttgggatgagatcgatggtggtggcgctacaggagggggcagaggcggctaccgcggtcgctgctatcggcgacggcggctaatctgcgtgtggacactcatcgccaacatgtccatctaggcgagtgtttgtaattcttcatagacagaggagaatgaccagatgcaaggcccaacgattgtttgtcccgtatttcctctgacttcaattgtacagagaaaattttgaaggttgtaaaatttgtgttgatgtctttgtaatttaatcttcataatccgtaaagagatggatacttgaaaagaatatctacttaaagagaattcgatagatattggatggatggttactggcgaaggtcagttgccgaatcgagttggcaccgccgccggtgtaggtgcgtagagatacagcgagagaaaacgatataagcggcgacactaacaacagattcaactattaacggaaaaataaatatcaaaattacccctaattaactatacaggtagcaaaatactaatatacccttagaaatcaacggctcagatcattctacttgtagtagaatactaccagtagaaagcactggagcgtgactcgtcaataaaatgtccatttttcttccaacacttcttcacaaccgcgaagttctcaaatttgtcctcagtttgaagcaatcatatgcacgactgggatgcgtcaggaatttgcatctttcttttgctttccagtcatctcagggtgcaagcgattttgttctgctcaccagcatttcaacatttgagagaattgcacatccacctaacactacgcaggaaacgctcatctctgacagcaccgaagaactcgtcatggatgacctcacctttgaccggtccatccacagcctgtgagaggtgaagtctccagccgcgggccatcacaagttataatcactctatatcacagggcatggatttttcattttcctgttgatctcaacgaggtcacgcagtgctgtagtggaagctgcgctctagctctttcattcattttcaccaatggaaactcacccttttagattcgaattgaatgtccaatgtaattcgtcctcaagcgattaagagatccaagcagagtataaagcatcatatataatcttaataaccaagcaatccaaacagacagagatcgcactgtaggtaaaaacactaaaaattaagggagcatttgtaatatttgttgcagatttatatactacattaattctttctcacacttgcaagtatgctagctgtccaattcgaaattatcaagaacagagttttaaattttagagtgccaactctctctctctctcagcgcaaaagcatttcaggggcactgaaatttcagtattgaattgtgaactgtgcacgaacactgttaggccttattcggtttagagagggattgaaaagtattagaggggattaagaataattccccaccaaataggtgtggaataaatctcctctaatcccttcctcacaagggttaatcgaacatgacgttaaggctgatttgtggagagcctgaaactaggcatttacatgctcgtcgtttgcattagaaaaaaaagacaataatcagttgcaaacataatgaccgtatcaaagtagttgagtgtattcagggagcatgtgcagagctccaaagcgatgcaaacatatgaaaatacaataatacatttagagatcttcttcaatacttaaaattaattaggaccattgatctgcaataatctaacggacagaaagagaaggtgcctggaaaaaggtattaaaagggtgagtcaggtatggaaggtgggagggtaaaatggtaattgtttttcattaaattttttcggtaaagggcaaaagcgtatttttacaaattcagaacttttgagagaagcaacaaacgtttcagcatgaggaagaaaaaaaatgagaggaagaattagaacgctcgcgtgcgagaggaacctacataacctgctggtcgtcgctgccgtaaaaggctgccgcttgccgaggccgcacacgcccgccgctcgctgctgccgtacgcgcctacgaaagcagcagctggacaccgtcgccgccgacgcacgcgcccgtagcgcccgccggtcacagctgacgtacgcagcagaacatcgctgtcaccgccgctgcacgagcccgtcgcgccagccagtcgccgccgtcgcacgcgctggcttggttgattagggttaatcttgaatcaacggtgcgatggcttggttgattgggtgacgggtgggatttgagcaattactaagctacccttgttaataaaaaattgtgttcctaaattaccctttgaagattaatggtggataacaattcgttaaggaggtacctggggtaccttccaagcaccgtaaaagatctcatatatttaccatcacaaagtcaggtagaccctagcatagcatatgagcctcagtaaggtgctagtatttactagtagtaaaaattaatctgaaccgttgatctcatctcatatctattaatactattaccccaagtaagcggtagtagaaatatgaaggggcattattatagaaaaaggtgtgaaggggcataatcattatatagcagtaactaaacatttttttctccttttttttttgctttttcaatgaaatatgagcgatgccagctcaatggatattataggtcgatttagccaaggaaaaagaacataaatgatagttactcctaatcatggtattaatagattactaatttagccctaaaaataatggtagtataattaaactgttagagaacactggagcatcgtatcagtgagcaggttcactcctcttttctcataagaaacaaccaaaaggttaagactaggacactatacaagctcctcatctacgcaatctgccttttaaagcaaaggagtgtcaaataggattgggaggaatctaggaattcaatatctctccttctcaaatccacagtagctaattgcctatttggttacctgcgcactcgtcagcaacgaagctgggatccccatggcatgtgctgatcacattgccttacactgggaggcaagaaatgaaagagaggatagataataggatcatcgaagcatcataaaatagacgtggcattacttttgaacctcatctcttgaaagaaaagtaatcgaacactggaaagagtcatgtggtgagttatacatctcttgttgatgacttttcagttgaaatcatttagtattcgaaaatattgtttgaagttgtcatattttcaaattcaaattcaaactattcaaacaaagacatatagaaaaattaccaaaataaaagttatagatcttgataagttatacaactttgtttttgataatttttccatttgaaatcatttactacccgaaaaaattatttgaatttcttatattttaaaatttaaattttatatagtccgattaaactcggatggagaaatgaccaaaataaaattggtagatctcaatgagttctacatttttttatatgagtttatttagtaccataaaattcaattcgaagtttaatttttttcaagaagtctgatttgcctcctctttgggttgggctggcttatgggtcttatgtataagtcggatatccgatggaaaataccagataatatccgacggatatcacctagaccatatcgtttttatatccaaaaaaaaatatttgaattcgtttccgaattcgaaaattttcggatatatccgaccaaaactatccgaatccgaaaaatggtccggtcggatggaaattatccgaatcactttccaaccctactgctgagcgttccctgaattcccaaatttctgatcgatcgtgagcctgttgataggttatctacagttcgtttgcatctcttataaacaacttatttctgctgcttcttgctgttaattctacgatcattgagtttttggtagttttttcttaggatcgaatagcaagaactaagccaaccggggagggggggaatagttgtagtacctaaaacgtgaaacttttagcggaattaaaagttaccctcgaattcgatgtagatcggtgtgaccagagttgatccacctgtctgatcgacgttgatttccaggtcaaaccaccctgcgatcgtctctgcctcctgtcgccgctgccggtctgaccaccttgtccccaccggtttgaccgatgcgatgccatcggtctgaccaccaaacccgaacaaacacaaatagaagatcactcaatgtagattggaactttaatatttctctctgtgtttacaaagtgcaacaacagcatgaaattctcgactaaactcgaaaccctaacttttctctcaactcaactctctcaaaaacattaccgggaggacacaccctccctctctatatatacccgagataggcagcctaaagctacgaaccaaccttgtacaaaaatcctaatcccctaggaaaccttcccgtacaaaaaacaaactttacaaacttcaattgtactaaatttggactccttccaaattcgactccacatcccatacgtacacaatatctccatcgtatgccatttggaatcttcaccaagttatgacaccgcatgatatcctgatcgtcattgatctttagcctaagcataccgcatgatatcttgatcgttcagacatcatcttctcccatgttgactcccgatccatcaccggcaacactctcccgagacatcaagaccacctacacatgcatcaactaagaaaccatatccgagcacaagttctcaacaacttgacttattcttagcaaacaacaatattatatacgcatagtatccatctagaagtcataaacatgaataatccacagatatattgagaaacaacccaaaaccaaaaccaacacagagtcggacggtcaaatcgcaagctggccagtctgaccgcttgatacacgctggtctaaccggcaaccactgcccgatctgaccggttctacttagttagcaatccctgttcatcacctgcaaatcaattatctccaaaaccacttcgacaataatctccaaatatcaaaactaataatctcagatgccaattattcatcacagaataagaatcaaaccaactttattttacacttttacttggaagttcttgtgttactgctgctgctgattcaattcgatttactcagtttagaaatcaattacgtcataagtgctacccacctatataaatatagctcttggatttgttttagatatgtacagatttccctagaaaatcaagagtaaaaggattcattttcccaaatctattcagtttcttgattcgtatgaattaaaacagagatttctttgctttggtcttcaatatgtgccatgaatctgctctatatattggcccggtgaaccctctatcggagtaacatgtccattgttttaccaatacttcacaaccgcaaagaactcgaattcctcaatgtgaggtgatcatgcatggactgggatgcgtcgggattatgcatctgacttacttttgtaaatagtttcagggatgcaagtgttggaatgctgcacatgagcattccacatcttgcaacagctgctcgctttgatcatcgctcggtgattggccagagcaagatcgttcttcttccaactaatctcaaccagattgcaatttcttccatggaaggtgggctgtttgacaccttcccagctaattctgagatttagaaggtgccaaaaccatcatatatgtgatcttaataagaaagtaatttaaacagatagagatcacaacgtcaaaaacacgaaattcaagggagaactggtggtatctgttgctggtttatctgctccttttgttgtaacacttccaagttggctagttgtccaacatgaagctatcaagagcaggattttaaatttcagagcgccaaagtatttcagtccaaaattattgtgggccctgcaagaacacaatcaaggatgattaatgaagaacaaaacttggccagtctatgtaactacattgcaacataatgatcaattttcttatgtagttaacattcaaaagtatgtacttgatcaaggctcttattatcaagcttgtaaataacggtgacatagagccaaccatctgccagatttataggcttgatgctttagttctgtgttagatgtcaatctacttgctgactggtggcaggtttgaatcaatacaatgcgttgtcactgtgacttgtaaggactgatcgataaatctttgcatgttttatatccatgttaagattagttgtaaatttgttcttgcacttatcatgtgatgttgatctttagcagctatctggaacttgcacatgctcactgaaggagatcaactactaccgataggatatacatatcaactatataaactgaagacaattcagtacttctcatatatacgaaatatgtaaacaaaatggtaagctcctcatgcatgcactgcctatatattcttactggtaatcagataggcttgggaggaatctaggaaatcaatgcctctggaaacattaagagatgctgagtgatgatctgctgcgtattgtttggctcgttctgcagtgacagcttacaacaaccattgaactggttcttgcacacttgcagggctagcaggagcttaatatctgtttgcagaaaacagcctcctgaatggggtccgtcctcttacatgtgcctagactctagtggagtacttctgaaagagagtggtcaaaacatatttatcggaagcttaaaaaccagtgtaagatttctaacactttgaaacacagacctattggttgatcttggtgctacgagaattaattgtgcgaggatgaagtccaccgtgcacccgcccaatacattcacatgagtttccaaattaaccatgcactttcctaacaataattccatgccatgatcagcggcgtttccacatattttggaccggccacgtgtcccaccaatgtcctataaaagaatagaaggcccatgtgaggtagtgaacaatattgacttctcgcacactagaatacgttgggaagggacccgatggaccgcttccaaacctacaggataaggccatttccaaccaatgacactagacactagtacacactattctttccatgcaaacaccactattccataattcaatttaatgctacttatctcacatgatgtcttggatgttgtgtagaaatcatgtctcatgcaagacatggtttccttctccttttctcatttattcacttgtcacatcatttttcatcctacgtggcagcttaactaatgctatggacaccatcctagtcattgggttggtaatgccctaattaaatccttcaagggagatgatgaggaattaacctaggaagttaatgtgtctggggccagctctgtcacatatcgtctgtctaatttagcaacggcaacttaattataagcactgaattagcttttatacgattgcaaagctagctgaccgtgtacgctatttaaagttcatatacaaactcgtgatattgtctggcgccaccgcacaaagctctatgccatcgtgcgattgagatggcgcggctcatcgggggcaacggcgattgcgtagggacagttgagatcgagatcatgagtcgcggatgttcggcccgccgccatcgctcgcttgcgacaggaggggaaaagagacatttcgcgtaaaccttaattttctcaaacatgtcataaacgtcaaataaagaggaatggagggagtacaaacctaatatagccatgtcgcactagttgattgagattcttattatcatgctagtaaatatatgggtggtatatagggccaaccatttgttagactccagactttgttccctgtcaaacatcaatctattttctggtggtgaattatcacagtttgggatgtgtttgctgccactgccacttattatagctgacttaattttgtaagcgtaactatcactactacacaaaacccttttggtgccggttgcaaaccccacataggtgccggatttggcaagcggcacccagtttccagcacctatgagtattgttaatggtgtcggttcaagaaccgacacctttgaggtgtatggatcacaaaaaaaaaaggatggcttggctcgactcaattcgagcggatgcctcaaagccaaaagaaatcgaaaaatataaaataaaatgaggcaagttatcagataatcacaaattcattcacagaaacattcatagatacattcacatcaaacatttacaaatacattcacagatgcattcacaaatacattcacaagaggagatcagtgaatacattcataggaggagatcagcgacggcgagatcaacgagaaaggagagggcgagggagaggggagaggagtattgacctttgggctggcccacccgccgagaggcaccctggctgccgacctggctgggcaaatgctgccgagcgccataccaagcaccccgaacccggcccagggcggccgaagtgggggcgcacacggcagtgacaggcgggctatcatagtatttgctaagttgacgggctggagataagcggactcgaaccgctaacacggccacaaggtaaaaccaccgcctcttaggcctacccaacgggggccctagggcggacgaacccgctagccagcagcggtagctatgcgcccactgtgaacgccagcgccgacgccgacaccgccttgaatgagctcgaaagccggcggttctcctcgttgaccaccttttgatgcggacatcactacctcggatacacacaacaatcctccaacggtcattcaaggaccgataacaagagctcgtgcgcgacaattaaatttagaggtgagttcgttcctatgttcttctttgtatgaattcgagaatagattgctacctaatgattatattatgattaggaacaatggaggggacaaggagacacttggagaaggacttagagccatggaggatcatcgaggacgtccaagtcaaggtggaggcccaaaccaagtcgacgtcgggtgtaattcggagtccaggaccagtctgcactaaaacgggcacccaggtcgcatacgtgctcggattggggcgttctttatatggatggaaagctaagaagataacttttccaatggttttggtcccacgtccaaattctttctaagtcaatggaaattgaccgaacaagttgacgtctagaatctgtcctggtgctgcatcaccgtatttgggcctttggcccgtgtatcgtgttggaacccattagggttacgtcgagaggggtttgcacgaccctaaactctatatatcagtacccgccgccatctttaggtttttgggttttgcttagattaatctgtcgagaacagtttcgccactagatcgttttgtaagaccccaactcgtgagcttaatcattcatccgcaattttggttgttttctatctcgttcttgtttgtgttcttcgactgtcaaatagggattagccttctcggtgaggttatccgcgttttgacatgggtgataaccagaggagacgtggtgctgcgattgcggggctcaagagcgtgcgcgttcaagaagctggatcgatttgtgtcgcgactccgcctaaatcgttgtttatcagaacctttcgaaagattaggaaccctagtacacatcaccttctccgcgggctcgccgtcgccgcgttggcattgcctcctcctacgccgggccctgccgcctcccctcctgcccgaatctagaagaggggagggtgtcaccgccgcctcctcccaacaggatcaatggagagcgagagagagagagaagagcgacagagagaaaagagatcgatggagtcgatggatctggattgatccgagggccttatctcctcgttcctcgtgatggagcctgccagctcagctcatgcctgctcggtaaattctcaggtacctataatataacacataacataggtgctagtttttaattaatagccacctataatatattataggtgttcgttcttttttaaaaaccggtaccattagtattggtaccggttttctttagaaccaatacttatatttgtttaaaggtgttggttttctattttttatcccatgggaggtggaaaaaggtcaataggtgcacctatatgtggagattatggataccccatacccacacggcatgtttattcgaccgggtataggggtaccatatacagatagaatatatttagtacaggactcaattgggttgttatgttaacttgtgtaccacggaaacacctgatggtcctagtcggatacgactgtaatttatctttacttgtctattccgttaggaacatggattgtatcttgtaatacgggcttctccccatatggagaggttcggtgtctcttggggcataatttttctcccggatcatacgatgaataatacactcagcgaattattccccggacaggagtagggtattacttcttatcgagaaggtctgaacctgtataaaacttttgtctcctaacccatccacttttcctgcttgatagccacccctttagtattgccgaaatattgcttcgacactataagccggtccctacgaggtttttgtagtagtgtagagcgccttttcattctacatctatgtatatacctaggtacttacatatttgtccttgtgactataatgtgatattgatgcgcagcaggtccggagcttaatttgcacatgatcactaaataaactcaactacgaaaagacaggtcccaactatagcatagccatatactcgcttcttattaaaatataaatatttctagaattcaaaatttgtcaatttatggagaaccgatagtaatgcgaaattcgtacattttaagcaaagtgggtgcgtgggaggggaatttaagcaattcaaaattcaaaatttgatgactgagatgaccgaaagggaatctttttcattaagcttaaactttgcaaaacaacctgaaaattattatattgtgagacagatagagtatatcatatcagtgacttataggtttattcctccatttcttataaaaaatattatagtgtgcgacagagatactatatcatatcagtactgactgatagatccattcctccttttcttataagaaagaaccaaaagggaaagtaagactagaacaatgtacgggctctccgtctatgaaagctgtatagtcttgttgctacttggccactatatatgactccagaaaagagagagtcaaataggattggaaggtatctaggaattcgatttctctccaactcaagttcgaagtagccaagggcctatttcattacgtgctcctctgcaagcctgtgctcacattgtatcttccttgagattgcaagaaattgggagagaggatagatgataggatcatcaaagcagcaccaaatagaggatgatgcggaacagatggcacacaagtttgaattgtgctttttaggttgatgctacaacaattactgaattgcaaatgatcactacataaactcaactacgaacagacaggtcccaactatagcatagccatatactcgcttcttaataaaatataaatatttctaggattcaaaatttatcgagttatgagaattgatactaatgcaaaattcatacattttaagcaaagtgggtgcgtgggaggggaatttaagcaattcaaaattcaaaatttgatgactgagatgaccgaaagggaatctttttcattaagcttaagctttgcaaaacagcctaaaaattattatattgtgggacagagtgagtatttcatatcagtgacttataggtatattcctccgtttcttgtaaaaattattatagtgtgcgacggagagactatcatatcagtgactgatagatccattcctccttttctcataagaaagaaccaaaagggtaagtaagactagaacaatgtacgagctctttgtctatgcaagctgtataatcttgttgctacttggccactatatatgactcaagaaaagagagagtcaaataggattggaaggtatctaggaattcagtttctctccaactcaagttcgaagtagccaagggcctatttcgttacgtgctcctctgcaagcctgtgctcacattctatcctccttgagattgcaagaaattgggagagaggatagatgataggatcatcgaagcacagcaccaaatagaggaggatgcgggacagatggcacacaagtttgaattgtgctttttaggttgattctacaacaattactgagtgcctagcaaagccgataactagcctcaaagagtccaagataactagatgcaagcaaccaaaatagtagtgcaacctaaaccgtcatctccattacggcaacctgtactgagggttagcccaaccacactctaagttaccaaccaacacaacctacaatcaaacaagagaaatctcgaaggaagtagaagcgccaattgcaattggggagcgtcgaacactacttctgtaatcccacaaggaaatcacaagagaaaaggggtagggatctctctaaatttgttagcacacaactaaacaaaggggttcatattcttattgtcaaaagtctttcaaatggtaaaacaaagggaatatttatattaggaataaccctcctagttgggaatgaaaattcttgagagtttattggacatagactagctcaaaggtcttaataagtgaattcccaagaatactcacgcagtcttcaatgatttgtccattactccttattgaaaaatcaaaatgatgggccgtttgttggagttgaaactagacttgattatctttccatccatatataatatgcaaggaagaagttgactagatgggtctcacataatttgaaaattggagcaaatgttaggagacgtggactccgaattcgaaatcagcatggcgtaaatggtcgtcgtattcacataacccatcatcaatttgatcttctagctcatcatcaatgccctgcaagtcttgtgcacgtgtgaatctaagtaaaagcaaagtagatgatttaggtagtacataattctcgttaatattaaagttaaattcagcgagaaaagagtcaaccttttgtcgtacttttattgaatgatgttgcgcactccatccttgcttggcacaatcccttggagatggagtcacaacatggcttagcatagtcggtcctcgagattgtggcactagtccaaatgatggtttacgttcatatgatagcaaggttagtgcacagttacttcgcctttgtatagtggtggtattggttgagtaaataatccaagtcaaatatctctctttaggcgcatcgatatgttttaacctacaattataaaagacaactagtaaccttgtcttttgaaaataacaatattcagagttaagcatagctttaaccttgcatggatgtgtcacaatcagattatgtgtcaactgcattggccgatccacattaatcaagatgtgtttaccaagtgcatccaatgcaatcctctctcaactcacgaattagaattgaagcaaaaacaaaccatattttttcacaacaaaacgtcgatatacttcaagcctcaatccattttctttttgtacccaaaactaggggtgggcattcggtcagactgaaaaattcggtctcggtcttcggtttttcggttagttcggtctttagaaactcaagaccggatttcattcaaaaaatcttaggaccaacaaattcggtctcgtttttttggtctcggtctcggtctgaccgattttttttcacagccgctagagagtggagacggaggcaatggcgacgacgctggaggaggaaggcagaggcgttggagcttggagggcgctagagccggaggcggaggcggcggagggcaaaggtggaggcggcgccgacgctggaggcggcatcgctgtcggtgtcaatagcacggggaggaggggatggggatgggaagggctcggtggatgggaggatggtgctggtggttggttggataaggttgtgggtggataaggttggttttgctaaggaggtattgggcctaatgggccaattctatatttcggttttttcggtcaattcggttaaccgaggcctaaaaccgaatcgcccgacctaaattcggttaagtagaaagtgctgaccgaatttgtgaccgaatttttcggtctcagtaagttcggtttcggtctcggtcattttggtttggtctttttctgcccacccctacccaaaacatggctacccctagccccaaatccaactagaactaggacttctaatcatatagggaacctaccaaagcagggaaacaacatcgacatacaactctaaactccaatcttcttgattcaaatttgattattttttccatacacacacaacaccacatgtataccataaggaaacctttccatgcatccatgtgaattgttctctagcctgggtatcccatgtgatctgcttgactgtctacatctcaacttcttccaaatctagttccgatccatcactagtaatactcccatggcctcaagcaacacttccacatgaacaacaaaaaaatattctatatctgagtacaagttcgcaccaacttaactcacatcagcacacaacaatgtcacatacatataaaaaccatctagaagtcatatagataaagtaatctagaaaatccacgaaaacaacttgacactgactcaaaccctaagtcaacccagtctgatcgggtggaccgcatggtcagactggctacatacctctgatctgaccagcaccctcctgaccggtctaaccggtgatccagtgccaaccacactattcaccatataaaaacattattcaccgtattttcacaaacactcacctttggcaatagttcatcatataaaatagagtaaatttcataaaactgtatatactttgcatgatctattacaaaactacatatttaagaacttgtttcacaaaactacagattcagtgtctccgtttatcacaaaactacatatactttgcacaatatttcacaaaactatagatttagtatcttcatttatcacaaactacaagtgtaatgtcttcattatcacaaaactacatattttagcatgtagttttgtgataatggtgacactaaatcgtgataaatgaagacactaaatgtgtagttctgtgataaacgaatacactaaatctatagttttgtgaaacaagttcttaaatctgtagttttgtgatagattatacaaagtacctgtagttttgtgataaaaatctgtatttttatgaaacaagcctgtagttttatgataaattgtgcaaaatacttgtagttactctataaaataaatcatcacatgattctctatgccagtaacaggttcattgttttacccatacgtcacagccacaaagaagttgaattactcaatgtgaggtgtgtaggatcgaatcacaagaactaagccaaccagaggggggtgaatggttggtatacccaaaaaccgaaaactattagcggaaagaaaagttaccctcgaattcgacggatcgcggtctgaccgaagttgtcctactggtctgaccgcctggttgccgtcggtctgaccgagattatatctctggtccgaccgccgagatcagctactgctcgctgtcgccgccgccggtctgaccgccatgctcccgctggtctgaccgccgcttaccgccggtctgaccgccggtagatcgccggttagaccgccgaaacctggtaacacaaatcgaaaaactcttaaagtagatgacgactttattgattctctttgtgtttacaaagtgcaccaacagcactccttacaaaaattttgactaaactcgaaaccctaactcaaaactcaactcaattgttctcaaaagcgatcccgggaagcctgacgcttcccctctatttatacatgaggtaggcagcctaaagccacgaaccaaactcatactaagagtcctaaacaccttaggaaaccctctagtacaagaatgaaactctacataaccaatcataccaaatttggactccttccaaattcgactccgcatcccatacacacacaatacctccatcgtatgccatatggaatctccatcaaccacgtgcattaactctagcctaagtatcccgcatgatctctgaccaccacggacgtcgccgtatccccaagccgattcccggtctatcaccgcaaatactctcccgagacatcgagtcacctacacatggaacaaacaaagaaaccatattccgagaccaagctatctccaacttgactcattagcagtaaacaatagtattacatacgtatagtatccatctagaagtcataatcatgaaataaactcggatatccaaataaactacccgaaaccgaaaccgacatagtgttggtcggtcagaccgcgggctagccggtctgaccgttcgcatatcgccggtctgactggctaccagagcccggtctgaccggtcacataaaataatgaacctgtgattcacctgtaaatccaatcatctccaaaaccacttcatgaataaattccaaataacaaaaccaataatctccaatgccaattgttcatcacagaataataataaaaaacacctttgattttacaaggtgatcatgcgtatggattgggatgcgtcgggattatgcatctgacttattattgcgcatcatttcggagattcgagctttggtgtgccgctcattagcattcaccgtctttgcaacggctgttcacttcgatcatctctctacggctggccagagcgacctcgtatgcttcttcctactaatctcaaccatattgcgactgaatttcatcaacgaccagttcaattcaacccagctaattctgagattgaaaaggagcctaaaccatcatatatatatatatatatatatatatatatatatatatatatatatatatatatatatatatatatgagagtaaatatatacatgtgatcctaataagaaagtaatttaaacatatagagatcacactgtcaaaacacaaatttcaatggatcaagaactggtgatatatctgtttctggtttatctgcccctttgttctaacatttccatgtaggctagctgtctaacatgaagctaccaagagcagcatttcaaatttcagagagccagagtatttgagggggaaccagaattttcgataaattcggaccaaaattattgtggatccgagcaattttaccatccatcatttggtacctcgaggtaccatattttatacacaaattttagttcctcaagatacgaagtaactcaagctaccaaattttacactagaaaatacctcgtggtacaaaaaatttgtgtaactttgaggtaccgagggcctgtttagttcccaaaaaacttttcccaaaaacatcacatcgaatctttagacacaaatatggagcattaaatataaataaaaataaaaactaattgtatagtttatatgtaaatcgcgagatgaatattttgagcctaattaggccatgattaaccataagtgctgtagtaacctgaatgtgctaatgacagattaacactactagagaaaccatctttggtcggttgccaaaaacaacaatagtcccgattgcttaaaaaactgggactaaaaagcatttttagtcccggtttaaaagtgcaatgatatttagtcccggttagtgttaccaactgggactaaagatcatcttttgtcccggtttattcattggcacgacgtggtaggtctcctaatatttttaatcccggttggtataaacaaccgg

SEQ ID NO: 81281 - DNA, 865 bp, Oryza sativa
catatatatacacacatatatatacacacatatatatatacacatatatatatacacatatatatacacatatatacatatacatacatacatacatacatacattatacacatatatacatatacatatatacacatatatatatatatacatatatacatacatacatatgtatatacatacatacatacatatgtatatacatacatacatacatacatacatacatacatatatatatacatacatacatatacatatatatacatacatatatatacatatacatatatatacatatacatatatatatatatacatatacatatatatatatatatatatatatatatatatatatatatatatatatatatacgtatatatatatacatacatacatatatatatatatatatatatatatatatatatatatatatatatatatatatatatatatatatatatatatatatatacatacatatatatatatatatatacatacatactgtcggtgatatgggaccgggagtatcatgaccagaggcttgaggcagacacaatcgcccacgtggcctggcaccttcggggacgtcgggcccgagggtgaggtgtccgccctccttctgattccccccgagggggggtcgggttgcgcttgccccgaccccgagggccgaggcaccccgaccccttaaggaagtctgccccgcatatatgggataagtgagccaagctgtgctcacctaacagcatttattgcggtctgttcaagcgtgtcacgctgcatgcaacccagtcagcgcgttcctttatccggtctgtgaccagtcacagcccggtcagatcacgggttag

SEQ ID NO: 81282 - DNA, 51795 bp, Oryza sativa
tgtgtgtgaatgacaaatgggtcccacatatatgtttttaattgaaatgccacctcagcgccacgtcagcacacagactaggtcaacaccgcccacgtcagcgccacgtcagcgaaaccgccatccaaaaccaccaagggagtcaaattgcaccggtttcaatagtttgggggtgaagatatccggttttgcggtttagggtcatggattagattcgggtctcttttgagggtcatgaagtgaacttattcctctgtactctgtgtctttgtgcgtttctttttctgttcttttaggctattttctgtgctttatgcgtttgtttgtgtgtgtgtgtgttaaaagaaaattttgtgtgctttgtgttgaaaatttaaaacagtttcagaagaaaagagaagaaatcgctaggacgttgacatttgtcttaagatgaccgaaaaattgttgttgcactccatcccaaataagtgtagttttatagtggccctctgtatatctttatattttacttcaacttttccatccagattgtagctattgaaccaatagtaatctctacttacctccccccccccccaaaacacaatcccaccctcttattttcttcatattagtgaaggacgtaatcctatatatttatatagtccatccacactcagtgtagttaatgctatttctctcttctttcatgaaaccatatcatttcaattattttttattctttggatgatagatctatagtacaaatagtcatttctttcctctctcgtaaaaccacacaatctcaattattttttattcaaaattcataagtatcaattacataaaatatgttcaccttgcattatatttgcaatcatgtgttgattatataaaacatatgaagtcattttattttggtttacaaaatataatatagcttatttgtacatacgatacaacttaatttcccgcaacaacgcggcagggtattcatctagttatcttcgttattacctccgtctcatataaattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagggtgtgtttagttcgcgaaaagaaaatttttgggtgtcacatcgaacatctgaccggatgtcggaaggagttttcagacacgaatgaaaaaactaatttcataaatcgcctggaaaccgcaagacgaatttattaagcctaattaatccatcattagcacatgtgggttattgtagcacttatggctaattatggactaattatgctcaaaagattcgtctcgcgatttccatgcaaactgtgcaattatttttttatatctatatttaatgctccatacatgtgtccaaagattcgatgttatgtttttgggtaaagttttttttggaagctttagtgtactgaccggccgttgtgtgtgttcttgacaaggaaaagtatcaattagcacttgtgttagtgacagagtgacaatgacaagttaacgtcagcatccatggcattgatatagaacagagatttttatttttgttaattttactcttttagtttctgacatgaagcaaattgtccactcgtgccacgtttccacgccatcgttctagtgaaattacatgagcaatgccgttcacgtatagttgtcatcacaaattcacgattaattaggaacactgatgctgatgtgtataacaaaattaaccgcctaaccagccatctgcttaaccaaagaatgattaattaaccaagtagtcgctcccttctagaatgatgacgttttagaatgcaatgtattttgatcccaaaatcttagattaataaataaacaaataaatgtcaaaaaaataaataaatatttactatgtgaaagtgatactaagtagatttttggtaccaaaataatttcattgtcattatttttaatatgttattagaaataacaatgattaaatatgtatatcagagactacttacatgtcctaaacatcataagaacgaaaaatgttaattaattggtagaatcggtgggcgcaaatgcatgctaattgattataccatatatctcccctgcactttactcatccataaaattaatatgacatgtgtgcatgagtgcatcgttgttttttttctttcttctatttttctaaaagcacagtagaaatgcaaactatcacagcgtgcgtatgcttatacttatgaatacacgtatgcacctctaattcaatgagtatcttataaaaactgaaccgtaccgttatatgttaagattcacgagatcaccatagacgcatcgttgtcgagttatgtcatctactattgaaagaataattttggtgactcgtattaaacaacaagtaactttgggatgaacgcattgcgtgcatttatatacagtcattgagtctaccagtttttccttaaaaaaaagggaaatttacgcacatatataattcgatcacgattaaccgtgataaagctagcccctcaagctttactttagatgataaagctagcccctcatgtttagtttaattacctgatgtcggttaacctaaccgtcatcgacatgtcaaccatagaaaaaaaagggagaatttgaatcacatccagaggacagacctgttgacaaaatgaccaatactccctcgattccaaaatataaggcacaaccatccttaacccaaagaccaaaaaataattattatcatcttatagtttagatcatcctaataaatataatgcatgcatccaatagaattagatagcatgagagtggaggatttaaaaaagtaataatttaggccctgtttgattcagcttaggattattataatttagcttattaggagtaagctgaaacaaacaagtagattattatagcatattattataatctaataagctgctctagaggagcttttttcagattattgagtggctaaagacccactacccctacatacttgagaaaaattaaccacctatgccatcaaccgaacagatagctgagggcattatagactttatcctttcaaacccaataatccatgcctccaataatccagacaaacaaacaactcacagcttattataatctagtttatagtaatctggcttaataatctagattataataatcataagctgaaacaaataggaccttaatagataagatgtcatagttaattaattgcatgcttgcatgtatgccttaatattacggaacatctaagaaaaatggtcgtttcttgtattatggtattatggaatggagggagtaatcgcacgtaatgcctgccgactcaccgtaatatgaggctgagaagttgattgcagaccatctagtgcaatcaatggcgctcgctttcggtgattgttccaaattaattacggagtaattagcacaacacggctcgccgcccttgccatcccatttaggcacatggacagagttgaaatgtgttgagagctaggctagctagctgattttttcggttatcaaattgagatattcaatctagtctctgaattgactgatatcaaagtttaaaatctttaactatagataaattttaaaatgtttgtattagaaatattggtctcaaaaggtacttcaaaaatcacatttttattgataacaataatcctatatatatattataataaaaaatagtgatcagagttattttttaggccgtgtctttatttaaaacgataagtattattaacccggaaggagtgtatctgatggtattccaaactgattaagactatcgaattagttaccatggtattggttagaaaaaggaacatgcatcgaaaaactaaaaaccaagataccgctatcactttttggggaaaatgtgtaggagcgtccattttcagattcaactatatttttcaagttttcattacatacatgattttcactacgtattttcttcacttgaggttcatacaacagtgatagtggcaacaataatgctggtcgagaaaaactggtaagcatattccctgagctgagtttgaatcggcttttccagcgatcgttttctgtaacatactttttaaaacactttttatatagatttttctcaaaaaagataaattattttttttaatttataatagttcattttcaattaatcgtatactaattgctcatctgttttgcatgcctggaaaagtgtaaccatactgcccaatcgaatgaagtctttagctttgttgtttattcttttatgctcgacagattaaaaaagctacgcacctacatatcatgtattcatgtgtatacagcagattacgaagacggcatgagttcagttctcttaatttgccggattagctggtcgataaccatgtcattatcttggtccccaaggaactatttgtttactaatgagattgatagttgagccatctcaatttaaaaatatagtacttattagacctttggtaaggagtatattaaggggatgagatatttttcaatataaattatgaacaagaaaaaggtatatatagcaaaaaagtaataaaataataaccagatcatacatctagccattaatatctgctagtaccgtagaagaactcatatgaggagtaatcaatagcatgtaagagctctcatattaacttggaaatttagtcgttgattagatgatcgtgttatcatgattatatgtccgtgagtatatttcacaaaactacatatattttgactaaactatcaaaaaactatatatttaaaaatatatatgtatcataaaactacagatatttagcaccaaatttatcataaaactacaggtttaaaacattgtatcacaaaattacagatcgatttagtgatgaagtcatcaaacaactatagattttagtgtttatacgatggcactatcgaggttacaaaagttgtagttttgtgataaaactgatcgatattaaatatgtagttttctaatatgaaaccttaaatctatagttttgtgatacatatccttaaatctacaggtttgtgatagattgatcaaagtccctatagtttagtgaaatttgcatgtattttccatgtgccacgtttaaaagcatatcttctactccctccgtcccataatataagggattttgagtttttacttgcaacgtttgaccactcgtcttatttaattttttttgaaattattgtttattttatttgtgacttactttattatctatagtactttaagcacaacttttcgttttttatatttgcaaaaaaaatttgaataagacgaactcaaaatcccttatattgtgggacggagggagtatatgttgtgagaactgagactccaaaataaatacattgactaaaactccaaatcaagtacaactcaatatttgttaattacaaatttcacaattatttagtcatgccaaatctctttaaccatttttaaacataaaaaataaaaagcattgcaacgcagaagttagcgagtagtatttataaacacgaataagagtatgaattgctacaatacatatagttacttcgcaattcttgttttagccgttgtactatggtatactaattgtaaatgtaggagctctcatattaactagaatgatttagctgttgcttagataattgtattacatgactgcagatctgtatttttcatgttccacattaaaaactcatctattgtgcatgttgtggtgattgagactccaaaccaggtataacttaatgtttgttgattacaaatttcacaattattaaatcatggaaaatctctgttaatatctttgacatcgctcagttatcatatttaactcccaagtcttaaacaaaccaacatgttattacaagaatgtctaatgtaacatcacattccaaagttaactaatgttaccacaatatggaaagacaattaaggttcaatgaggaagattagctaataactatactgcatcttccatcatccttctaaattctaagtagctgatcctcccatctctgtcctcatcgaaggtgtggatcatcctcatacagtcctcatacctttgcccttctttgaaccctagcctcctcatcacgctccacagttccgaggcacatatgaagccatcctcattgcgatcgaacacataaaaggcatccttaagctcaccctcgctcgccatcttcctatccaacagctcatccacggtagcatccatagggatgtcacacccttggcactccatggcggcctccccactcctttgccacctgaggcctaacctcgttgtgacagtcattgcatcaaagcatgacacccctcctccaagcaactgcgaagaaggaggagggtcgttgtccacgaccatagagttgataacactatcgtcatgcgctaagaaccttgcaattgcgctaaataaccttccaatcttattacttaccgaaatcacatctatgatcaatggtcccagtaccaacatcatgagggatgacaccagtggaattaggatgttgtgatccatcatcatcacccactatatatctttgtgtgaaatgcagcaaattgaacagcaatgaaatccagtgtaccttattgaagtgcttactcaaaggaacatctcaacttacatgcaaatagcctgtatatatagctgacatagatccttcaagatatccataaggtgagtctttgcatcatttcggagaaattcagaggaagatggatatgctattattgcctatctttattttttttctatctgtgtagatattggagatgacttcagacttaataaaaggttatggctgcaagctgtcgatgaaacttcctggaaattactcaaaacagctaggacacaaatggttttcgtaactatcaccaagaaggacaaggagatatatgaatattaatgccaaacaataaatggccacatcttttctagccttctagctgatatcaacctcccctctcccccctaggtaccattcgacagaaacccttgcgaaatttcggaagtaatcgcttattgatactcctttctgttataaaataggcttaaaatcaccatcaaaaaccaaacgcgaaaaaaattataggaaattcaaactaatgataacaccgagacacgatattttataacgaagttcatccgggacactgataacaggcgttcctccccgatctaggtttcgatcaaagtgacaacgaccctctacatgttgctgctggcagccgctccctctcgctatgctaagtcgacatgcggttacaacaggtgtgcctctctatttaaaagagatccgaggacataatctgactcttactctatttatagtatacaactccaagtcctaaactgtaaccgactacgtgcacatatttgtcacaaattaaactctaacactttctatcacgacaacatgttgtcttagacatgtatcaagttaaagttcaaaaacatcaaaatgaatattttttttgaaatatttaaattggataatttcttatgggtagatttaactcaaaagcacttttataatattacattaaatcatgtttttcaaatgttttagaaaataaattagcaatcaaagttgcatgttggagacttcttcaatatatagaacgacatgtggccccatcgtttcgctttcgtggaagaaaccaaacggcatgcttgcaaacaaaaagtaatttgtgaataaaacttttatatacgtgttcttagcattctaaaagtaaatgccgaaaaataaacttcgatgaaaaaaccacaagatcagttccaaatttaaggttgaaaattcaaattttggctgataagcttaagagaaaagatgaggccccttcttatgaccagcgcaaagtaacacacccgccaatggtgaacgtgactctgtgagcgatgacaactagattctatacatatatactactatattgaaacatatccgtggaaataacccttgtcttttcaatagaagtaacaatatcatgtttgtctatccaaaactaaagttgtagcacacatattatcttatcattgttgatcctttggccattaatagaagttgtatatccaacaattttcattttgataatataggtcatgccgtgcaaacagactgttttcggttcattgtcaccaaatggaacattaggaagaccactgaacttattttcagaatgaagacaagttcaacgaatagtgtttctttgaatttagaatatgtgtcatctagtaatactagtacactttattctgaatttctgatgccttgaacaagagcgcacacaccagctacatcgtgaaaagcaattagaatgtgatacggtcttagttaatcttccaagactagacacatgcaactcttagttactgttaaataggaaaaatgaaaaggtatgccatggtttatacaacctttttttagttaagaacttcttttcaagaaaatgactaacggctctctgtcattaacaacccgggtggttatagacattacagagaacctccacatgtcaacattgtgcttattaaacatgccagcatacaaattttccttacaactcctttttgaggatgaaatataggttagcatttttttatcataatcactctccaatgaagtccatttcattcaaacatacaatgccaccctttttttttttcctaaaaagtagtgtgcaatacaacttggcaaagcccaatgcttatatggctgttgagtgcacgtaaggttgatatatgccagcactcatcgcactgcctcttcgatgtgatcaatccttgctaggttaacactaataccacttttcaatttactagtcacagtcccctgcattacaaacaggagggtatttgatgaagatggttcaattttttctcttctcccatatttttctctcggttcggtagttttttggtataccagtttttaagagcggttgttttatacatgagattagggtgatgacaaccactattaaaatttaaaaatagtataccagtacagcaacaaccatttgcttaccgtttcagatctaatgttaccgacagttttgctactctacacctgtatggttttttgtcaattttttatccctacactagtgtaagaactacaggaaaggagaagaaatcccttgcatagttgtaatgttattactcggaaatgggccggccatcgatcagacttggtccaagtctttagcccaattccaacacccatatgtggttgtctcttcccaagttccaaacgtccagatagcccacaggatctggcaggttcagactttgacagttgacaaagttctgagacacttcattcgtcgacatcatcaatcaataactcctctaacctcaccgttttttttttgcctaccttgctgatttacacgtccctgtttactgtggtctgctcctcggctgagtctgtgaatttttgtgttgccggtgcgccggtcatgtaattagttaggctggttaattgggtaattagttgctgtgtttggggtttggatgccggtcactgtgatgcttgttcccggttggatggcgctttgtatggcgcgcggcatgtggccatttcttgttttggtccatttgtttcttctgttatttcagtttagcctctctgtcctgtactttgtgccatcgtgcttttctgtttagccccttacgctttttacaaattgaatgtgaagaagacaaaattctgttttgggggtgtgtttgtggttggtagttatgctgggtatgtacatgtgcttttgccctgttgacttttttgggtctttcttgttctctttggattggtgttgtctccccgtcgctggtggcttgctcgtgccggtggccgttgctgcttgtcatcttctgttcctgaatcggtcgaggttagtccatcttgcggatgtgctgttttcattctttgttgttgtactttgggggtgggggtgtgttgttcccctcccggtagtctcttcttcccctttgttgttcctgattctctgttggaggtgactcgatttggtggatttggggagagctgtttctcccccggttcagttactttttcctctgttgtgactgcttctttcggtttcttcttcaatgtgttcctttccagtgtgttcgctgaccggaggaggagccgacgatgatgggtgggatttgcgcgctggtggtcggggatgccgaggaggatgagacggagctctgcgcgatctgcgtccacgtcatggtgcccggacggccggacggccagtgcgcgtcctccccggatgtacccgcgccttccaccacgactacgtccaccggtggcgaaccatctcgccgcgctgcctcgtctgcaatgcgtgggtgacgcagcggtcgcagggacctaaccgtcgccgtcgcccgcccagcctgatctgagttcttggcatgtcggcgttcctactttccttataatggctcagctcttggctcttggtgaggtatagttctattcccgctgattgtcgtagtcggtttctaggctctgcacagtgctccttgccgatttcttgttttttttcttgcgattcttctatgggtctgcatgtaaattgacttgttcttgtatttggtggtagcaagcagtatggtatgcaggttttagcccttttctcaattttttgctgtttacttttttcctacatgtattttgtgcttgcaaattttcccaatgcgtcttgcttaccctttccatgtgttgggtcttgtaaaaaatttcccttttcatgaggcccttgtgtaggaaaaattgccctctttgctgttgtgtgcgatattttattttattttttaaacattgttctagtgttacagttttacatagttagtaaaaagggtaccgttgttcggaaggggtaaaaataactatgggtcaacacacatatggtcatatttatgggacctgcccaattcccgtttgtaagcggcatccccccctctttgggtgatgtaggttgctgtgattgctggtaacttttcaagtgtatttgtcaagtggtcttaatttgttattactgctaccgtatgtatttatgcggttgtcattaccctgccttttttgttgattgagctgatgtttcttgtcgaccttgctgtccggttgtcctgcctgtgggctgattcgttgctgcgtgcgttgtcttctttgaaggcagggtatttactgggggtgattcatgtgcgtgtcgacctcctgtggtatttactgtcctcacaggttgtgctggcgagttaattcactgtttattggtgtaggtgtcggcttgcatgtctattgtttgttgtatgcgtgtccatgcccttgcttgctgtcccttcttgcccctctcctttatatggttactctgtgcatcagtgcttgctcttctgttttcctttctacgaccggttcgttatttgtttcttctttgttcttttttttccctcccgacgcttgctctgttctttcatttatattgtgttaatgttgtactgatcgtacgcctccttgtttctgtaaaattatgatatccatgttcttacttgtgaaatcttattaggcactgggtatacttacttggtcgtattggtttatgctgtctgtatcatctgctagagctcgtcgtgccgcaatccttcgtggtaggagttcttcctcacggccagcatgtgaatcaacacgatcaacaggtaattgccttttccttcgttactatattcatttttactccccttttgcccgaaatgtaaacgtcacttctctagatttgaatttgtctttgtcctttgcttttggaaagtttgattatgttaccttttttttagctacctcgttcaattctggcccttcgtaccagtctttggtcattcggaggaaaaggaaattggcaatcttgcgtcgccggttgtttgcttcaccaggttggttctttagccgtgtttagttgcaaaatttttcttcaaacttccaacttttccatcacatcaaaactttcctacacacaaacttccaacttttccgtcacatcgtttcaatttcaaacaaacttctaattttggcgtgaactaaacacaccctaagggtccaggcaatgaattgcttaagacccctgtactgtagctctatttatccgtacacagtactgcacatgaatagatgattgcctctgttttttttttggtcgaatgctcaggaggccagtaatacaatatgcttttagatttttttctggaaaatattctcattgtttgcgataagtcttataagctgacaaataaatgaagcaatcaaaattgatattagggtaagttcttatacttctataaagattaaggccagaaaatagagagggatcttagattttgtcacagatgatatgatacttcaccctgtgtgacattttcaactgaggagttgtaaagaatatctgcaacaataatttggaagtgaatcatgacaagtattcttcatataatttactagcatgattctatttctttttgcaagagatcaatgctgctattaaattcagtcaagagtgtatcattacctttctaacattaatattgcccttggatcataaggccacaccatgaatgcctgcacttttggtctttgaaaatatatttgtattgttttgagggtgaagctagctatggagcaacatgcacagattagaaaaaatgtaaaagtgcttgggaagacatgttgaatactgagcatgcagatgcaggtaatcgaaagaaaagttgaaatggatatattatgcttcctaaggtattaagaaaacatctgttttgttctaacccatgtatgccctatgtcagtgacattctgaaagagcatttggctatatacgattcaaaaaaaaaaagatgctaccgaatttttttggtgcaaacatgcttacatgcttgaagagcgaaccatttgcatcttgcagctgcgctgaagtggtttgaacatgtttgcagacaaaattgtggtttgtaatgagctcttcccacttgtaatcctttatggtggagaagaatgccaatcagagcatccacctaaatgaacacccatttgaaagtgtttgtcctttttgttaataaaaattatagcccaattcacttttttatcgttcatctttgttggtgtattgtcttctattaagccacttaatgacttaatggattcgcaaggacgacttatacttcattgtactctgtttattaaacaaatgtagaccatatttatcaaaatatgtatctactatctaatcattttatgtagaactatttgccatcgcgcgcggcgtggcgccgcgctctcctttctagtaaaagatcaaggaccatttctttctttcctccaacgacttcaacaatggaatatgttctggcttctacaccacataagagcaggtataatagcatgctgtaagtcagctgtaaacatattttaaagagataaataaggagagagaagagcagcgggctatagatttgtagccagctatagcacggacttcaagacgcagtgtgtgtatgacagatgggaccagatattaatagtatagtatataactattgtatgaataagcttttagattgactataaatgaattggagctagtagttggctacgctattgaacttgctctgagtttctggcaagacggtcaatctgggaagaggaaaagaactgcagcttacctacaaaacatgcctttctctgaagaatcatagcttcctgaactttctctgaaagcaattgctcttttcatttcatcactctttgcaaattagtaattgctcggtgcaggaggaattaccatatgccagcctgacagaaagggcctttatgaccaggacatctaaagaaatcaatcctgcaatggttcagctgctgcatacaactgattcacctgatgaagagatagatatcaggtatcctttgctgcaaaacaaacgatatactactagtataaggccgagtttagtccctttgaattaaggatttatattagaatttcataggattcaaatcctataggaatttttttctatttggccatttgatttaaaggattgaagttttcaaatcctatgaaattcttatggaatgacacattgcatatgggttttggaggaaatttagcaagagctcaaacctcttggaaaatttcctttgagtttatttctctcatccgattcctgtatttttcacgcgctctaatcaaacgaccattcctgtgttttgcaatcctctgttttacacttcaattcctatcagaatcctatgtttttcctattcctccattatttcaatcatgcgattcaaaggggcccttagttgcaaattttttcttcaaacttccaacttttccatcacatcaaaactttcctacacacacaaacttccaacttttccgtctcattgtttcaatttcaaccaaacttttaattttgacgtgaactaaacacaccctaagctatcatgtgacctgctggttcactgaggcagatatcagctgacagcataaggcctctcacagtgcaagctatggggcccgtacccctagtccaaaaatttggcccaaagacatctatcccacagtgtaagcacccttagttgtgttgtttaattggatgaaggtactgtgtaaataaaccgagcccacagtggggcgttaccctgccgcgtggtcacgggagaggaacgaaattaatttactcacctacccttccagcgacttctcctcgcgctcccctccatcgcccttcgccgccttgtagtccgccgcacccgccgctcctccttcccttccaccaccaggctccgctccagccgctcgtactccccgtcagccgcggcgctctgctctctctctctctctctctctctctctctctctctctctctctctcacctgttccaccggcgctggcgtcgggcccctcctctctcggcggcgacgaggaggtggagcgaggaggacggcggtggtggcgcggatctggagcggcccgagcttcgcccgtcccgggcgccgccttgctcgccccggctgccgcgtcgtcgaggactaggagctccgtggtgatggcgctcatctccaccttctagaagaaccggcggcgcgaatctggagccccgaggacgcagccacctcctctctctgccgacgacgaggagacggagcgtggtggtggtggtcgccgccacgatctgttattttgcttcttttttctttttcatcttgtggtggcaacaatagtgtttcttgaatccatattcttgagttcttccaatccccaagatcctctgccacatttttgcttgctgaatttgaggattatgcttgggcgggagaggatttaggagggtgaatcgggtatttcgctaggaggattgagtgcgaggtcacgggtcggcgaagcaacgctacccacagcgcgcgttccttccgttttctcctccgcccgtggactcgcgagagcgaggtttcacgcgtctctgcttgggggcgaggagctcagttggggcgcgcttcctcgctccacgcaagtgcacatccgagctggcgaggtggagcaccggtccacgtaggtgcactgtgagaggccttaaccaccatatgcaacaggtctctatcatttcaacctcagcagatgactggagctactgccatgatgattacaggatgcattatgtagccattaatattacggaaaagcaaacggcagagtgcaggactggtatgcgaagcccaggaagatcatgcaatgcaaccatatgcacggcattctacatttggtaaagttctcttaagagtaaattgcacccacggtgtaacaacttggcaggtgggtgtaatttaatgtaataacttgaaaaataagcgttctagcgcaacaacttggcaagaaggtgcaatttagtatcagaactttataagtgatcatataaatgcaacaacttgcaaggtaggtacgattttgatacaataaattaagaagttgtgacaacttaattatttggagcatttttatataaattcaaatttttaagtacttgacaatatactagcgtggatttgtataaacatatttatatttttatcctaataactaataactctaataactaataactgaaagtcaattaaactagatgtagaaattattatatttcggttgatatttgagaagatgaagaaaacaaaaaattcttaaaggtaactgaatgtaaattgtaagtgcaatataattcttaaagattaaattcagtattataaggtaatatccataggattactgtgtattggcatattgatatcgtgaaaaacctcacttagcatatgcttagccaaattgattcaccgaaatactaaattgtcaagttcttgtactaaaacgcacccacttgtcaagttgttgcactcggacgttcaattctcatgttcttgcactatatctcacccatctgccaagttgttgtaccgtgggtgcaatttattcttttcttaaacaggagaaacaactacactacaagaacatactaaggccgtgtttagttccattcccaaaattttttttacgtatacggacacacatttgaagtattaaacgcagtctaataacaaaacaatttacataatccgcctgtaaactgcgagacgaatttattaagtctaattaatccgtcattagcaaatgttactgtagcaccacattgtcaaatcatgacgtaattaggcttaaaagattcgtctcgcaatttacatgcaaactgtgcaattgtttttttcgtccacgtttaatgctccatgcatgtgtccaaatatttgatatgacggaatttttagaagtttgaagggaactaaacacatctaacacgggtccagccttctcgtaattcagatgctacgctaaatactagttattccaataaagtttggtacaatgccaacgatttttgcaataagtaccctcttttgcattctcatcctgactagtttggttcagacttgacaattgacaaaaccggatcactattcacctttctaatctaacacagcctatagggttcatttcgtcctaaccctttttgttcgtttccattcacctaaattcatctgtttacagttttcacgcccgacaaatttggaccaagtttgagaagtttcacaacttaggtagcaaacgactctttggtgttacttattagtgtcgataagaagacgaacaaaacattgcatcgcctgaattggatcggttgggagaagtaaacggccttaacgacgatcacaaggatgcattgctctcaacccaaatgtatagcactgattaaattcagttcaattcaaccacagttaaaaatttactcatgaacatttcgacaaaaaaaaactcaagaacaaacgaaatttacaattcgcttttctcctttaccgattcagagatgagcagcttgtcaaaaataacaatgtgaagttataaacatttaccgattcagagatgagcaacttgtaaaaaataacaatatgaagttataaacagtgaccaaaacgccacatggcgaagaagatgtcaacctagtgctaaaactgccttgatagattgtagtaagagaccaagtgactacagaactagagtagtagctgcatcctcatagcagccgaggaaacaagcaattcgcaggactgaaaactggactgccccgtgcggaagaacacctcaaatgtcagaacatctcaaatgtgtaaaccaatctgagaaaccgaaaggttcgaccgcttcttcaaccacccagctcaagtggctgaccaaaaaaaatgctcaaatggcaccaagaatcccgcagaagttcaagaatgcactgcaacaactgcgatcattaccacagtattttgctgaatgcccctactaagaaaaccctccagtctgcgacataagttctgtacaaatgattatgattcaactataacgatggcctgcagaaggttcccggtattcttatgctggcaacataagttctgtctataacttgagtcagattaagagttcaggggtcttcttagcccagcttccacctgtgaaaaggaaaatgtcaaaataatgtcccaagagtaaatgtgattgcaataatcttttgcataaatacatcaacatagcattcatgaagtactactaagtacactgatgccaattggtagaaagttattccgtcaacatgattcagcaaggattactgaagtgtcagccatgaattaagtatgatacccattccacattctgacagatttatcaactaaaatccgagaactggaaagtgtggtcctccaactgcacatgaccagatatccaaaatcaactaaaatcaatagaggcatcagggacccatatcatcataggccataattatggcttcgtaccaacataatgggtgctcatgataaattgtatttaagacatgtagaaccttcatcaatttgcagaatcaaacccaacttaaatgagacagaaaatgttcttcctaaggacattagaaagccagggttttcgacataaatgatgggattgtagaagtctaagaatgtgttaattacattatgattaaaaatcagacatagacttacatcattggccacaaaagatctactggcaaaagatttaagtcgtggagattgacccgcagatgttgatccactatcattactaccactttgtttatcaccctgcagacagagaagtcgacatgaatctaaatatggtagacttcaagaattgatgacacagacaaagacatatacttgaagcactgaaacttttaaaacatttaattttgtggtatgaaactaatatatttgtggtatgaaaattttatcgctagacatgatagaaattctctcatgatattataattcgaagttgtatatcaaagactgacaaataaaatatgtcaagtaaaaaagcagagtagtgcatatttaaacacctacacacaggaaaatattttaagaaaaaattaggagggaatacctgatgagtgcatgtgttgtttcggacatccgcgaaaagagaagaatagtaggcaggatcataaatagaaccacccaatatatcatcagccatggaatttcgtctaactgaacttgatcttgggctcaagaaactatttcttccatcatagtttacttcatgatatgttggggtgcttgatgaaacccccagcctatacatctggatccatatgaaggaagacaaaaaccttactgaaaacccaataatttgcatccacaacgctagtttgagtgataaaacgaaaagttgaccatacttctcttcaggagtaatattcctgtataaatataatattagattaaaactctgtacaatatcaaaatattctccctgtatcttaaaaaagaagtgtattggcaaatatttccatgtccatccaatagcaagcataacaacaaacttatgttttcaggttataagttgatgcaaggcatggaatactagaagcaaccaagcgccatcacacataaatccaaacaggtttcatcatacaaaggtacttccataacacacttaattccataacaaaataatgcaaaatctacactggcaagtggcctgataccagtgcaattgtcacaaaatgggaaaaagaaaatttgaaggattcccttaacttccaaaagaatttgaaactatttctcagcacaaataaatgacagaaacaagggaatcaagattggcacaacttgaactagaatgagctccaaaggatggtattaggatgtgtgtagcatggtttgcattttactacttttgccccatcacacaaaaattaaaacaggttatgaactataaaatatagtggttgattcattgcagaagacataccatatagcatgtgagaagagaataaaccaagcaacatcaagaacaatagcgaagaacagaaggactgcatatgtccgaccaagtgtctggctgctactctcaattgcaacaacagcaaagagcccaattaccaggttgatcacaagaacgccattgaacaatgctccaagtgacccaatcagcgcacaaccaatctgagaaaatactgagaaattaattatgcagatgaaaacttcagtcttcagtaattcagttttggtgtgcaaacccctatttcagcatgataagcattaaagcagcatgatagtagaaggaaccaaatgtaaaagcaatcagtgaagataagcatttagaatgttaaaccatgatgaccttggaaagaagatagtttttgcttggaatgagagattcagtgcagcatctacaggattaagtcgtattcggtcaaaagtaacttgctgctaacactgtaagcatcaagaagatgactgccgcaattaaaaaaaaaggaggcaaaacaaggacataatacaattatggaagtaacattaaataactcctagattgaagcagaaaattatatgttcattatttcctaaaatgctacctctaacatagaccaaaaatttactcaaatgctaaagttcgctttacatcataaactcataatagagcaaaactaattgctttgcaagacagccatgaagtcgtcagaatctactcaaacatagaaatattgcactagttcacatcaaaataaggtatatctcctctttttcaccatatttgccaaagcccacaatgtacaataccaaaatggaacaaactacaaaatctaagaaaaataatcattgatattggacccttcaaaccctattgtcaagtacaaaagctctctgatatcatttaggccttgtttggtttggaagggattggaggggtttgaggggggcataataggtgtggtacaaaccgaatatctcccttggggattaaccgaacatggccttagttggtcagagtaaagagtgcaaatataacaactataatctccacaagcattttgagagaagaaaaatcccaaaacgcggactaaaaatattgagtgagaagcaggtgagtaggtgatgcttttcctgaaacattggggattgaatctaacgagtggcaaggcccataatctgacaagcaggctacctcaccagaattggggaaattcgcagtcctagcaaaatgacggcattgaacttcacacttcaccccaaaatcagatcgaactgaaactacacacttctcctctctttcttcgtttgattcacgcagaagaacgaaagcctaaacctcattgaaccaaacaccccaattcgccaacacaatccagacgccgcgagcaccaaccacaaatacaaattcggcgctgccattacgccctaacgccgcccgcggcagttgcctctaatagataggtgccacaaaacctagggcacgcgctcaaactctctcgcctctcggttcgcaaaaacaacaagcgatctcgtcccgggggaggcgccgatccggtagatgagggggggaatgcgcgcacctggaggtagatgagggcgagggcgagcgactggagcgcgtcgtagtcgcggaggaaggagcgcagccgcggcccgatcccgatcccgagcgccgccgggcaggggcagcagcagcagcaggagcgcatcccggcaccacgccgagcccggacatgcaaaacctcgcgggcggtggtgcgtttggggggtggcgcggctgcttcctcctcctcctcctcctcctcctccggcggtggcgagcggcgagcggcgtgatcggcggggaggattcgcggcgagggggaagggaggcgaggagatttcgcctgcttcggcttgccctccggcggccgatggttttttttattattattttttgggtgctttaattaattaattcggtgacggcgaaggaggggcaagaagacgtttgcgttgcgttgccagatttgtttgggaactaagggtgtgtttagggggtgtttagttggggaaaagtaaatttttgggtgtcacatcgaaagtttgaccagatgtcggaaggggttttcggacacgaatgaaaaaaataattttagaactcgcctggaaaccgtgagacgaatcttttgagactaattaagccgtcattagcacatgtaggaggttactgtagcacttatggctaatcacggactaattagttttaaaagattcgtctcgcgatttcctccataactgtgcaattagttttgctttttatctatatttaatgattcatgcatgtgtctaaaaattcgatgtgatgtttttgggaaaaaaattttgggaactaaacgggcccttagttggggaaaaggaaatttttgggtgtcacatcgaacgtttgaccggatgtcggaaggggtttttggacacaaatgaaaaaactaatttcagaactcacatgtaaaccgcgagacgaatcttttgagactaattaagccgtcattagcacatgtgggttactgtagcacttatggctaatcacggactaattaggcttaaaagattcatctctcgatttcccccataactgtgtaattagtttttctttttatttatatttaatgcttcatgcatgtgtccaaagattcgatgtgatgtttttggaaaaaagttttggggaactaaacgggccctaattcggtttgccttcgctttattagtggtttccaactgagagactgttggtgaaatgaaaatttttgggtgtcacattagacgtttgaccagatgttagaaaggatttttggacacgaatgaaaaaaactaatttcgtaactcgcctagaaaccgcgagacaaatcttttgagcctaattaagccatcattagcacatgtgggttactgtagcacttatggctcatcatagactaattaggctcaaaagattcgtctcacgatttacatgcaaactgtgcaattagtttttctttttatctatatttaatgctccatatatgtgtccaaatattcgatgtgatatttttgcgaaaagtttttaggtaactaaacaaggcctaactaaactggatgaatacccccttgctgcagaaaattaagttactgtacataatatatataaataatatgtaatttgattatcaaaaataaaacaatttgatataattttaagcctaaaaataattgagattgcatgtttttaagagagagaaagaagagacaatttagaccatagatatatcatctaaaggttagaaataattgagttgatgtgacttaataagagaagagagaaataacattaactatacttagtgaggatgaactatataagtatatataagtatataagtatatagaattagggtttgcgaagccatggttccgatgcatcactacatcacctcatcgagtgctacctccgtttttttaaatatatgatgttgttgaatttttgtaaatgttttcattttattcaaaatattttacaaatataaaaatattatttaagttatacttaaacaatatttgatgataaattaagtcataataaaataaatgataattacatataatttatgaataaaaaaatggtcaaacgtgtcttaaaaatcaatggcaccatatattaaataaatagagggagtaatacatatgaaccagggctaaaaccagcggccccatcgtttggcacgaggaaaaagcgaaacgatatacttgcaaattaaaaaaaaatatgaataaaatttttatatacgtgttcttatatcgatataaaagtaaaggctgaaaaataaactacaataaaaaaatcctaaaattaacttcaaatttatgtttgaaaattcaaattttggctgataagcccaaacaaaaagacgaggctacaatacattcatatactactagccaggataaatgtcgacttggaggtagcgatgatgttatatagcgcgatcgctagtacgcgcgcactcgccggcggcgtgcgtttcaggcccacaaggcctagcgccggcacgcacgcgcctccttccacgctttttttttcgttttctttaccgattttttttgttttttcccacttttttatgattattttttaatctttagcatgctttgagtttgaaagttttaaatttttgagttgaaaatttttaaatctgaacttgaaagttttcaaatttttcaaatctggattttaaagttttcgaatcttgagttgaaagttttcgaatcttaagttgaaagttttcgaatctgagttgaaagttttcaaagtttaactttaaaatttaaatattaaatcaaattttttcaaatctgacttaaaaatttttaatctgttagtaaaaaaatctcccgaaaaaagaaacaaaatcttgagaatcttccctaattagttattagtgttaagtgttaactaatactatagagtagttatagtattagtagttatagggaagtgctcgctgctggcgcgcgcgcgccagctagtagcccccgttatataggaatacactggtcctacctctttttctttttactcttgtcccactcaaaatggtttcatcatagattctatgatcatccaaagaactgattttacttagagggcaatgcacaattgataataagtagtaactcagttaggcagaataactagaagtaggaatcaaggttttttttttatttatatacgatactaaggcaacgggcaatatgttgtaaaaccttcctagtggtaatcttatcagcagagaaatgtgccaactctttattaaaattagggtgcataatttattttgtgtacaataaagtcattgtcgtctaattcccattataactcaattatacaatttatggtagtatttctatatatactgtatatctacgggcctaattggcgacagaagtatgtacacgcgtaagcactaaataaagccgtattgccaatggtcctgctggcagcttaacacgcattacagcgtgactaatctgacgctagctagtccaacttctcgaaccttgattaaaaaaacacttaacttctcaactaattcacttgcaggattcgacaataatattcaatctaatcgaacagcacagctgtgtgaccatgtcatcatcatcgataaaagttgcctaaggatggttagtgactagctaggcaactttgtagttatagtggttataataagagttgtttagaacaatagactatcttagaaaggaatttagtaggattagacagagaaatggctgtaggcaggggtcattgagcctagagaattttagagaatttttagagaatttttaactaaatattagtggcttttcgttgtaattttctgtcatatgtgggactcaagcttaagctgccctgtacactgcgtgcatctttagttggtgtagagatcaaaacttataatttctttgtaaaagagaagatatattagatacgaggttatttttctctatgagcgcctttggatatcgtacaaatgctcattataaattgaattttcattacggataaagttcattggaggaaactaaaacatcattgcccccaccccatcccaccccaaaagaagaaacattatgtcaaatctcatggggaagttttctcaaaagttcaaggcagtctcgctctctctatatggcaagtctagtgagccatacttaaattagtttatcaacctatatgttttagttttctttcttttgtttagattcactaatatttatacacgcatatgaaacacatagatgagtccatatatggctctatttaataccaaaaacaccttaaagaatgtacagtgaaattttttggaatacccaacagacattcaaaggagcaaatgcaccaatgatatcatccactaaaagacatgagacctaccctgtaggcagggccagccctgggcctaggccggttgtgcaactgcctagccccagggccgtgctagggagagcgaggcgctgctttgtctccgcgagatcgaatgccctgtctgagtcgccctaactccaactccacgtctccacctcgcctaaccacctccacgagaccgcgataggccgacagcatcacaacggcacgtcgagtcgcccactcgccttgcctgcctagcgcctgaaccctgaagcctgaagggtgaaccgctgattcctgaagctgaagtactgaactgctgaaggtggtgctaatcaattagttcaatatatatcaattttcatcatttcaattaatggttattgttgtataatttactagaatttcactatttcagatgttacaatgttacctaacaaatatttgtcgggtgctcagtaaagaaacaaaagaaagtgagaagatcaattaattgatctcttattaaggtatttatagtactttgtttccatggtgttttttaattatcaattatattatcgttattatttatcgagaataaattactatattgcaacttgcaaactgattgatttatgagcaattttatagtctttgaggaggtaccaaactttacactaaatttttgatacctcatggtacctcctcaagaattatataattgctcttgatttattatttatcatattagaaatgtttatttctgttatagtatatgtgtttcataaagtatatattagaagtaaaaaaatagccttaacttgtcaagggcccatgctaccaacctcgtatagggccctcgaaattgttgaaccggccctacctgtaggagtaaacccatcacgaatttttcactttcttgtcagtttccctagaagaacaatttctatgggtatttttctgagggtcgaacataaaaaaaaatccactgtcgtcaggtttttttcaccaaaattctgacgtggaactgcaaacgtgaatggtggttgcaaaataatgttagataccagttttagaaaaaaaaagtaattaacaggccagttattatggcactcccaacccataacactagacatggttttcataaactccacatcatcaagaaactagtactagacgctactcttccaatgcaaacaccactattacatacttcaatttaatgctacttatctcacatgatgtcttggatgttgtgtagaacccatgtctcatgcaagatatggtttccttccctttcctcatttattcacttgccacatcattttttatcctatgtagcaacttatttaatgctatggacaccatcctagtcattgggtttgaaatgcccttagtggttaccgggcaaatgtttgaatccgaaatcttaaacctatatttttttttctgtgcaaaatgcatgcatttgggtaggaggaatccttcacgacaattaaaacaggtgattttattaagcacaaaccaaaaacaactcttttccatccactagattaggatcactctatatgcccccaatcccccgttaggtttcttgccgtgggatctattcacttaggttcaagtctatcacactgcacgatgctcatatctatgcctatttattcttttagtagagactatgttcttaatactccatccgttttaaaatatttaacaccgttaactttttagtacatatttgaccgttcgtcttattcaaaaaatttgtgaaatatgtaaaattatatgtgtacatgaaagtatatttaacaataaattaaattgtatgaaaagaataaataattacttaatttttttaataagacgaatagtcaaacacgtaataaaaagtcaacggtgtcaaacattttgaaacggagggagtatataccaagcaaaagtcttttagagatgtttacaagaataagatgtgtgtttgagtgtatcttcatacggatgagtgtacttccaagatcggttttgcaatctcccaaggaaatattactcccaataacaaattgcagaccagagatgaaaaacattttcccattatctaacattatacataattgcaacaaaactctaatagttaaaactagagctgttaaattaagtttcaaccattctaaaggtaggaagtaagagtaagtttcaaatcaaatacggaaattgaacagtttctcagataatctcttgagtatatattctagctttgatccgagccattcgtctcagatcggacggtcaggaaacgtccatgcagtttctcttcaaatatagtagccgccaaaaaagctgggaatctccagctcgtccagcccgcgaagcacctcgtcgtagtcaaaccagtcaacatcttccggcgccgcgccggagacctcgccggagaagccaccatgctgccggtggtgatcatgatcctcgccgccgtgttgctcgagcaatggcggcaccggcgagtcctccgtcttctgcccttctccctcgacagtggcgccattgccgtcgcccaccagctgttcgagctccggcccggtagtgacggtatcctcgccggagacggagaagtcgacggcggtttggtcggcgctctcaggctcagggcctgcgtgcgccgccgcgctctcggcggagtgcgcgtgctgtggcggcggcggcggcggcggcggcagcaggatgaacgacggcatcacgacgtagcggcgctcgcgctcgccgcggagcgcgctctcccatatggaggactcgagctcggtcagcctggagcggccggccgcggcggcgaggcggccgaagtccggcgcgacgtgcctcacgacggcgacgagcacggccaccttctcggccttcgcgaggcggcgcgggctcgcgaacggcacgggcgtcgccatccgcctcccgcgcaggtgcgccgccacctcggtgccccaccacggctcctccgccgtcggccaccacggcggcggcggcggcggcgtggcgccgctcttcctgtcccgccgcgccaccagcggcggcgtgcactcctgcgccatctccctcatcatgcgctccagcgtgccgttgcggagcctgcagagcgcggcggcgagcgggacgccgccgccggccaccggcgccattggcatcgccacgtagcagagaagctgcgcttgcatggtcaccggcgacagcatcaacggcgcgacgccaaccatgggcatggccgccaccgcattgcgcgccacgccgtgggtctgggagagctcgtcgccgggagcgcgtcgccggcgcttggcatgctgctggtggctcgaggtcgaggaggaagaaaccctcttgccgctcgaactgctggccattggtacagtgcttgattaatcctgaatggacacatgatttaagtttcaattattaataataatttgctttattaccagagcaaattaacaagcaatattgatggaaaaaacttgccctgtcaaaataaaatgatcaaaatgtaagaaagggtgaggcatagtatattttgatgtctgaaatgatctccttttaatagaatccgttcagcattttggaaaactaattcaattctcttcctcttagagtttctcgatatgataagaatgtttgatcttatcatatattttgatgtaatctggcacaatccgtactttcttctgcatagagttcttttcagcaactcgtaataacaattttatcatttttcgtcagggtatgcttttttatcatttttcgtcagggtatgcttttcgaacgtttaaacaatttatcaacatggaaactgaaatttttgtcaataatctcataaagaaaataaatagctggtttcctgccaaaaataacaggagggagaactttacaggctaattaactaagggtctatttgggagctttggcattaggctatattcttcgtcaagggttgggaacccttcccgaaaatgaagcaacagattagcatgtgattaattaagtattaacttaaaatttttttaaaaatagattaatttgatttttaaggaaacttttgtatagattttttttaaaaaaaaacataccgtttagtagttcataaagtatgcacatgaaaaacgaggaagtagaggttgggataagagacttttgaataaagccttacgattctaagaagtcgtttgagggcctaagacatatatagatagatgccaacagttttttttttttgaaattttcgcaggggggagagattccccacgtgaatttcattaaactggaaggggacaggaagaagttcgaattacaaatttagagatcacagggaggaagagaacaattctttccacgaggaaattacaattctttcgcagttatcatgtatacaacttttatcgccaactgtaagcatctggtgcagtcatagaaaaaaaatgtgtagtttcctacccaaaatacaaattattacttcatccgtttcacaatgtaagtcattctagcatttcccatattcatattaatgttaatgaatctagacatatatctatctagattaattaacatcaatataaacgtgaaaaatgctagaatgacttacattgtgaaacggagggagtatcagctatgggacattctatttccagagccagcgcgtccaatgtgaaatggtttggttggacaggtccgatgccacaaaaggatatgtgtttttagaccgagcgtgtgtattgcaagccacacaccatgttgtcatcacaagataacttttacgcacaattatattgtaatcataacctgactcctaaaacatgtttgcgatgactgatgaacatgaaaattatttgttcaaaacttctcttgaaagggttattttatatggttttgcatagtttagagatatctggtcttttatttcggtaaagtcgaccaacagcatagtctaccatatcttttctagcatctaacatttgagaagctcatataaagcaacatatatatagttcattttcttagtgttttaaatcatgtttttgcactccgtgtttttctacattcatggtttctatgtaaaagaatatgtacttgctgaaaaggcttgaaactgtacataaggtcccaatgataggattaactagcaaacaaagttaaaaaatcggcagattttaggagaaaagccattttcaaatgtaaccaaaatcttaacttcatcatagacaaacactactcaaatctttagacaacctcatacctaattacctagaatgcatgaactatttactcgaagtgaaaatcttaacacaaaagatgaataaattgtgtaccttcaagatgatcactcagctgccatcttttcattagagaccaacagccgctttgttagtcttgaagacatagcactcggcatctggaaaacttgtagtcaggtgaacgatggtaatggtcactgtagtcctatatatagggaagagggatgcaatatgagttggaaacagaaaccatggattggtacagttcttccatatatagaagatgaccacgaatgccactatatgcaataattacttgcgaaaacgtatttgatatttccaattttaaatatcccaaagttttacatttgataatgccatggtggcaacatttagagagagggtaggcacatcggtgtcggcttgcaaggggaatgttgaatagttccacattggttgtcaaagggcaagtgacactactggaaaactgatctttgctaggtcgtcccaaaaccacaatagtcccagttataaaaagaatcgggatctttagtcccggtttaaaaccccatagccattctacgatctttagtcccagttggtaacaccaaccagttcatcccctgtcagtcccttgtcagaggggcggggatctttagtcccggttggtgtcacaaaccgggactaaagatcaccattttatcccggttggtaagtaaagatcctagatatttactcccggttggtattaccaaccgtgactaaaatcacgcatagtatataatccttattccctatcctctccgccacaaccggcctcaatctcctcaacaaccggcctctcctctcctcagatccatctccctctcctcctccccctcctcccatcccggccctctcctccccctcctcccttcccatccgatgcccagcgagggccgcctcctccccctcctgccttcccgcacgcgtcaggcggggccacgcccggcggggccgcacgcaggccgcgcacgggccgagtagcgagcggcggcaggaggcactaccagcatccattcttttttttctttttttttacaatttgtgattcactgagatgtataattttgtaatttgttgtatggatctgagatgtataatatgtgatgtatttgatttgtgtgtaatttttttaaaatttgtgatgtatttgatttgtgtgtacaagtaacttaagatttgtgatgtgaatgttttgggatgttactttgatttggggtttgatttgggaatatgcatcccactcgatttgggagaaaatatagggattaaactctggctaaaaaataatgaaaaaaaaagaaaaggagacctaatgggactgccgctaccctctctttagtcccggttggtgttaccaaccgggactaaagatcgatctttagtcccggttatttcacccaggactaaagatagcgatttttagtcccggattcgtagtcccggttggataaccgggactaaaggggggttatgaaccgggagtacaaagggtttctccaccagtgtgacctaatatataagtggtgggtggccctcacctcattggctatctttaggtgtggaaaaaaccctttaacatcctacaatttgtatcagagtcaagctagttcaacatctctagtccgatggacaagagtgtcaaggcctgatagaccgtgggtgcttgcagggctcgtataccagaaggaccattggtgtatggtgaaggaggtgaacggctgagagacaccaatgtgtaaaggggaagattgttgaatagtcccacatagggtatctctcgcctcattggtagcttttagggtgggaaaaacccattatgatcctgtacgtccactcgcggtccgaccgttagcctaaaaatagcttgataaagcttgtataagaaaaagatgttttcttcaaaaccaaccgttgaatcgagctcaaatctttacaaataaactagacaaactaaggaacaagttcgccgcatggattagcaaactaataaacggtttaagagaaaacactctcaagccaatcgtctcagaaatttcagcaaatctaaacaaaacataaaacgtaagcaaattcaaatctagcaagaaccaataaacgaaaccaccaatcgtcggtctggtcgttggaatttagaaaaacacgtctcgatgaaacagatgtgtttacaaagtgcatctaaagcactcatctcttaactcatgaactagaatcaaagcctcaaagcaaaccctaatttttctttccccaaaatcaatgtatcggctactaacctttacaggtactttggacccaagatgaagttactttggaagctaccaatccccctaaacaaacacatttcctgtggttagctataagagataggattcaaaccacaaaacatctaaaacaaaaaaaaaactgggagggatgtgagttttgtgagctctgagccactcaaaatgcacatgttattttagctgccctatggcatattttgtttggtgttttgctagagacagttttggttgggattttgttccaccatctttttatcatttttttctgtattgatgaaagttgatgatagctctaataatagtttgagatatattgatgtttctggcggcggtaatctggtagctatggctgaccagaaacgatatgatctttagagataagttgtttggcacgcctctaactataatctaccgtgtgatctctctaatgcaacagtggaagattctggggagataaaaggacggagtatttgacctcatcgttgcttgaggggacaaaagtttccacccgcaagaagtgggatgatttttttttcttcaaaagttgttgtcatttttattcccgctagtctagttgtttagaccctttgagatgtgttgtttatggttttaacatctttccttctctatttggcatgcgtaccttttatactgaaacaaagctaaaactataaagctggtctccccagcgaactaattatttttgctttctataaaagcagcgtaatgccttctatcaaaaaaaaagttgaaaagatgatgatgagaaacagcataaactttcaactaggtgaagtcagaaacttagaatcaaaataatgtcaataatcctgacacatagacttgttccgtaagagtgtgaatatagataaaaaaaacacccccttgtactcacgaccaataatgccattggaaactgtaagagatctcaaactgtagatagcacatgtggaatggctccatcgaatgaatttgagcagcttaccgggcagagatgaagatgacccaaggcgacatccatctccaggctgcaggcgctcttgatggtgaggcaagtatcgcggggccagcgacgactggagaatgcgcgtggatggccacgaggagctgcgccgcactcacagctctggtgaggtcttggggatgaaacgatggggacgagagtgaaagtataatatcgaagaccgtgtagaaaacttgcgtgcttcataatttgggatggagggagtattaactatgatctaaaatagcacactagctcttgatggtgaggcaaggtgttgatgcgaaaaacacacactggcctgggagatctgcttagctccagtgcaggtccaaaggttggtaagatgcgggcgtgccagtcagtttgatcctgcaactgataagatatacaaacagcagatcaataagccgatcggctgtcaagccgatggagcaattccagccgatgctgataccagccgatagcgatagggttttaagctatcggctatatgtttgatgtagagtcttaacacttgatataaataaaggcgatcggcttataatgataactaacaaaaatatagcaatataatccagtagagaccaatcggctaataatatgatataatagaacacaagtattgatccgaaggtcaaaatatacatcggctggagatccgatgtcataaaatccacaagattagatagatcaatgaaacatttgttgtcatcggctaaatccaacttatatgtttatgcaatccttataagccaatgcaacatccagataacttatcagctagcaccccgataaaacattagcatgaacctattggcttaacaagacttatattatcaacaacaatctagtggtcgaacctaaccgatgcagcacgagattgtatatgataatctaatactcgatgagccgatagatctgtctaacgtgatggatataacaaatctatttagagcaacattgtgattgtagagatatatcggctaagatagaagatcggacctaaccgagacagtcccaactaaaccgatgtgtctctaaacacaatgcaattaaagatagaattgagatatcaggtaggcaaatatatcaaccaaaccagagcgatccaagagatcgaagcgatgcagccttgaacaacaccaacgtaaccggtagattcaccagggccggcggaacgtaggacttaccccttcgccggagatcgaactgaatcgatgcagccccgcgtcaggtgccaaattccgccggttgataagtaaaacctcaggaatgagggtggcgatgcgccgagagtagttgtattgatcgagagattgattagaatgaccctgggtatacatatttatacccatagggagatactagtccttgtaagacaagaaagaaactttcctaaagataaaaggaaaacataaagtccttattggacactaaacacactttcctaaagataaaaggaaactaacaaactattcctaattaatagataacttgtcataccgcatcctcattgaactcggattcttctggataaattttctttaattgatccgactccaccaagaacacaactgctggcgatttaacgactcccatcggccgattctaaaactctaaaaccgatactgactctaggccaatgatgacttcgggcttaccaaattttggcgttaacacaaggatcccggggccagcgacgactggagaacacacgtggatgccgacgaggagccgtgccgcactcacagctctggtgaggtcttggcctcttggggatgaaacgatggggatgagaatgtaagtataatatcgaagaccgtgtagaaaacatgcgtgcttcataatttaggatggatggagtattaattatgatctaaaatagcacactgatttgcatttgcctcgtcaaatgtttcttgattttgaatagaaacaatgtagtattaagtactcactctgtttcagattatattgactttagttaaagtcaaactgcttcgagtttatctaaatttatagataaatatagtaatatttacattaccaaaattagttttattaaattaataattaaatgtatttttataataaatttatcttagatcgaatatattattatttttttataaacttaatcaaacttaaaacagtttgactttgaccaaagtcaaaatatcttataacttgaaacgaagagagtattagtttaatgcttgtaaccagttcaaagaggtaatcacaaagtacatcatgtttagtccaaagattttgcatacaaattaacttctttacaccattcatttacatccattttggtcaaatgattacataatttaagtatacttaaaacaataaaatgtgtatttttttaaaaaaatatgtattcctaaaacaatggaatgtgctttttaaaattgattcggctcatatcgatgggagaggtttaggccctatttggggagctttagattctaagaagaaactgtttgagcttccgagaatctggaaaagctctgaaacccagcttctccagctttttagttcatttttcagaatcctttgaaaccctctgaaacccagcttctgaaacccagcttctctagcttctggcttcttggtttatttttcagaatctgaagctgtggactgtttggagcagcttctagcagaagcagcagcttttgggaaaagatgcagctgggaaaagctcccccaaacagggccttagcctcacatcgctcagaggtttagcattacaccacaagcatgtcctttcatgtcaattttgataccacttgggattccaaaataccaacttcaataatttttccctcaagctaaatactactccctccgtttcatccgtttcagattataagactttctagcattacccatattcatatagatgttattgaatctagacattatctatatgaatatgggtaatgctattatctatatgaatatagataatgctagaaagtcttacattgtgaaacggaggataattgacaagttccaagtaacatgtcgcggaaacatccatcatgctgtaaatccttgtgcaaaatgaacaggtacaaataatatccaaaagtacggaacattcaagtgaggtatcattacaaaaatattggactcgccgaagccacatgccttacaaaaacagattgaaacagtgcttcgtcctacatatgaatgagatacatgccatagctcctagtcagctccatgtcttaaaggtccacgtatcaagcatcaagcctacaagagcagaacagcgaagttgaaaaaaaaaagagtatacatagaactttgaaaaggcactatctgtgcaagcacagtaccagaataaagtctagtataacaattgaactgagaatgaatagttttgtaccttgctagcaatgttgctggacagccaatccaggccctcatacaaaccctcgccagttgtggcacaagtgctctggatgtacctgtcagaaagaagaccaggttgagatccagagtaccatgggaaaaagtgaagcagtgagtaacatgaataatggcaacatgatgtgttacaatcgaaacaaaggatagaaggaatttcccctagtctataatcagttatcattgagcatcacactatatctacagaaaggactaaaaagaaaagagcaaggatccaccagtaattcgtatttaccagtgacgctgacgaagggaatgtaatccaagcttatcagtaatctcagcagcattcatagcgtttggaagatcttgcttgttggcaaacacaagcaacacagcatcacgcaactcatcctgccataaatccaattaaatttcatcagatagggttgcagaaagttgttagcttatcaattggaatatgatattttcacagttgctttgttaattattatgtacatcgatcaaaccagaggcataattgatcaaataagccatatggtacagcgatagcaaaaaaaagtgacagagaacaatttacctcattcagcatcctgtgcagctcatctctagcttccacaacacggtcgcgatcattgctatccacaacaaagataagaccctgtgtgttctggaagtaatgcctccaaagaggtctgatctgtttttgcaagcatttacaaagatcaatcataaggtgagataacatatgtcaacattttaaatattaaaacaaatcaagacataggacagcttaatgtaaacaacataaataactaggaaaccagatgctaataatgacaaagataaatttaattgaaggcatcaaataaaaatattggtcaaaatatggctgcagttcttaccttgtcttgaccccccacatcccagacagtgaagctaatgttcttgtactcaacagtttcaacattgaaccctataattcaaagaaaatcagttagcttgaaagatacaaataaataaatagaaaaggagataataccatagcacaaggagtcaagaacataaaaggatccaaatgttgaatagtttaaaatttaaaacctaaatagatgcctaataaagttcactccgacaatttaagattcaatcgatatcctacatgtaaagttgaagtcttaaatttcataagaaacagctcccagcgttatgcaatagttcaaatagcttttcaagtaaaacaaatgacaagcagacatctctgcctatcaagtgtgctagtaaaaacttagcattcccatggtcatggaataggacatttcgtctttccatccaattaggaaatttgacgtcaatacagccaagaaaacctagcgacaacaactctgcagaactaaagtccattctggaaatgaactctaacagcacgcaacaaggctaaagaaattggcatatacaatgtacagaaagtcagaaatggaaatttgatgtttatacaaccatgaaaatagcagcacgaactaaattacattctggaggcctcatcgtttacccattggctcatatgccactgcaaaagaattgaattttaaaacatgattttgaagttgattttgacgctttttcaatgtacctttttcctcagtaatggcttttaagttgctaagaacatataagtaaatatctacatacaaattattttctaatcactaataagacattacggcttataataagtcataggcaacggatggggtcctggatagaacacaaacagcaagcggcaaggccaaagaaattggcatattcctatactactttaaatgatgctagtggtggcatccgagtccgcctccaatgctacgagctgacatgtggtgtctaatcaattaactctatgctataaacttgtaattacatgcctttttcttttggatatagcattatatgcctaatcaattaacaatgctacaaacttgtcattttttgcttttgcttttgattttatttcttacaatatccgtcgcatcgcacgggcatttagctagtaatataacaatgtacatacagaaagagaaacgcatgtggctgaccaatggtggggatggtggtgacgatctcgccgagcttgagcttgtagaggatggtggtctttccggcggcgtcgagccccaccatcaggatccgcatctccttcttcgcgaacagccggctgaacagcttcccgaacgccaaccccatcttcccccctcctctctcctcttttttcacctgcaaatccatacgatcccatccgttaaaatccaaatccgccacgagatccaacctccctccccccacgccctaacgcctcgaaaaccagatcaaatctcgaaacaaatggcgccggatcttcgcccccacgcatcaaccaacgaaatcgaacgcggagaaacggcggatccagtagaatcatcgggcggcggatggatcgccggagaagggaggggcgggagagctcacctgatctgatctgcgatggaattcgggggctggggggtggaagcggatggatttgggggggagggaagggaagagaaggggtggtggagaggagcggagaataatataaggatggtgggcatgggatggagggcgtccgatcttgggatggacggctgagatcggtctccagggaaatttggtggcacgcacatggagagcggagaggcaggaagcttctgaaaacgtgcgaatttctctatacggactaaaaaattttctctccgtccaataaaaaaacaaaattattactggatacaatgggattcttatttcacacgcgctagacgagtaactagtgttcggaagatcggttttgtaggaccgtgatcgtgaggatcacggtacctcctccttctgtttcctcgttaatgtagtgggcttataccaaatatatatgtatgtatccatatacgacatcctattgtgggtataaatacaatagtgaggttgagggcaaagtaatacttgtaacagagagagaaacatcgataaagttaattgccctccactttcgaacttgccctccactttcgtgtccgtgtgttcgtgtgtgcttgttcgattgttgacaacgtgaattctaacacgttatcagcatgaggtgctcttcagacaaggtatattgtcaacatcgatatgttctaatctcgttctatagggataatgataaacttactagatcgttttctattattttttttctccgctaatcgttcgatcgatgggttgtactacgtggatttgtcccttatggcgcacgtagcaggagagtttgcggctctccaccccatgcacgacaggcgtatggggttatcccttatacaaccgatctatcgaatgagaagcagttatcgctatagtccgattagatctgttcccagcctttgcgctgggtttcttttcttgcaaacaaagacacgtatatcgtacgccctagatgcgcgaacggatcagacaagccgctgcaagaacgacggtttagaactagtgatacctcgaagggcgacgctacgttcagggtgtaatcgcgatgcacatgagaagaatcgtgtacctggctaacatgatcaccgattccgaacgagtcggcccaaatcctcatgctagtgccgccgtcgtcctgaagttgacgacgacgaaaccgagtcaatgacgccagcatgcgccgtcgtgcccttgccgccgccaacacgcgttgccggtcacccccttcaccgatggccgcagaatcgtgccatcggctttccatcgtcggttcgcccttgaaaagccagccgacgggtcttcaatcgaccgcctgcactcgccgttgacggccgccgcccgcagagacgctgaggagaccgcgtccgcatcccccgccgccggcacgcacggcacacctcccgcgctaccgcacgcgactgggatgggggtcgaagccgccgtggcctcccgctgccgatagctctccgcctcgccagcccgcatgccgaaccaaactccccggcgcacagcaaggagctgcgctagccgaacgccggatatgcccgtagccaaccacgccggcgtcggtgctgcttgtagcctcaccgccgctccgcctctatcgtcgaccccgccgcgctgacgagctccgtcgaccccgccgtgacgacgagccaccgccgcctcgctcgcatgagtcaccgggaaatccgccgccgccgccgaattggggattttggggctagggattcaaccctagccatccgaatcggataaggtgtggctcccctttgttgggctgcaccgtgggccaaggccattagcaggccaacggccctgacgggccggctactaattccttgaatggccggttcatggaggtgggccgaaaaagattttggcctataaaaggagtcgggctcgaatcgaaatttgccccgaaaaacggcaaacttccgaatattttctgatttcatgcggatttggaattttagcggaataatccctcgggattatagaaattacggggaacactataattttggttattctgcattattttatgccgaaacagagaagatgtttaatgctttttctttgtcttagccctcgattttctatgtattaagtgttcattagttaatttttgaatcaaccatagaatcctagagacatggtttttaggaaatgagctctcataatttgaaatttagtacacaccagagagcatcatatttatggtttattttccaagctgttttattttttcaggatactatttaatgggttagtaattcagtaattactttggtacctaaataaataatagtacagcaattctgagaaatgttgggagaattatgggaatatattgacacagtactaaatttagataaccagacaatttactatttgcacacttgtcatgctcttacttgcagtacttattgaattttgcatgactaatgtaggaaaatgactgatattgctaagagagattttgctgaactagcagtcagcggcaagaattacctgacatgggcactagatgccaaaatcatgcttggtgctaagaaactcctgaactgcattcaggacccaactattgcaacatcagctggaggagttaataatttaccaacttcagccgagaaaaatcaggcactgcattacctgaggcaccatttgaatactactctcaagaatgagtatatgactgaggaagatccgaaggtcctttgggactcactgaaggatcgctatggccatcaagtaaaggctttgctcccaaaagcaaaacgtgagtggcttcacttacgtttccaagattacaaatctatggagcaatataactcagttcttcaccgcattgtcacttgtcttaagctatgtggagagaaaatcactgatgctgacatgatagacaaaactttgtccaccttccatgccaatcatgtgaatattcagaggcaataccaccaggctaaatacgagaagtattctgaactggtctccgtgctcatggaagcgcaaggagaagatgagacacttgttgaaaatcatacgtctcgccccactggaagttcagcagcacccgaagcaaatgctagctcctttaagaaggggaaaaaccagaataaccagaacaaagggaagaatttctggaaaaatggtggcaaagttaacaagacatctttcaagaagaaaggaaatcagaacagtaagtctaagaagggctctactagtggtgaatatggaaagcaagatcaggtatgcttcaagtgtggcactaggggacattggtctcgcatttgccgcacccctaagcatctcattgagctttatcaatagaagcacgggaagaagaagtcagagcatgagtcacacttcactgttgagatctagaactcagaggagaagatggctgccatgcatatcgacaagaaggtcgacgagaaggcagtggttgcaatgcacatcgatgataagatggaacataatgcagcagacacagagctgaagctctcagatgatctcatggactctgatcagttatatggggacatttaagtcttccaatttgtatcttagcttcctgcattacaagttactttaaattttagactatgtaatagactaaagttaggtgatttttcaagtgtgcatttagtttgtgttcctagcagaactatagtttctgtaagctccttcagagcatggttatcttaataatttagttaactcttttagtttaatatattctccagatttttatttttctatcttaaagtgttatttttactatatggtcatgaattgattatatttaaatgctttatgatagaacagtgttacgtactatggcaatggaagaggagatgtgtctagtagactgctgtaccaccaatactatctttcgagataccacgtatttccagactttaaagaaaaagactggtcaaatcgctaccattaccggaagcaatgcacacatcgtcggagtgggacgagcaacagtagttctcccacatggtaccaagatcattataaatgatgctctattatatccagagtccagtcgtactctactaagctttaaagatatccgtgctaatggttatcatgtagaaaccaaagatgagaataaactcgaatttcttctcataacgaaattagacggaaatcgtaatactgttgttgaaaaactccattccttgaaatctggcctgtactacactcatataaaacccgaaaatgttgcactgaaaacaatatttaaaaatcctgagtcatacagaatatggtatgacaggttaggacatctaggtctagggatgatgagaagaatcatctcaacttcaaatggccataatttacgaagtaacgatttcccaaaccaagaagattttgtttgcactgattgtgcaacagggaaattaatcgttagaccctctaatttaaaggtgaatgccgaatcaccagtattcttgcaacgaatacaaggagacatatgtggaccaattaatccaatgtccggatcattctagtattttatggtattaattgatgcatcaactcgatggagcattgtttgtttactttctacaagaaaccacgcttttgcgcggcttatttcccaaataatccagttgagagccagtttcccggataaccggatacaatccattagaatggacaatgccggggagtttacctctaaggtatttaatgaatattgcatggctttgggaattaaagtggaacattctgtaccacacgtccacacttagaatggtctcgccgaatcattaattaagaggattaagcttatcgcacctaccaactacatgttggggacacgctgttttgcatgcagcggcgttatttcaaatcagacctactgcataaatgctgtatcccctatgcagcttacacgtggatatgcaccaaatatttcccatctgcgcaaatttggatgtgctgcatacgtccctataccgccacctaagcgtacgtcaatgggtcctcatagaaaattgggaatctatgtaggatttgaatctccgtctatcattaaatttttagaaccattgacaggagacctacatatgggtcgatacgctgattgtatatttaatgaagatcatttcccggcattagggggaggaaagtacctacagaaggtcgaatgccgcgaaattgagtgggaaactaaaaatctcctacatttagatccacgtactaaggaatctgaccaggaagttcagaccataattgatttgcaaagaattgcaaataatctgccagaagccttcactaacccaaaggggatcatgaaatctcatatacctgctgtgaatgcaccggaaagagtagaaatacctcatgacgcagaggaaccggttttcaaattaatttctacatctaccccaacttttaggaagagggggagaccaccagttgcacacaaccaaactaaagtttctaggagacgtccttcgaaacaaaagattggacagaataccacagcactagagaatagtgaaggagctcaccaggtagatgagccacctacagtgatatgcccggatggcaatgaacccaatgagaatgcgcgcacaattgcgggaaacaatgaagatcaggaatgtgaaagaatagaggaaatatccaccaattatgtggatacaagtgaaacatacaatagagagactactattgttgacatatactttgccggaaagatcgctaagatcattgatctggatccagaaccaaagtccatggcagaatgcaaaaagcgttcagactgggtcaaatggaaagaagcaataaaggcagagttaatctcgcttaataaaagaaaagtattcggtcctgttgatcgtacccccatagggatatcccctgtaggatataaatgggtgttcgtccgaaaacgggatgagaacaaccaggtggttcggtataaagcgagaatagtagcacaagggtttactcagagacctggcatcgatttcgatgaaacctattcacctgtaatggatggaattacattccggtttttaatatctatggcagtcaatttgaacttagaaatgcagttgatggatgtagtgaccgcatatttatatgggtcattggattctgaaatctatatgaaagttcccgacgggattcaagttcctgaagaaacaaaacgcaacatatatagtgttaaattgcaacgatcattgtatgggttaaaacaatccggtaggatgtggtacaaccggctcagtgaattcctagaaggaaaaggattcatcaagaatgatgactgtccctgtgtgtttatcaaaaaaatcagaacatggattttgtattatttctgtatatgtggatgatctgaatatcatcgggaccacacaggtgattaaggaagctagttcttacctaaagacggagttcgagatgaaagaattaggtaagactaaatattgcttaggtctgcagcttgagcacactcctgaaggggtattgttacaccagtctgcatatatccagaagatattggagaaatttaatatgaaggattcatatccgacgagaacccccatggtagtaagatctctagcagtagagagtgacccatttagaccacaggaaaataacgaggaattattgggacctgaatgtccatatttaagcgccattggagctttaatgtatctcgcgaatggtaccaggcctgatattgcatttgctgttaacctacttgcaaggttcagttcagctcctaccaaacggcattggaatggtgttaagcaaatcttccgttatttacgtggcacacaatatctcggtttattctttagaaaaaatcaagatttaaccatggtgggatatgctaatgttggatatctgtcagacccccataaagcattgtcacagactgggtatatgtttctctgtggtggtacagccatctcatggaagtcgacgaagtagacgatggtcgcgacatcaacaaatcactcggagattatagcattatttgaagcgagcaaggaatgcatgtggttgaggagggtgatacaacatgtacagaatacatgtgggctgaatatcacaccaactccaaccattatttatgaagataattcagcttgtgttgcacaaatacaaacgggttatgtgaagacgagtctcactaaacatatatcacctaaattcttctatatgcatgaattgcaaaagaaagaagaaatcaaggtgactctcaccaagactagtgaaaatcttgcagatttatttactaagtctttgccaactagtgtttttgagaagcttgtgcatggcatcggtatgagaaggatgagagatgtgcccaaatcagggggagcacttccctgactgtattccgttgatattgatcatgcagatcagtacatcattcttgaagaatgatagagttatccagtagattagcttatggttgtactctttttcccttaagtgagatttctttgaagtttctcacatttaggtttttaatgaggcaacagtgcaatataagtagcatgtactatgtactctttctcctattccttttctcccactgggtttttggaaggagttttgatgaggcatatatataacgcggtattcgcccaaatgggagtgttatgaaaccgatctcccgaaggagtcggatttgtaggaccgtgatcgtgaggatcacggtacctcctcctccttcttctgtttccttatgaataaagtgggcttataccaaatatatatgtatgtatccatatatgacatcctattgtgggtataaaaacaatagtgaggttgagggtaaagtaatacttgtaacagagagagaaacatcaataaagttaattgccctccactttcgtgtccgtgtgttcgtgtgtgcttgttcgattgttgacaacgtgaattctaacaactagcacaagcgcccccccaccccccaggccactaatgcgcacccctagtccactgttcactgatgtttctatatatacgtataaactttatatatatttatataaattttatatgtatgtatataaagtttatatatatgtatgtaaaatgttatataaagtggttttttaaatcataaacactttattaaaaaataagagtttagataaataatcctaggacatcgtcgaataaatcagtttaaagcattagaatcaaaagaacagctaacaaaactaacgaaacaaacctcacaatgaaaccaaacaaacagtagatgagcaaattgacaggggatctgcggcgttgccacagagttacatccttggcctccttttgacatgcactccgcttgacaaatcgatgaccaccttctgctgccaccataggaacaaacatagctttgctgatgaacagtagattttcgtgtgagcttcactagactcagcaaaagcatatccatggagtttgccattgaatatgaggatctcagcctgcaatcctgccaaccaaagttacacatttgattcatactcaacccgaacgataaaccctctatggttactgctgctaggagacaaatagggctatgatttccaatagtgaactccaaaatgaaacaagcccgacactacataatggcatgagaagagaagaaattgaagaaactctaacataacctacttaggggtgggcaaaataagaccgaaccgaaaatcccgagactgagaaattcagtcagtagttaggtctcaaccaatgaaagactgaaatttattcggtcaattttgttagtgacctcggttaaacgaattgatcgatataaccgaattttgatatgtgatgtaatgcatgtcatgtgaaattgagaactaagtgcatgatgcttttggtttattcttgctacttgatcctatcttttgatatttgtttggtgtttggtgttgcctattatcttgtatttttgtgatatataactgtcaaaagttgtctaaaagaggttcagtgctgtcaaaatttatcattgcaaattttatctcctggaactggcacagttcggttaggactaagactgacaattttgcgttgttatttttcttcactttttaatgaccgaactgacaactttgcattgttatttggacttcacttttttatgaccgaccgtgaccaaaattttcgatcgaactgaatactcaccctaaacctactgacgaactatgcccaacccgaaaacctaatctagtgaggaaggtgttggcaacttttttgacaagtcgacaagcacgatcgcagcacctaaacgctttgcggtgatatggagtcgccaaccacctcgatctagccaaaaggccaaatcaagatgggtttttgtagaaaatagctaaaccggctatcggagccgatttagagatcaaaatcagcctctaggccgatttagatcgatatgaggataaccacccgtctcgtgggaaaacagaaggttttcaggacaagcctacaaagaggtgtcacactctcgcagcggtggcggacgttttacgacgcaaaccgacaaagatggactaaaactagggtaaagtagaaaacatggctgaaaagtaatgataaaagaaaaggcgattcaagtagattgtatgtttggggtattacaattgaaccggtcttgtctcttaaataggggttagtctctctctacatgcctttctccatgtccaactcaggatagaaaccaaaagaaaactcggaacatgccttcccaagcaaggaaacccgagacccaataaaaacagactcggagcagacccaaagaaacccaaaacatgcctttccaagcagacccaacgaaaacagactcagactcggaccctaacggtcagaccggccacatacctgcggtcagaccggccacatacaagcctccgtctcagtaaccttactactttgctcttgtttatctttgtttatctgtgtagatgtttgcttaaggccaaagggtgtaacttgcagggaagttaaaaggtccagacgatttaggagaggttacattcggttaaatttcattatacgagagtacgagacaatcgccaaacagaatatatcttaatggctacacataaattgagccttacatgcaaagatcctcacgggaacacacgctcatcattctaagataacaaaaaaaaaatgactaatgcttgtataagcatacgcatgcatagtcctcagcaccatgtctcaggcacacagacaaaggccacaaaagagaaacagaacaactgttttcgtcgattccaggatccagagaatgcagtacgtattaggaaagaattgaactgctaaacatgaggcattcatcaaatcctatgagcagcaatatatgttttgtagcaaaaagctggtagaatgtgtagtaaggtattggacaggttcatcacaacatgcccacgggaacatcatactgcaaatccttgtgcaaaacgaccacaggttggggtaggtacaaataatacggagaagataacgatggagtgaggtatcattacaaaaatattgggcttgccgaagacacctaacaagattgaaacagtgttcgtcctacgtatgaatgagatacatgcatagctcctagtcagctcgaagttttacggtcggagttccaagcctcaagcctgtgcacaacagcaaagaaaaggccaaacaagtatatacattagaactttgaacaggaaacaattttactagcctattatcggaataatctccagaaatgacagaactaaaatgataatgaggtaccttgctagcaatgttgctggacagccaatccaggccctcgtacagaccctcaccagttgtggcacaagtgctctggatgtacctgtgaggaagaaaacagatttagatcaagaatataaaaccatgcgtcgcattctagtttctagatgcaggatataatgaatacaagagtatccaagggaaaagtgaggcagtgagttacatcaatggtaaaaaaaaactatgaatcacaatccagatgcaggatacaatgaatttaaaatagtattgtattcgcttattggagagcttcaagctatatccacagcaaaaacaatatataagggcaagaatccattggtggtccttatttaccagtgtcgctggcgaagggagtgcagtc

SEQ ID NO: 81283 - DNA, 642 bp, Oryza sativa
aactattataggccgcatgcaagtttttctcaccgtattttaggaaaaagtacaccgaagatccctcaacttgtcatcgaattacaaaatcgtcctccaaccacgaaaccggatacaacgcatcctccaacttacaaaaccatacaaactaggtccctcggcagttttatccccggttttgtccgacatggcggctggctcagcgtgggacctacatgtcaagatgccatgtcagcaccctctctcttccctttcctctccctccttctcaatctcacttttctccttatgtgtaagcagcaagctggccgatgggtggggaaaggtcgccggggtgaggcaggagaggaggaggcggcgggtgatgaggtgttgatgaaaaacacgagccctgggaggtctgcttaactccagtgcagatccaaaactcgccttcgggtatgctagcgtgccaattgatttgatcctgccatccacaagaaataaagacaaaaaaactgtgggtaaatccataaatgatagtccatcggctaggtgcccatgacatatcaatttatctttgagcccatgttaaatatgtatcgatccgcaggttttaaatagatattaagaacttaatctattcaatcggctgtagatatt

SEQ ID NO: 81284 - DNA, 17931 bp, Oryza sativa
ttctcgcctgtctctcagttgttttgcttttctcgcctttcaaagtgcaatcttcttgcctgtgcagctatttgatcgatctggatgtcagcaaggcagagcaagtgctgctgcaccggaggattctcccgactgcgccgaccctgaaaagcgcccaatcttccatgcccgctacataggggtagactctggatcaactccaactgaaaacggtaatggtgggggctttctccctatcaatttgaggtataggtcaccaactttccaatgcttttatatatatatatatatatatatatatatatatatatatatatatatatatatatatatatatatatacatacatacatactttactagttgaggacacagttgatttcagtggagtgtatgtacctttcttttcgtgttcggaatggtatctctttgtccaaacaaaaatgcttcttcttctgtaaatatcaagccaacttatcagtatatctttcgtgttaacatcgattgtgcctgtgaatattggacagagatgatgaattcacagaatccgagccatatgaaaggatgatggaagacctgagtctagagagaggaaaaggtgtggatgacttcgaagccagttctgcaaggtatttttgttactaagctgttgtgctgtgcgaatgacatatctataccataataacaatcaattaatccggaacgtcagtttcaggtttcaaccatctggttcgatctaaaaactgcaagaatgcgaaatttccatttcatttgtataaacatagattatgtttccagaagggtgctaacttgactgaaaggttgttctgtccataaaacaacactgtgttcctctttggtacaaagcttccgtcatgatacttaagagcaacctttatagttggtgttactgctccccgcaaaaaaaaatagttggtgttactgcagttatatgcaatcaggctagttgctctaatcagccttgtttgaattgttgagttttgtggatatgagcctttgctctctacatcggtgcacaacagttctcatataattctttgaaatgattagtaacgtcttctttgcctattctttttatatggacttctttctgatatccagactagtttagcactcatgtattatatgctttcttttcgtgaaccattctcttaatttgcctgagcaatcatctttaatcattttttacatgatttgtccataaccattctcttaattttgcagaagggactcgaaattcgtccgtgttcatgaaattattttttcttccatagacaagccaaagctcctcagtaaggcaaggccatgtactttgtgatttctatttagagacctccatacgaataccacaccttcttgtgtcaccgcttgaactgtgagatattgttttacagctatccgcgatactgtctgatattgggttgaacatccgtgaagctcatgtgttctcaacatcagatggcttttgtctcgatgtgtttgttgttgatggctgggatacagaggtaaacttagagcatcgtcatggttatagcttatttttttcacacaattacagaactctacaaattatgtttcgaacttttaatcatgactacttatggtgggaaaccataaaattagataatcagattgttaagtacactatgcttcaaggtgttccacaaattaaaacattgcctaacactatgtgcaggaaacggatggtttgcttcagaagcttatagaggcagaggcaagcagccatgtatggttcttcctatttctccatttaatcaacacgattgcttgaaatttaaaggtgtcttgctggttaggaagtcaacatgcttgcaagttacctcctttttgcattaaatgcagtcctgtaaatactctcaagtcagcattacaagacttgaagaaatgaatatgccatccctatccttttcctttacagaattgaacttcttgtatgtagggctcattgtctaatccgacaaatttgtcacaatcagagaaagttctagagctgcaggaaaagataggagattctgaattcgacaggagtttgctgcaaattggggagaaaattgcatccggatcttctggggatctgtaagaaacatgcaactcttattacttaggaataatgaatattaggaaagaacggaggtagttatttagaacaacaggtacaactcaactgctagtgtggattgcatgacctttcttacatctgtttacaagcaaatggtttcacaagggggcactatcaacaaatagtcacaaagctagttgtgttctgggtttctgatttcaacttgtggagacatattgctgtgtgcattattctatattttttaatgtttctagcaagatcagcagttcattaaccaagtggtcttgtttgtatcctcggctgcagatatcgaggaacttatctcggtgtggatgttgcagtaaaatttcttagatctgaacatgttaacgattcttcgaaagtggagttcttgcaagaaataatgattttaaagtaagctttcttttgaaatcactttgatgcatagacttgactttgaatcatttaaaattccagataattctaatacagtgaagtcatgtccaggagtgttgatcatgaaaatgttgtccaattttatggagcttgcacaaagcatcgaaagtatctcattgtaacaggtgacacaaatattgctgataatcttgcctgctgatttttttcgtaggaatcaaaatccttgtttctcaagattcagatagcagtgcttgggcatatttacaatctgagtagcgttggtggctaaaagattgagctcatgtctgggtataaccaatgtgcttggtttttcatctccagtttccttggcatctaatgtaaataactgttgattgaacatttttagttttgcattttggtgagcgtcattaggtggaattgttaaaaacaaaaaatctcgaaagacgggggataactcctgtcttttatccattttggtagggacttcaagagcagctaagtctataggagggatactgtaaccattacatttgcttgttgcgtccatgcataaagaattctacaccatgatggaaaatagtgcaagatatgtctggtcagaagaatattgctactctattcctatcaacaggtctctacccacccttcaattagcctgtgaattactactttctaattcatgcatgtgaaataagtcttcgttcctaatgagcacacaaattttcattttctaaattaccagccaaatttctgtattgtttacacatcacatgagtatttttttctattattgtattgcaaggcgatgagttctgggcccctagctgcaaagttcatatcagactcatcctgtatagcacctataaataaggagatgctatccatggatttataagatacatgtatcatccacacgttttaacttgacattagtttattgagattactcccattgcataattgattagcagtaaggtattggttgtccaatcttgctgttaattaaatatttagatgttttgaagagctttattaggagggtgttaattcattttactgcaagtgaacttgtgttcagaatcccaactaaactcttttctagtcacttaaaaaaagatatttgtgcatcttctttactgaatcatcgtattcacatgggagtttggttcaaatatttcgtacagtctagtctttatttattcagaagatgacaagaattatactttttttagataatggacaagaattgcatggatagtaaataaataattacttatgtacaatactgttattctgttcccttgtcatgccataggatttcttacataatatcaagagccagcgatctagatgagttaagttagtagtagtatcattgtagccatgagatcatttatatatttatcttactgcttttttagggaaaaaaatgtttgtatgtgtcagttccgatttccaactttccaagggtgcactctgttttcttgcttcaatcccacaaacgagcataggccatggattgcttgtttgtatttttatgtattgagttttccgaattgatcaagtcagctcaatgtagagcatttatctatctagggtatctattatcgggcaatttcttttctgcgattatttcatgtcaactgatattttgctttgttatttgtgtgtctcatccagagtacatgcccggaggtaatttgtatgacttccttcataagcaaaacaatactttggagcttcctgttgttcttaggattgctattggtatctcaaaaggaatggattatttgcaccagaataatatcatccatagggacttgaagactgccaatttgctaattggctctggtcaagtatgcatattgtttcgaagttgcttatcaattgaaggatgtcgaagcactgattcaattcttaataggtcgtgaagatcgcagactttggtgtctctcggctccgatctcaagggggagaaatgactgctgaaactggcacgtatagatggatggcacctgaggtactatgttgatccttttgttccttatcctctggtgtcccttttttccctttattttcctttctgattactcgataagacttttgtactgcaacagaaagtcttttctgtttgctaatgataagttcagtttcacaagcccatttcaccaggcttaggcacatatacagatgcatgatgcactattttactgttttcacatgtatgcatacacagactacctgactatgctgtccttgcaagcatgttggcttacatattgatcacgcttgcatttacttactgcactgattttttggatcagtgtgcaaaagccatacttagaagagttatgcaaagctaagacaatatgcatgtgcaatgtacttattagaatcgcgtgtgttaccaggtaataaaccataagccttatgaccataaggcagatgtcttcagctttgctattgttctatgggagttggtcactacaaaggtaacctgtggctggcaaggcattgtgtgacgttttcatagttctcaatttttttaacagcagtgaactatggtcagatgtaataaccactaatacatgtgctatgtagataccatacgaaaatctgacacccttgcaagctgcactgggagtaaggcaggtatgtatttgatgccaataagctccaacataacacattggatgttaaaaaaagtaaataatattaacaaataatggatgctcaaggatgaagggatgactgtaaacattgacccttatttaattattttagggaatgcgcatggagatcccaccgaaggtgcatccgaggttgtccaaactgattgaacgatgttgggatgaaaatcctcatgtgcggccccttttctcagagattactgtagaattggaagatatcttacggcatgtcctggtaaatttctgaactttgtacactttaggtttaatgaaacgacgatcggaaaaaaataatgaatttgaagtatctaggttcatgcttgagactgctgaaaagctgcatatctgttgtaggtttccaagacaggaagtcgacatcccaaagcaaagatacaaaagaaatcggcgcgatagagaatacatgggctccttgtgacctttgtgaaaacagcttagaggttttcttcaaaactaccaggctactgtttgttgctagcacggcagcatagaaatgattttgtatatatgtcggatgcttgcatgtataatatttttttactcacacctgattggtatgagttttctgttttgtcatataatatgtgtactaaatttagaagaacgctgaacaaggcggcagccactgggatattttaatacagctctagtttttgtgtttccagcctgtgcaattttggctcatgtacatccggcaataacttagttgagacttcagaacttcagatgaagaaccatatctcttttgctgaattccattttgatgcttgtctataggattggagccaaattgttggctatgcccaagcttaatttggtagcatcccaaacccttgtttatactctagttagatttggcacctaactggaagcaattcaaacatattaaaaactagttcctctgtttcataatataagtcattctagcatttttcacatttatattgttgttaatgaatctagatctagattcattaacaataatataaatgtgagaaatgctaaaatgacttacattgtgaaacggagggagtagtatgttttgacacgggtaaagaaagaaaatagcagtttgggctgggcctggcccagttagttgcttgggccaaaatctgatgagatcgaaaactgaggaggaaaaaaaatccaatccatccatttcctttccagtggtttcgcgatggcgagcacgccggagccggagacgacggtgggaggctacgagctgcgggagcggctgggcggccggccgccgtccacggtggtgtggcgcgccgtggagcggtcgagcggatcccccgtggtggtgaagcaggtgcggctgactggcctccccagcaccctccgcgacagcctcgactgcgaggtccgcttcctcgccgccgtcacccaccccaacatcatccgcctcctcgacctcatccaggtctccttttgtcttctccatcgtcttcttcttcttccttctctaccaatcctagtgaatttttctccttaattagacccagagcaacctgtaccttgtcctggagctgtgcgagggaggagacctggcggcctacatccagcgcaacgggagggtagaggagcgcgtcgccagcaatttcatgagacagatcggtaattcacctagtaatatttgccatatcaatttcatttctagccctagtagcatctcttttctcttgttgccccccaatctatcacattacccgcaaccttagttagttgtgttacaaatttttttttttggatcaaagggccttagtcctccatttccattaagagaaatgtcacagtttacagtagagttgtgttacaattacaacaagaagataatcatgtgtaagaaattatgcttgcccaacaccttgtggtaggagctggcttgcaagtgctccgcagacaccatatcgtccatagggacttaaaacccgaggtccacaaatctctctcttttcatctcttaattacttgtgttattaagctctaactgatttgagacaccattgttgactgataaaactgttgtatgccgcagaatatcctgctctcttctcctgacagcaatgcgatcctcaagatatctgattttggcctgtcaaggtacactgctcaacatacataacctgtaggttgaggttactcagtctttaaaaagctgtattagttgcaaaaggcatcgtgctactcataagacaatctaatccaaattttacttctggtctctagagttcttcgtcccggggaatacacagatacaaattgtggcacttgtttgtacatggccccagaagttatgctgtttcagaagtatgatggtggggtatgttgtatgtactcacatggctaactctctttgccacacacacaaacgggagaaatctgaacatatgtatgttgtgtgcaggtagatttgtggagtatcgccgcgattctcttcgagctcttgaatggctatccaccattccgtggtagaagcaatgtccaggtggctactagttctctcttcaaccttgtttatcttatctaaacttcaataagttctcatcacagatttgtctctgcagctgcttcaatgcataaaccgaaccgtgtctcttccattctcagaagtcgttatttccaagctacgtcctgattctattgatatatgcaccagacttctgtgtagcaatccaggtgcgcctttgatcttgttacaacctctcactgaaaatatggagagtgcgaagctaacaaatttccataattgcttccagtgaaaaggttgtccttccaagagttcttcagccacagcttcctcagaccatagacgccttactgaagagcctatgcaagcttagcaatatcatctgaagttcaggattagttgaattgtttgtttgttgtacttggacatatgcaggtacctctttgtgttcaaaaccttgttttcctgtagtcttctctgtagcctgtagactttttacacgaaaaatgtgaatataagttgggagttctgtacacagcaaccaaaatgcattttcatatccactgtttgtctgtgttgaaacccggtctcctatccaaacatttcaagacttcccccccaatccactgttctgttgccaaaaagacacgaatattagggaatgacctaatattaaataactataaggggtgaggcttcgaacccaaattgtctagctcaccaccttgtggagctagctggaagatccctcggcgtttctcactgttctgttgccttaaaggtattttccgcatttgcaatccatctccttgctagcagcaatgatcaggagcagtgccattcctggaccttcagattcgggcgccgtgttgatgtcgcgtagctgagagcgattgatctactggggttccttccgatggagcggcggaggatgatcgccgatctgctcagggcgagcgcgagaggctcgtccctccgcggcggcgtccagctccacgccgcgctgatgaagctcggcttcgggtcggacaccatgctcaacaacaacctgatcgacatgtacgccaagtgcgggaagcttcacatggccggcgaggtgttcgacggaatgcccgagaggaacgtggtgtcctggacggcgctcatggtgggcttcctgcaccacggggaggccagagagtgcctccgcctgttcggggaaatgcggggttcagggacctcgccgaatgagttcacgctgtcggcgaccttgaaggcgtgcggcggcggcacgagagccggtgttcagatccatggcgtctgcgtcaggacggggttcgaggggcacgacgtcgtcgccaactcgctggtcgtcatgtactccaagggccggtggaccggcgacgcacgccgggtgttcgacgtaattccctccaggaacctcgccacctggaactccatgatctccggctacgcgcacgccggccaaggcagggactcgctgctcgtcttccgggagatgcagcggcggcacgacgagcagcccgacgagttcaccttcgccagccttctcaaggcgtgcagcggcctcggcgcggctcgcgagggggcgcaggtccacgcggccatggcagtcagaggggtctccccagcgtccaacgctatcctcgccggagcgctcctcgacgtgtacgtcaagtgccaccgcctgccggtggcgatgcaggtgttcgacgggttggagcggaggaacgccatccagtggacgacggtgatcgtcggccacgcgcaggaggggcaggtgaaggaagcgatgtgcctgttccggcggttctggagctccggcgtccgtgccgacggccatgttctgtccagcgtggtcgccgtgttcgcggactttgctctcgtggagcaggggaagcaagtgcactgctacacggcgaagaccccggccgggctggacgtgtcggtggccaactctctggttgacatgtacctcaagtgcggcctcaccggcgaggctggacggcggttccgggagatgccggcgaggaatgtggtgtcgtggacggcgatgatcaatggcgtcgggaagcatgggcatggccgtgaggccatcgacttgtttgaggagatgcaagaggaaggcgtggaggccgacgaggtggcctacctggcgttgctgtcggcgtgcagccactccggcctcgtcgacgaatgccgccggtacttctcgagaatctgtcaagaccggcggatgagaccgaaagccgagcactacgcgtgcatggtggacctcctcggccgcgccggcgagctccgggaggcgaaggagctcatcctcagcatgccaatggagccaacagtgggcgtgtggcagacgctgctgagcgcgtgcagggtgcacaaggacgtcgcggtggggcgggaggtgggcgacgtcctcctggccgtcgacggcgacaacccggtgaactacgtgatgctgtcgaacatcctggcggaggccggcgagtggcgcgagtgccaggggataaggggcgccatgcggcgcaaggggctgaggaagcagggcgggtgcagctggacggaggtggacaaggaggtgcacttcttctacggcggcggcgacgacgcgcacccgcaggccggcgacatccggcgcgccctgcgggaggtggaggcgaggatgcgggagcggctggggtacagcggcgacgcgcggtgcgcgctgcacgacgtggacgaggagtcgcgggtggagagcctgagggaacacagcgagaggctcgccgtggggctgtggctgctgcgcgacggcaccggagacgatggcggcggcggcggcggcgaggtggtgagggtgtacaagaacctgcgggtatgcggcgactgccacgagttcttgaaagggttgtcggcggtggtgaggagggtggtggtggtgagggacgccaacaggttccacaggtttcagaatggcgcctgttcttgcagggactactggtgaccatcaccatctttctctcaattcaattctacttgcattaccgaattctgaattggagcgaccgtgagaggtagcatagaatgtcatgtacacaatccccaatttagagagtgagtagctctttgacgcggaagacgtgtaaaagtatcatatggttcaacaaaattttcagaaaccgaccttagctcagttggtagagcggaggactgtagtgtttgcagataaatccttaggtcgctggttcgaatccggcaggtcggatagtttttttttctctaacaacttgttcctattgccaagttttcggcaatcctgaagatgctactgctacaccttttcttttggcctgttcttgggaaaacgcgtagtatcagttatcacgaaagtctttctaccataaaattattagtggtatttttttttctaaaaaaacactcatctaaaggattcagtgccaagttgttgttcaagatgtgcagaactccccgtgtttttttcttggattgtttactgccggcaacgctggctgtagctcctagcttgatggatcatcctgccaaggtgatgatgggctgggccttgattgcaaagtatcatctgccgcagcccagttccagcgaccaggcccaaactgggccatatcggttggtttttgctctctacgtctccacggctcgaccagattgtcgtcagtcaccgtcagacatggctccggggaagcaacgaggcaaggccaaaggggccccaccgccgcccgccgcccccaacgccgccgccgccggaggcttcccggcctgcctccgcctgatgccgccctccaccgtcgccatctccatccaagccaagccaggctccaagctcgccaccatcaccggtccgtccccctctttcccctcctccctgaacaccaactttcgccctttacttacttcatacgcgcatccttcgattctgcagagatcggcgacgaggccgtcggcgtccagatcgacgcgccggcgagggacggggaggccaacgccgctctcgtcgacttcatcagctccgtaagtgctttcttgcttgctctgcttgtggattttctgattgagatcaattttagttggcatgatgatttatactccagtatggttgtatgcataggaattttggatacagcaaggctctcagaagaaaatacaccatataacttgcttaaaaactacatcatcatatttgtctagtctggaaagtgagacgtggttgaaaactcccccttttcagtcaagattcaaacttcacattaactagtgctgatggaatatgtagctaacgaaaaaaaacatgcctcaagcagtagagagcattgtttccacaacgtctgtaaatgtgcacttctgctgagtttatacatcctgccacaattaattctttcagcggttgaaaactgatagtacatcttagagatgtgtttcactatcgaatacttgaattaactaggtttgccattctatatttctattcatcttctttgccctactgttcttgttagttttgcttatgttcagcgagttgtgttacttcttccaagtagcctatgatatcattggtttatgtcggggtatttggattttggagtgtccactattcagtttaatactctaggctctacaatttttgcatcgcgtaaatggtttgctttgcgtttggttttagagcacagaaaacaacctttttctttacaagaatcgatgcaatgtcatcactgtttagagtttaagtgtgctgaaaaaggtggctcagttccaaattgctccgcgtggagcacatgaaactgttcttcagaccaacttgtctcagatttggtttccaataacattgttttccacctgttattgcagtagtataagagatattcctgatacatcattaacccacttcatcgtgtcaattattatcatcctgagcagatcattaccgtccatgctccttgcacggttgcaccatggtttatattgtttttgctctacagatccttgcattatatctgttcagataatttcgatcttattcattctccaaaatatgagataaaaaacggagtctgttattctcgagacttggttgagaatgtgtgcttagtctggactctggagataggttctctaatcaaaagagttattgtacatttcatcagagacgttgatacatatatcggataatgataattagaacagatgtttccagtgcttaaacatttttttagctgggttagtgcttaaacatttgatgttgtatttctatggatcacatcagaattttgagaacctacttgacatattcaggtacttggagttaagaaaagagaagtttctattggttctggctcaaaatcgagggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaatttgcctagcgagtttacaagatgaaaactttggtcatcgcatattttatcacgagatggtggtacagcaaagggcaaaattatgagagctggtttttagtttgatatgctaaaactctctctcatgatttacgctggtgactctgcgttgccactctcaggtacaatctgatcctgatatttcaatcggattgtacctttcgttttcaaagcatgtccagtttgggcgtttggagttggaccttttggatgtcgaatttgaaaacaaatgacagcatcatttcagaacgtatgtcttcttttttggatccggtaagaaatggactgatttgtatgattgtttgcatactaagggcccctttgaatcgcaggaatgagaaaacataggaataggaaaaacgcgggattttgataggaatgtaagtgtaaaacagaggattgcaaaacacaggaaaaacacaggaatggtcgtttgattggaccgcaggaaaaacacaggaattagaggagagataaagactcaaaggaaagtttccaagaggttttacctcatgttagaattcctccaaaacttgcatggcattaggcaatccataggattccataagatccattcctttgattcaaatggctatataggaaaaattcctataggaataaaattctctaaaattcctatgaattttctttgaatcaaagggggctaaacaggccagatttaatttcgtcgagtatggaattcgttgaggttatttcttaatcggcggcccccaactgaaagcctaccaaagaagctagtatagcaagttgggcactagctggaaacttttctccatgaaacacgcaggacctcgacctgtttgggcgacacgtacttgttgctaacttaatctaagtgtaaagtaatcggatcggacttcgaacatttcgtggatgggtaatgggattgcaagttccacgatgggctcgatggtagatactgtgtgccagctgctcgagctgttggattccaaaggtactccatttgtgatctaccactagcttctcctacatcggttggcgccaaacattggtgtaaaataggggatcaggctacaagagcgagagaaatgtttgatgtttgcttgctgcttggcttgctcgtcgtgtgctttgccttggcaggtactaggtgcctcgagattggggcacagtgcagatagcgccccatagggcatgcattgcatgggccatggtgcctgcagtacatgtctcatgattggatggatggtcaggtggtttgtcttgtacgaatacgcgctgtctttcgtacagtgcccatctattccaaaatataataatagtttatgaatttttacacattgattaaaaatatatgtaaaattaaatagaaaatagttgtgaccggttgagatgataaagttgttgaataaattgttataatctaagataatattttaacgctagaagttactactccatccgtcttataataagttcagttcattttaagctcctttcagttattgtaaaacaaaattattttttaagtaattattacatcggagtttgtgaaagtaaaaaaataattgtatctagagtaaataatgtggggaatatttgcattatttgataaagtagggtattctagttcttaggttttgtattgatatgtacggaatgtatgagaaatgaacttgttttggaactggggaagtacataatagagtacattaatacataattaattgcatcaactgaaggaggaaagcaatctggaataaagacatgtaaagtattttagctcgagtattcacgatcgatgagatccagtcaacaaacgtacgtgcatgcatatatgcatcctgttgttgatagcgatggtgagcagatgagggaggcatgatgatggaacgaatattcttgcgttgcgctcactcacgggagagttgctttacgtcaagttgcaagagtttcatcaatcgtttccgaattcagagtaaaatctatgtgtgtcaatcagccaattgtacttatacgtgagaaccgatatgcatcataccaatagcatatatgtaatggaacacgaatctatagatcgaacggagtgccatgaaaaagtttaaaatgcatgcatcgagtcgtgtatatataatccatgttgcaggttataccggagatggaatttgcaattttacattggtcaagtggtgagagtgtcgagagtcacgggtacaaggcgtcgcgtgcatgcaaattaaaaaccagtccaggccgatcgacttggtagtagcagtaagagcatgtacaataggagactattaatgagatacaagatgagagagaaaagcagtgtgctacatatttataaccagctacagcacggactcaaaggcacaatgtgtgtatgacaggtgggactatatattaatggtatagtagctatagataaattggagctagtattggactatactattaaatttgctcttaaacggcaacagtatttatgtggtcgctgcgctgttggattgcatttctcgatctgcatggttcattggatgggaacacagccggagatatggacaagtaaagggcaattgtttgccaaaaattaaataaagcacacgatcaatcgacgagaccaccaaactctctcgtcccagtggtgtgagacacagcgcgcattacgcactgcgtaggttgatcgggagacactgagccgccacgcatatataacacgcgcttccatctcttttattttttaacaaaccggtatttagagtgtgccgattttattaaatattgtgccgagtaaaaaaatgtcgcacaagttaaaggatgagctgtcgtttcgcttttgttagggcccaagttttgacctcctccttggttctcgccactagggctatcgccaaaagatccttgtgttggaacactctttggtttctatccttctattacggatggctgagttccatagtaactagctggttggcttacatttttagcagcgtgcgaaattagataagccattaccgtatgattaatcgagtattaaatattacaaaattttgaaaaataaatttgtttgaacattttaacactatactatatcggtccacatttgacgagccgaaatgcttatcacaaatggccttacctttggcgagtccatataaaggtcgtaataggtgaggacatcagccgaggctcatcacaggtaggccatcacatgtgacggggcgtcatttgtgtccgacaaaaggtcgccctctaacgggcattgatccgttagagataagtgaagtcatcactaaccactcatctttgaccaagatcaaacacatcaaggatgaacgttgagcccgtcagaagttataaccagacctggcatagtgtaaaatatttctatacaaatttcttttacacgaaacatactatttagtaatttgagaaatatgctcacgggaaaatggtaactagctcactcaattaaacagctagaaagaacggggctctacgtcgggaaactattttgattctcgaggggatattccctcgttatttgcataccactcaaatggttacgaaaaaataagaaaatatattaacatatgatatatcactcccttccacgtcaatcaatgtatttttgctgtctactagccttctcactacgtaggaatagtagtactctcttctttacaaattgatcatcatatataaaactttatgtttatgcaccaagactaaagataatttaaatcacatcaattaagatatcatgcacacattctaccataatacatgtattgattaaaacaatatgccaattgcaccttagtatgcacacatgtattctctcatgctgtattaattgtattacgatgaaaactatgttcatatggttatatgatgattaatttgaaaaattttaaattctattttacgatgattaattaaaaaaaggagggagtagtacagtatttgcagagaaaaacagatgtggcgatgagttggtgtcaggcagagacgtggtgacctgggttatcagagtcaacgctcaactgaacacgaggcagctgataccctctgaatctgatcgaacagagtttacatgcaacagcagctccctcccctgggacattgccattgccacaaaacagacacggtcttccaccgcccatctcttctggatctgcaccatgcatctgcgtacgttggtcgggagacgggagtaatctgatgtgatcgatggtgcattttattttatgactactagtacagtactactactacatgtgcatacagcacgtccagtcgagtcgagtcgagtcgaggatgccattgccaccaaggatgtgtttagttcacattaagagcaagtttaatactagtatatagccaactactagctccaattcatctatagttaacctaatagctcatttatataatagttacatactacactattaatacatggtcccacatgccatacacacgctgcgtcttggagtccgtgctacagctggctacaaatatgtaacccgctgcccttctctctcctcatttatctccttaaaatatgtttgcagctggcttttagcctgctattgtacctgctctaaggtgg

SEQ ID NO: 81285 - DNA, 546 bp, Oryza sativa
ttctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgcccccttctatgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttatcttcccaaccactaacacagcaccggaggccattaacgcgctccgccgccttcaccgatcctgggatactggtcctcctgcaaacgcgtgcgccgcagcggtcacggcggtaagttcctcagttgtccccttcttcgcacgaatcctatatcgatctgctgcgtggggttcggaggtatctgctatccgatcgcgtgctcgtgagatttgccttcgcttttgattgggagtaatcccag

SEQ ID NO: 81286 - DNA, 2265 bp, Oryza sativa
  unsure (1)..(2265): unsure at all n locations
ccatcttcgatgctgggtgttcccaacccttctccctcatattctgcgggcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggaggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatctttttccaccaaaacttttaccatttaccatttgctattccaaatgaatcaaaacggacccttagcaaaaattatgtaccgcctaatcatacttgtcaggcggcagctgcaaatcgaacaataaatatcccgccttgctgaccaggcaaaaaagtagggggctggttggttgctgccctcgcctggagaccattggtcaagcaggtcgatccgaccgcaggcgaccgaaacggacgcctgagatcgacgcctgagccaggcgcgaatctgagggcagcaagcaaacgcgccctagaactcatctgtaggcataaaaaaaatctcaggtatgctgttcaggataccatggtcaggcggcagctgcaaatcgaacaaataaatatcccggctgcgcaaaaaataagggggtatctgggagagaggggctaaactctcaaaaacataagtccttcccataggaacttatatttttgtgagagagactaaattgtttagccgcactttagtccctccaaccaaacaccaaataaaagctatctgtcaggcatgaagaaaagtgtcaggcatgggtgtcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgcttttaagtgnttgagatcaatgcccattaaaacgccttgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgattaacgccgcgcgccgacgacgtggtccttgccagctaccccaagtgcggcaccacgtgggttaaggcgctggcctttgccgc

SEQ ID NO: 81287 - DNA, 31077 bp, Oryza sativa
  unsure (1)..(31077): unsure at all n locations
atgccttgcatgatttactcatggtggaagtatgggatcatgatacgtttggaaaggtataatgtatcttttttacttttccacactgtttcattgtactatgtttcaattgctctcctcttgttaacattgtataagtgctccattaatccttaaccattactccctccatctacttttgataatcatatttcatcttggcacacagaccaaagataagtaattctacttattatccatttaaacatgctactaatcattcatcgtaaacaagcgattcattaatatttacatttctcgatgcctatgtaaccaatcttgtgtggaagaatgtagtcacgcattaaatccgagaaagtaattaataggataggttgttggattgaaatatacctatcaaaaataaaattttcagatttggaaatatgcctatcaaaagtagatggagggagtataatattggttggcatttgttgaattcatgtgcattttcatagcgcctcagtcactaaacattgttctagttattgctgcatatctacataaacttcgtggttgtactaatactgtagttctaatgccaatcttctacctagtatctggtcctgtagtcctgttattcttctgatcttgtcacactaactttatttattcaaattgcaggattacatagggagatgcatcttgacacttacgagagtaatactcgaaggcgagtttcaggatgagtttgttttgcaaggtgctaaatccggaaagctgaacttgcacttcaagtggacgccgcagccaatttatcgtgatcgtgatcgggaccagtgaaatctgtgtagatacatcacgtcaagcagctgataaatatttcttcccctacggtgcctgtacattagtttttctgtacagttaattcacttatcttgtagcaacaaggtgtaatggaataaaagaatggtggtttcatgttccgacggaaatgcgatgtgctatgaatggagggttgcagaaagatggatggtaacacggggagatgggttacccaagtatggaaacattaagttcatcatgcaagcagatactttatgcatcttctactggtaaaactaaacgtgtttgtctttaaaatgcaacttgtaatataattccttgtactaacaattactacctccgtcccataataattgcatttctagaaaattggagacagattaacaacaaacacaatttaccacaataatcctatttaataactacactgcatgtatatattccatatgtaaacttgattaaaaggaaggttgaggaacatatttcatatgtaaacttaattaaaaggaaggattgggtacatattccatttgttgcgtcccatcttatcagaaatataatctttctgggacaaaatttgaatggtagaaatataattattatggggtatcagaaatataatctttctgggacaaaatttgaatggtagaaatataattattatggggcggaggtagtagtttttaaactgcggtactgcctccctgattcttgtcttgaacgtatgtttgtcagaaagcactaatataaagccgatgtaacaggatgaatttaactcaacaccagctaacagtgctttgagacctgggcggggtaaacttgcaacaataaaattcgagtgaatttcaaaaatctgtcctattgttttactcgtttcttcgttgttttataatggatcattcatccattttgattttagtctgaatagccccattttgatttggcaatgagccggtgtgagtagcctagaccgctgcaattcagttcgtgatgttatcctatctttctatcttttaagagcaaatatagtaaggcttattcagcatgcgatataaaatccacatcagactcggtggtgatttggacgagagagagaggaggaaaaatggtgcaagcgggcgatagattagtcgccagctccgcactggctccaagacaccacttgtgatactttttttgaaacaggtgatactttgtcagtgttgcagcagaagagagagaaaagagcaccaaagcaccgcagagaaagtcattgatgtggttaaaaaaataataaagcttttggttgtttaacgtgactattatactctccaactattaggttgcttttagatgacatggtacacaattatcgctagcaatcgacgataatattaaacctgccctaatgccgacgtagtctgtcttcacggaacaaaggtcgcagccatgtccccgaggtcagtttttggctcaaatttcggaatcatgataaacatgctgtccttcctgttgttttttttcgcgaactgtccttcctgttgtttccaaggagatgatgataagatactctttttacatgagctgagacataagcgtgctctttgtgttggcgcttagatggttgcagatgatttcaacttatatatacagaagaactttgtgttggccattagataatagcagggtatttcaacttatactagaattgtatcgagcggcgacacgccgcgcaccgcatgcaaatagtgattaaacaaaagatttactccattggcctaaaagagtacccagacgtagcatacctatacaagtgacattcattaaaaattagattacataggtcagtacttcagttgcaaactgtactatatgactaattttaagtttgttattgagtggcgtcaaacttcaaaagaacacatttcgtgtaactaataccatgatctcacaaacattgtacacataattcaaagtttggcaatagagtggctctttagataaattgaacaaacttcaaacaaacaaatctcgtggaagcattcgctaatggaaacttgcaaacatatctggactggtcaatacccaaaacatcactcttaaaactatccttgcatttgttcattacattacattgtaagaaataagcatggtcaagatctcaagatgtgaaaggcaatgaacctctgtagaaaaatggccaaaggaagcaacaaggggaaaactgacataacccaaaaatccacatgaataatcgcccatgagtcaataacttacaacagcctctcatggccacatcatcacagtgctccatttgacataaagaaatttgaagaattcatcccatattttcccaattctacggacaaagaaccatgcgggcatgctcaggcgcgggggacggcgatggcgccaaggggtgtagcggcggcacacggtggggaggaggtgggaggcggcagggtatggtttggaggtgggatatatgtggttgttttccgaaaaaccccgtctttttaggtttacagtgctaccctagaagcagaattttcacttcttctggttgtacttctatggaacacgaggggttttctggataaaatacaacggggtaaccatcggttcgaggacgtgtgtgcaattctgtgcaaatgcgaggagtttttttacaaaataacaaaacacgcataatctttccgaggagccaaaaaatatctgatggaactggaaaatacccgtataaggaaaccgacacacagacagatggcacgcagtgaaaaatcggttttaccggcgcaccgcgtaacaatggttacagcgcgaaatcgagacgctgaaggaagcatgtggatacgggtaaatcagcgagatagccaaaaaaaaaattctaaaacatgagaaaaacgaagcggcatcaagttttattatatgatgatatacactagcactataccttctttcgtggttcagagacttcacaggagaaaagaacttagttcgtcctgtagtcacaagatttgccgcggcctactaaatattgaagtcacttcatgaaaaccaaggtactttaataaactcgttctgctcagaaaaatggtggtgcagcaggtaatagttttagtctttaaccactttgtatttagcattcttgctgtaaactaaagactacttgtttacttctattcatgaagatttccaaaaactgaagagggaagacagtaggacaaatcgtgctagatactaatggattttggcctaatcgtctaacatatgcctttggtcaaagttctgcgcttagttgattcagatgaaaagcctgccatgccatacatttatgagcatatggtccatgcaaagaaagaattaaataaaattttaacaataatgtgaagagaaactacatgcctatattgaaaatcattgatgaaagatgggaatcacagctttctataggcctttacacactgctgcatatcttttgaatccagccttcagtataagcattgagaccatgcctcctaatattaagtttggtttgtattcctgtattgacaagatgacacccgacaaatctgagttagtgaaggttcacctgtagcttgatagatctaagagtgcaaaaggacattttggagactaagtggcagtcttaaccagatcaagaaaactccaggtaactaatatttccatctggaagtgttgggctcccctttaatgcaagtttttcatttggttggccgtataataggtgttggacagccgattgattggcgaagtgaggcctgcagcacctgtggtctaccctctttgtgatcaaaatgaggaatccatccaacacattataatttcttgtgtcagtctcgccaagtgtggacaatattcttcctacggttggggttacccgatgcggcgcctcaaccttccacggatcgttttttgagatggtggagccaagctactaaataccggccgaaggaggtacaataagggattaattctttggtcactttagtggcttgggagatttggaagcatcacaacgactgtgttttcaatggtgtcaatcctagagttgcgtctgtcttgcaagtggtagaaaacgagagtaatctttggtgttctgcaggtgctttggcacttcaaaagctccttagtgggacagctaacctaggcagttagcgctccccggtgtggtcttgggtgtgtgggtctcagtggaagtggaagggctcgggtcctcatactttgtaaatattttgtactttgttttttccccttaataaaatgaaacgcagtactcatgtgtttctaagagaaaaataatatttccatctgtacatattatatacattctctaattcattcataagctaatttatttttatattaactgattggtgggatttgtacggggataacttgttagcgccttttccggccaacacggagtcgccaaccacctcaatctataaagctctaaattaagatgggtttagaaaagaaataaaaccggctagtgaagccaatttagaaatcaaaccaacttctagaccgatttagatccatttaaagataaccacccatctcgtgggcgaatcaaaaggtttatgggacaaacctacaaagagtatcacactctcgcaacaaaggcaggcgatttacaactgcaaatcgacacagatggacgaatctaggttaaagtagaaaaaaatggctgaaaagtaaaggtaaaagagcgattcgattgattgtgtaggagttgaggtcgggggctggaatcgaatcggccatagcccttaaggggttggtctggcctccacggggccttatccacatcctattaggcttagagatcaattaagacacaacaaaccttaggcccaaacaaggaaacacgatatttgccttaattgaattcggacttggcctctgccagtctgaccggccactagccatcggtttgactggccctagaccgtcggttagactggcctcgcatggtaagctaggactcttccaaatctagcccgagttttcctattttccatttaggtgtcaaattttggtgttaaatgtccactgccttttagacaaacttatgtgccgaaaagtctagaacgcatagtcttagggcgataatctgtatcggccttacaggctcccaagttcttagcaaatctttctctttctaatatttcaacaaagcaagagctcctaagaatgatttgcacaactcgattaggcattcccgactaaatgattacccagcgagctctttacaggcttctaacagtaaaatcgtcttttcatgccaagtctttaatcccgagacgattccactccagttctgttgttatgggttttggctataacttcgtattatctctttagcttgttctaaagtcttcaaacatttatcggtcactttatcactattaacgtcttataaccactgactgataaatcatctcactcaaacaaggagaatcaacaggctaaataatttatcccctaagctgattgataaattcgataatgcctcatagcactttatccatagcaattttggattggccagcatctaaacatcttgaaagtactagctctatggtttgcaatgaaattctatattaaacaaaatgtatttagatgctccaatcaaccgtcttgtttagatctttgaaatattaaactagtggaatccttcgattggtaatcttaaattcataacacatcaatagctatgtactacgggctgcaatccttggtcagacgggcattatcctcacggtcataccgttcctgtgctcaatcagacaggacaagaagccacagtcaaactgacattgaatcatcggttagaccggccatgtaattgaggttagaccgacctgatctagaattatcatacacaatttgtaatcaagcactggctttgtagtacaaaatttggctctcctatcttaataaccaaatgcttgttgtgtcaaactattggtcaacatgatttctgaagtagctatttgaaataattatcaaagagaaaatccattctatacccctaagtttactctagttcaatgatttgccatcgactttatctccctctataatatgccaccgactttgtcaatttttctataatatgtcatcgagatggatactttttaaaaaatgtctaaaatgcccttcaagccatataagggttatcgattgattgtctcattataagcttcaaaaaatatgaaagttttggtgtagccttcatatacgacataaaagtttgtgtacatattttaagattttcttcattttttttgaaaaattatttttatgtggtatatgaaagatgaatcgcgtacacaaaacatagctagattaaaaaaataattttgtgtatcatatgaaagatgatttacataaaagaaatcaatgctaaggtattttttttacttaaatgctagggtattctattagcatgtgaaacataaattatatttttttaaaaaaataataaatgaaaattaaaaatcttaatatgtaaagagactatgcaaaaaaaattaatatttttttgatacttctagaaggtaaattaattgtcaaccctctatgtcttgaagggtattttaggcattttttaaaaagtagctactccaagggcatattgttgaaaaaattgacaaagtcggtggcatattatagagagagacaaagttgatggtaaaccgttgaactgtagtaaactcaggggcatataatagattctctccattatagatgatgcatccgaaactcacagccacttgatgcatcatctataatgaatcacccaaaagattgacatgttttgcacccatggattctaataaactacaatgtatgtaactggctcaagcatagatgaacaaaactctaatagggccaatgtagcaaaatagcatctctaggtactattagaaatcaacatactggccatttgtataagacaaattattaagaagtaaaactctcatagtgcaatattaacaaaatcaatatttaatatggtgatccataaaatcatatatagtttggcttttaatagatataaaaaaaatcaagagccaaatcatactcaaacaaagtgtatgccaacttgttaattctatcactaagaactggcctttgcagcatgtatgtacaatatcgatttaacaagcaaagacacatgtgctagatagcaagcaatgttctaacatggtataggcataatataacgatgaacatgatacacatacattgtcttagcattcaacaaattttggctcaaagatgtgatgttgtacccgttgccgttcatctctctcgatttcttcaaaagaacattaatgtcttaccccccgagcaaaatcagcttttcttagtgcttgattttgagggcaagataaacaccatattaatgtcaacaacatcatgtggatcgaggaagcttatgactaatgaccgatggttcttctctcaacgaattggatttatcactactttgggaaatcaccgttctctcatcttttaccgccttgggtctccacactctcttaggagcttgaggctctaaattgttgcacgtttggttcttcacatcttcggcctttgtctcctttcgatccttggccccaagacattgtagcctcctcttttgagagcgcgataagccagaaggtatccactgcggttgtgattgtgttccaggaggcaaatgatgatttttgatactcttgtttgaattggaagctcatgtactactctcagatcgcctagctatctctgatgccccccggttagaccggccttggggctctgttgacggtccttaagtaccaaatccgaccatcaattcctgcataaaagtaaatgaaagaatacaaaatggagtagcaaacttagaggtagtggttattagtaaccattttcataagtcttgtgaatatttgtatgtaggtgaattacgaacggatgcgagtacatggattggagggcccacatatcaatcaaaacaaattacaattgagcccaaccaaggtacaacatgtagatggcccaccagatagcttcccaaccaaaggagtaatcggaaggtgggacaaaggggtcatccgaacccaaggttggccgaacctcctttgtctcccctcgccatcagcttccacgtgtaggttcctgatgactcccaaaaggcggttatgagtgattcccatgagttactaactttataatcgtcataggatggctataaaatgaggagaagctcttactctcaaacaacaaaacaagtggagtacaactcacttacacatttaagctactctctagtagagttagaatataggaggagagagagagggaaagctccggaatgagtgccccaaatatcagagttccggaggagtgccatagatgtcggcattcttccaggggagttccggaggagtgccggagatgttggcactctctccgatcttatacttcgacggatgtttcttttataagtaagcattcatgattcttttggtatttacttttttttatttaagatatataatcatcgttgcggtttcatcgctctgcttaagtagagtgttgacagtcgttaagtaccgatttcggccatcaactatctgttaacgaccaaatttggtaacccaacgatcggatgtgaaggaggaatcgagacggagttcgaggtagagattgttccggaaacagagtgaggatcggctgaagtctgaatcggctgcgactaggatcgccagagttcgagtcggacagggttagccgattgagccgaatccgacaatatgatgcggcatacgttgtcgggttaggttgacgtgcttcatgatggttgccacgcatggatagagtcctgagaaggcaattgtatctattaattaggatattttatgtaatttccttagagatatgtttgggcaaaagtctgccgcaaagacttatgatatcttagagtttgttaaagataagagtcatgtccgatatggacatattttgtaattctcgggtataaatagaccccgagccccatgtaatcaaactaacacacgttcaatacaatctcggcgcatcgccacccttttactttcgttttatttcgacgagttcttactttcgggttgagctgcatcggtttcgatcttcaacaaaaggtaaaacttgttatggcggcttgcgttctcggcattagtgcttccatctctatgatactctaatcttgtttatgtaattcgtcgagttatcatatatcttatataatctccggcaatatcgctatctaacctacaatcggctaacatctgtcagtagaaggtagccgattaggttaaatatcgatgctggcttagattatacaagatatccaccactctatgaaacatccaacggcttgattgtctagatattgttcttcttttcatacttatagctgcatcagttgagtttgatcttatgagtcgtgattagaatctcaatctctagcctgcctttgattgccgattagggtagtatcggggtttcagccgatcttacctgatttaagtactttttatcttatatgcttgattgacatgttaaatccaccctttatgttaagatcttgttgcatttaagtatattaggcttttgtttagtatattctacttgccttaatatcttaatatagagtggtatcggagtattagccgatacatgctagatctatctgatcggctatgctatgaacatatataatcttgctgttagtatatatttcgatctaggtgatttatactgtcttggcatggcgaccgatctatcccaatcacttgagttaagtatatatcgacataaggattacgtattgtgaatatctacagccgatcgagtagatttagttctttcttacttattcatgactgccgatcgattcacatatgacatcggctcaaggataaatgatatgtcatcggcaactaaccgatcggctatcgtttatagatttaaccgcggtttctttgtctttgtttcttgttgattgcaggatcaaatcaactggcatgctcacacacctaaaggcaagcttttggacctgcactggagttaagcagatctcccaggcctcgtgtttttacatcaacactatctcaatgaataaagagagaaataatatttcttacacttatattagtattaaataatgtagttccacttgtcattagagaaatactatagattcagggttatgagacaaattaaggagaaaatgcactgacatgcgaagaaatacacttccggtgaatcatgtgagagcacacggattgatgggccacaagtctagtccaaaccgacttaaagtggggccaaccaaccatgcaccgaccaaggagtccacatgtcagcctcaggacaaggtcggtcaagaatggtggtttccctggttcggccgaaccaggggtggcgccccttggtcctagcttccatgtgtcactctcttagccactctcaatgatagttatgccttattcccggaccaaaaccgacttaagcaactgtcattggaagctatgaaaagaggaggccttcatactctcaaagcacacacttcaaggagcaattctttgattccatattgtattctctctaatagtagtggagttaggtttagagtagtcttcggtcctatagcctttatggagattccaatatgtctttagtactttatcattttgttagactatagttgcaataaagaaagtagcttctttatttaattgtgttcatagtccataaactactttgctagttatgtgttctatgaatagattatacttcatttatatgcttcacttgattaggctagtctatctaaactatggtaacgacccaatgatcttaacgggttgcactagttctaacttgtccatcctctggatggtaatccggggaaattagtggtattatttgttaacataagcatggtgcttagattaaataaataccattagatgcaggaatgccccacagaaagtgaggtaggcggcatgtggtgatagctctatccatcctttgtattcctccatgtccgggtatgacgtaagagttcgtaaaatgccctccttgaccactcgagttccttaaccatgcacacactcaaccatagtgcacatcttcaccttctagttttcttcgcgtacatcagtcattgcacaattgatcttgtgaagtttgttatgaacacctcctgatatgatatcaccatgttttttattgaatagtttcattttcaattttccgatattgttttcaattccggttaccattttcgactgtgtttccggttaaaaaaatacgaatgtcgaaatggtttaggtgtttttccgacagtctcaggctgttttcatccttctctatccaaactctaaagtggttatatcgtggccgtaccgaatcgattagtttagtgattaattttgacaaattgacccttctataaaacttattgccaaaataaaccgtgtcaaaaactaatttcaaaaatagaccgtcaagggccaactaaggtggcgctgagacattttagctcagcgctgtcggggttggtgctgaggccacggtctatttttgaaatttgtttttggcatgatttatttttgaaactagatgatgcccccgcgctttgctgcgggatatatgttagatattggagaaatgataaaatgatttgtattgaaatattatgaaaatgatttgagaatgatgatttagtatgtgtatgtttagttttagaataaaactagttatcgtgcacgtgcaaggcacgttttggtttatatacataaaaaatagaataataaatataacttttttatgtactgcactccatacaaattatacaaattctaaaggtaggtctatagtaggatgacaatttgcagatggaaaacaaaaccaatagttcaataggtccctgtcaaacactttcaatttggcagtaaccaaataaagcactcttactatcacccctgtcagcccataggacaaaaaagtacaggaaacataactgtaaaaatttcaaaataaggttgtgtttagttccacgccaaaattgaaagtttgactaaaattgaaagtttgaagaaaaaagttggaagtttataggaaagttttgatgtgatggaaaatttgggaactaaacaaggcctaagatacgatgctatataattaatttaggaaatctgctgattttttttgcaatgattgatgtatactcaatatcatttctcatgaaacttgctgagttgatcataccttcgttgttccaaatataacccaaaatcaccaacaaaacaaccttgattctctttatattcactacaggagattcaaattgtctttcggcttgataacaggtatttcagataattacctatccgtcaatttggaaccattaggttgtaaataaactattagagaagagatgaactgcacaggaactaaaggaggttaaaatgtttctcctcttcaccttgaccatgcagtccgctctcctgccccaagaactgtagccaagaacatctgttcactgcaaaagttgtacttcctccatttcacaatgtaagtcattctagtatttttccacatttattttgatgttaataaatctagatagatatatatgtagatagatatatatgtctagattcattaacatcaatatgaatgtggaaaatgctagaataacttacattgtgaaacggagggagtaactttgagttgttgaactattgctcttccactcaggtcacaccatcttttacaggattgtgtatagcttgtactacaaagacaacgatggagtattttagcctccctacaacataaatatgcaaataggaagaagaaaaagtaacttttcaatagtgcaacaagatttaaaacataacaggtaattaggactgctagcaactgcgagcagttgtgattccttctattcgagcgttctatacatcaccaagaatgattccttctattcgaatcaaatcaaataacacagttgtgaaactattcgtttgttctgagagcactggatttgatctcggtttggtagatcaaaaagaaatcaagaaccaggtggtgattcaaaaagagaagagaaagataggagcgaaagcaatagagcagtaccttggggcggcggctgcagcgttacccgcgagaaggagtgactgcgggggcagcagtggagtgcggcggcggcagcggtacacgcgaggaggagcgacagtaggggcaatggtggagtgcagtggtggcaacggtgcacgcgaggaggcgaggagacttttcaggggtccggtgtgaaactaaatgtagaggtgtgaaactatacaatgataatatatgaattattgtcataaacatttaaattgcatttagaaataatatttatataaaaaaattgtatatgctacctcaaaatttttttccgagaacacactaatgtagctagggccttcgttggttcatccaattctgagaacaactgaattaactagtatgtaccccgcgtgttgccgcgggacataatgaaaattggttattataagcatggagtgaagcacggaaacaaaaggtattcatgtagattttgaaatataaatccaacgtcaaagctgatatgattagaaactgcagtgtcgttaatataaatgtgaatacatatatttttaatatttcacatgacaacaaaaatattactggaagtttacttactaaagcatataatatatgtaagatatgttatttcatcggacaaaagaactgatgacggtagtcagttggcaattaaaatagttatattatttacatggcaggcatacaggtgagtgagacaaataatttatctcgtagaacactcttgcaagccaaaaggtacatactagggcatagaggtgcattgatatgttttctagcagaacacctgctgatggaaaaatgaaatttatgatgatcattgagatggctggatgcttggttcttcgtatgatggcagcctgcattatagtaagattatgagcatcagccataatcaagactggtagcatagtgaataacagattaatttttaagtaaaataggtatgtgtgtgaaacatccatatacagttgttaaagtagctgatcacattgaaacagggaaaataatatcatgtgacagttgatgagatgacaaatgaagtggtaagacatgttatgaaacatatatatggatggaaaacttaatgaattatagcatactatgaacttgtatcaagactaaattaataggagtaggtgtgtgaccaaatatgatagactacttaaaagcattagctgtgagagaatctagatttggtgtggaagatttttttttttggcaatgcaggaatgcaaggatcttcaaatttatataggtaacctgtaaaatgctgtaaacttcttttcacattgaacttgtttagtggtcagaatgcaaaatataaaaagaggaaaacaaacttacgaagaaaccatggataccagaaggcatatattagaggaaagttgagtgtgaagatcacataaaatagacaggaaagaactgaactattgtaacaataccaactgcgtgctgctttgacaaggcagaggtttcggataaagaatcctacaaacaatgaacataggtaaatttgacattaagtatcaaaacacaaagaatataatcaggtcaagttagtaggtctgagaaaaaagaacctaggactcacattgggggcaaggcaacaaaacacagcaaattaccaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttagacgtgagaatgcgacataaagttgtccatgtgagaagacatggctaggtaagtagacaccaactctactaagtgtttgcccttgacttttatttatagtcattgcatatgacacacgtacaggaaattgtcggcgctttaatttaaaaggccacttcttatcaattgaagtggttactatccttggtatatatgccttggatccttggtatatatgccttggatcctttagccttccctgtaattatctccccttctatcacacgacgagtcaattgagtcactataagtctggttccattgcagagacctttagatgggttcagattgcgcagcagcataattggcactcctatttttagttgaaggtgatggtctggcaaaccgctgatttttatagtgttcaggaactcagttgggtaaagagcatcaagagtggcacgattacttgtagtatcttcaattgtatctgaactgtagtatgacatttcttgagtagtcagctgagcaatcatttgggaatttatacttgcagcgatttcatttgttggggctagaattgctcgctcacagagataattggctgtgtgagaattgattgaggcatcatatacaaaagagataaggcctgaaaggtttcttgtgtcatctggcaaaagcaaacactctggtatttttacccaagaaacatcctctccatcagtaggtgaagaatctgctactgctccctcccctattgctaacaaccattctgcaaattcttgaaggtgttggcgatgagtattagacaatgttggggattgaagtctcatattttccgtaagatgcatgagaatgcagtgttgccataaatgagaacgtgtgatggatgaagataagatttcctgttttttttttttgcatagggtagaaccgggagagtttgcctaaaatctcctccaagaacaactgtaatgcgtccaaactgtttgttagcaagtgatggatcattggatgcaagaatatctctcaatgttcggtcaagagcttcaaagcaatgtttgtgattaacaggtgcctcatcccatatgactaaggaggtttgttgaattaattgagccaagtgagtgttcttcttaatagaacaaactgaatgctcttgtatgtccaatggtattctaaagcaagaatgaggcgtgcggccaccaggaagtagaagtgatgctataccagaagaagcaactgccaaagcaattttcctttcagcccttacactatttagtaaggtattccaaaggaatgttttccctgtccctccatagccatagataaagaaggtatgcccaatgtcactatttaaagaattgagaatagcatcatatatatgtctctggttcagatttaacttgcctaactgatcagccgcttcaatcgatatcttctctagatcatatgcttgttcatctattagcagcctattgccaaggatggatgtgctttgaatagtaggctcaggtaaatggaaatatgccaaagtacgaccaacatttctaagtatgctatcgatctcggaaagaacataggacttgacatattgtatgactgaaggtgcagaagaatttatacctagtgtggcatggttaaggtggtaggctgcatcttgacccattgaagacagatgctcttcaaataaactcagtgggtgtgtaacatcacagaaaagaagcaatgttacaaataactcacggagttggtagggaagtgcccaatgagtcgcatcagtcattgcgaaggaccattcacggtcatcaccaagaaggcctagggcttgacatgcagcttggaatgtaggatatacatgtccttcaatggtccggagatcagaataggattttgctcctttgacaatgtgcagcaacattctaaggtagtagacatctccttgggcaggacaaacatgtgctatccttccaattttcttgcggcaatttttctgtggagcccaatatttgccattaccatgccaggtaaagtattctgggaactctgcatatgtatatgcagcagcctgagagtattctctatttgcagcaaaccatgctgtaagtttcgtaacacgattgcgtgggttatccaagatctgttccagattatcatcctctgtgaatgtaacattattctctaatggcatatgtacatggagacgctcaatagcaggatcagtataatgaatctcaaactgaagtaaacgccatgccgcctcattcggcgctatacatctacatttaaacgccatgccgcctcattcggcgctatacatctacattctaaatagtcatgaatctcattagttccagcacatgcccgcttgcgcttgagactaaccctcgaacaatcaaaacccttagcaacatatttgaatagatacttttccattccatcacgattaactctttccacgttgatatgcgcctcatatttgactaataaatcgatgttgtgggggacaacatgccgattatcaagagaaattctatttttggcaacaattatatcattttttggccgagcataccttacatggccatttggcaggattgttgttttctcagaatattccttcgggtaattctttgagcatttaccgtcaaccatgcatgaacaatgcggatttgcatcaccacaaggtccatgcatcatgaatgccgcaacagcatcataaccaactcgatcaatggatggatctggaagctgtgccgatattagtctgtcaatatcagcaggtgtcaacggaccactcttatctaaccacaatatgatgtgaacatgtggaagtccacgcttctgaaattcaattgtgtacacaactacataaaaggaaaaattatgtgagaatgacacatgcaaaatatttgaatatatgaagtgtgcagtatgttgtgtcatgcatgattcatgaacaattaaattactacctgcagtgacagggccaaaaaatttcttctttacgatgtcgtccatgaagaggtgtagcttaacatggaatacacgattaataatatcaggcctatctgctgagtgttgcccagggatgatagccaaagcttgtgttacctctgaccataaggaatttgatgtgaaagtgataaacaaatcagggcaaccatattttctacatagagcaactgaatctaagtaattttgatataaatatcttggccccccaatataagaagaaggcaatataactcgctgcccggcatctgatgcttctgtgatgcctgaatggaccatagtggatacctcactgaatgaagctgttctatacttaagctgaaatgtcttggatctgtagtgactcaggcgagattcttccatacaacaataggcatctatgacataggcctaggttcctctcttgcagcgcataggagtattgaagtcatcagctctgtcatgaagcctatatgcaaagtattcaaccatagtagccttctttcttttgatagcttgtgatcgagcacaacgtcggtatgtgatattttcatgatagccatcctccccatatggaaatagaattggatattgcattgacataaatttacaatgcttttcttcaactttttgtaaatgacccgcttggtcctgcacaataaggtcatggccaacatcacttatacctacatcaccaacaactaacccaacaacctctgatgcaactggagcactaaatatatcaccatgcttgtcgggatcaccaaataatcttatgatgtatcgatcatcaccattttcagccaatctatcacgagctgtcctaaataggtggacaataggattgtgggtgttgaacatgtctataagtccagccacaatatcctcattaggacaaaaactcctatttgcataggttccaacattcatcctattcctaatctcattttctgtgtcaaagatatataactgagcatactctggtcgtcttccttcttttggtatgagtgacccaatgcagtggcagagctggccactaatcttgaaaacatatgggcctcgtccatcattgatagaatcaatgacatttacacccatcgatgtgaaggcaaacatcgaattgtagaacctaatgttctcaaaaaaatgggctgacaatgatctgttaactcctgtgagtagactatgcaaaggttctgggggtggcctatatggaggtaagatgacactcccacctttacagcatgtattgtatattggtgatgagctgtgctgttctcggcggacacgctcctcaaaccaaaagaaagccccacaatatggacaagtgtgacatgggggcccaagccttgatggagagaaaatagtgcctagtaattaaaagaaaaggacataagtgtgtgtaataggtgggaattttttttcgtgctattgattgacatacatcaggtcgagcatcagaattacattagtgagtcgaacagcaggtcgagcatcatactgtatgagtgatctgatttgacatgtcgagcatcaggttcacatcagcaaaaccacgataattgatgagcaaatggtctgtacattattagcattgtagttgtcatgatttgtaaagggtgaaatgaaatgatagttgtagagaactaatatatgactaaacttatgttggtgtgtgggagatggagacaataaggcaagaggtcgacgatgaacatgctgtcattggttacatttgttgaagaattaggagagaaacacagtaaaataagtggaaataggaataggacagacctccatcgacagttgcaaaaggttgtgtatggccacaattgataggaaccaaggtggatgactgagatagactggttcgttgtcgaacattccgttgtagcacatggatatgcgtccgatgctctatcatttcagtggtactattaatttctagagaaaacaacacgtgttagggaaaaaaaaattttgtataaggcatgaaagtgcacatgtagataaacatgtgagtggataaagaatataatcaaacctctagatgatttggcagccatagagagcttacgctttcgacatgattgagcagctgttataggatccgggtggggaaatcctgatttagaatatgagcaacaattttcggtcaaaaaagaattaggttaataacatgggaaattgatatgtaaatgtggactgcggtaggttgaactggtagtgatgattatgcataataaatggaaagaaatgccatacatttggaaaacaacagggtagacaattagaacgaaaaaaaaataatcaaaacaacaaatattataccagcagactgagcaagtagtcttcgacgtatagagcgccttgatggcaaatgaaaacttgtagggaaatcaccaacatgggagagggcgtcatcagccagcagaacaacgccatcgctaggaatattccccaggaaatagatatggcacaacagaatcatttgttgacaaataggagagctcaataggaaaatggtttcaaatgtagaaataaaaatttatatggcttggagctaacctgaaggtataaaagctctctcgggttgcctgcgcttgcgagctggtttaggtgttgatggcccagaagaggctgacatcattcaaactgatttatgaaagtaattagtggtttactggaactataataatgaaagtgatatatttattatagcagccaaaacatcattatatgtgtagcaatcaagtagtatacatataaagagaaatttatgcatccataaagtggcacattaggtactggccagtttgctatatcttttttttttttgcgataggaagctcatttcattcgtcagggaacagcaggattacaatcttcagtcacaaggtgctcgatacaagctggggctgactgccactcacccagcctgtcatcagccgtgacttgcttcgctaatacatgagctacatgattgcaagatcggggggtgtacagtaaagtaaaaccatgaaaactggagctaagctctatagcatcactgataatcgacgcaacatgcgatctttgagagccaccctgcttccacagtttggttagctcttggcagtccgtctccacctggattcttaagactcctttctcccgggcaagttgtatcccatcccggcaggcaagggcctccatcatcaaagcatccaggccatgaggatgccatctagcccggccgcctttgaacctcccatcaacatctcgtaggactgcccctgttgctccctggctatcgttcctagagaaagctccctggccagtttgctatatcaggtaatactaattaaactatatgggaagagccataaaaggaagcagataaaatgcactacacatctagtcataattaatctttttgaccaattgatatggagttctttaaatgtgagtgtacttgcaaattgtaatgaagaggctataatgcattttgtttatgaaagaaagcaccaaactggaaagaaggttaaaaaaaagatatgcacatagggaaattgataggcagtaacagagaaagttcaaaatcaaaccaccaagaccaaatgccatgctgaagcgtacatatattctaaatcgacccaatatggcaagccaaaataaatagcaaaattagcactgcaataatccaaatgccaagctgcaagttgacggcctacaaatatttaataagctgacaggcaaaatgagaacatatcaaggaaaagcgcatatctatctttcgttcattagcatattgtcatatagtgtttaatctgaaaaaatcgcaaccttggtagtattcactcagcctaactatcgcaaggaagcatagggaaatagattcatgttttggttgttaacaacagcaaagattgatcagcctgggcattgtctcggtgactcaaaactgaaagaaagcaagattggtatccaacagcaacaaagagcagtatagagaaaaatgacttactgaagaaaaccgaggatggaggcagccgtccagagcagacgggctggcagatggcagccgctcgaccagggcaacaatcgggagccttgttgggtacggccagcgcgctgacagcctgaccgatggagatagctggacgacgactataatcagcggcaaccaccacggggcaaccctacaatcacaggtggtgggtggggaagaacgcaggtcggggaagaggaaggcagccgccggcgaactggtgatcgatggggcagaggggatgacgtcgatttctccgatggattagagaattctcttcatgaattggggattgatgggtgtgtggtggagagggcaagcagatggattagggatttattttcatgaattggggattgatgggtgtgtgctgtgtggagggcaagcatatcgggttggcaagcggacggacagatcacagccacgacagagcatcgcacggcaacgcagccggaaggaagctgttgcactgtagcaaaatactggcctctggtggagcaagttactgttggtagtggcttaggaaaaggacgcgactacacagctagtgctagctaatttgtctaaacaagctactactccatctatgaaagacactatccacctatacttcaaatacaattttctcttaaactacttatctgatctacgctccgattgcaccgttgtgtttgtaacaattaaatctttataacaagatctcacacgattatactttgatgaaaaatcacaaattacttttataatatatctaaattacttttagatttcactaagttacttcttagacatatgaaagtaaattcaataaaacctaaaagtaatttacatatattatagaagtaacttagatcaaaacgaaggtaactttaattaatgccttttttcattgaacaaattatcatatatataagttacttttagattttattaaaaatacttcctatacattcataatgctctgagttgattacttttattattgtttttagttaattctataatttgtgctgattaatttaatttctagatagagtcatatttttatctttacaacgaacttacttcaaatgacatgccaaagttacattcgttttgttttaagttacttctataatatatgtaaattacttttagactttacttaatttacttttatatgtttaagaagtaacttagtgaaatctaaaagtaatttagacatttcataaaaataatttgtgatttttcatcaaaatataatcatgtgagatcttgttgtaaagatttaattgttacgaacataacagtgtaatcggattgtaaatcggatgagtaatttaagagaaaattttatttgaagcatgaatgataggaatattttccctacttacttaatggattaatactataaaaggcacgcatgttgacataataggttggtacaaatcctttcaccctagcattaaactctagcttagatttctctcatacttggcaactggaccgtcgctgctttgtactaaaccgagagtgctcttggtttagattttacgttaggaaaactaaagatttaatatgattaacctagcattactcgtatgtgaacaacaagcaagttagaaacagcaactatgggaacaacaactactgaatcaatttttcacatgggcttgacgcgatggcaaattggcaattgcgaaattgactcacctgatcagaaaacctacgatcgttgtcctcgttcaaaggtccagtcggtgcgcaagcaaaaagcagcggacagccgggcttgcgtcggcgcggcggcaggggtgctcggcgcgccgctcccttgaggattgcgcaatctaccgatctcgtcgcatgaggagtgaggatgagggtggcgccgcggcggtaatctcgctcgctcgtgaggagtgaggtctctctcgcgtctctcgcaattgtcaccgcgcctgttgggttccgttttctcgcatgcgcctgttcggttcctggatcagggcgatgtggatgcagatagatggacggtatggattcacctgttgatttggctggtagggttggaggggtgcaactcctcatttttatattagtatagatatagataaattgtagatataattactatatgattgcatgttgaactttttgtgcttaatgggttgatgtgacatgcttgcatgtgatatttaattaacattagctttatagaaagaagggataagttatactccctccatactcataaaggaagtcatttatgacaatgtttaagtcaaaccttgggaatataaatcatgaataactctcaagttattgagattgaaaatgtaaaaattatacgtatagatttgtcttgaaaaatattttcataaaagtatacatatatcacttttcaataaatatttttatagaaataagaagtcaaagttgtgttttaaagaccgtgccgctgtcctaaacgactttctttacgagtatggagggagtatagaagtgtcaatttgtcaaaataacggtagtgttgagaaatttaacaatatgccactccataaaaatggttttaacagaatgccaccctctaggatgttcttataaaagttccactcaatagagggtactccttaatagaatgccactttcggctgttttgaagcttttaacgtgagaaatgacaaaaatatccctgatttgtatgagcggcggtggtgcagtgggggcggcttggtgggggaggagggtggggttggtggctgtcgcggcgagcgcggcaacgccgttgtcagtgacgaggtggagggagtggagcttgagtcagtggaggcctgggccaaggcggtcagtgactcgcgcgaacgtggggttgacgcgacgtggagccgcgcccgcgcgtagaggatgaggcggcgcacgaggcggcgttgacggagagccagcggcgcagacgaggaagcaacgcttgcggtcgccagagccgaggaggccaaagacaacggccaggagctcggcaaggaggtcggcggtgtgatcctcctccgcgggggcgtcgtcctcaaggtaggctgtgccgccacatgcttggcgggggtggagagggaggaggccgaggtggcttgcaggggtacctagcgatgatggtggtggtagtggtagtggagtgagtgtaggggcctcatggcctagggccaacgacggcagcggcgagaaagaaggaaatacatctggtggtgcaggggtattttagtcatttcacgagtgaagtctgataaaaatatccaaagtggcattcttttaaagagtacctcctattaggtggtatttttataaggacattttagatagtgacattttgctaaagtcaccgctacgaagtggcgccccgtgcgtcagttccccactcaaaccctcgcttccgccgaccacacggccgcaccatggcgccgccgccggagctcatagacaacgtcaccgcctccctcccgccggatctcatctccgagattctcctccgcctcccgccggatgagcccgagcacctcttccgcgccgccctcgtctgcaagtcatggctccgcgccatctgcgagcacggcttcctccgccggtaccgcgccttctcggccttcttcacaggctcaaagtcatgcagggagaccccgccgcccgcctcgcccgcaccacagcggtgcccctctcccccgatcccacctttcgccgggccctcgattgccgccatggccgcgccctcctccacgcttcggacgatgattggtatctcattgtctgggatcccgtcacgggcgaacggcaccgcgtgccagagcctggcatcccgtggctgatctactccgcagcagtgttctgtgccgcgagtggctgtgaccacctcgattgccacggcggtcccttcagagtggtttttatagccacggacgatgacgacgaactcgttaaggcgagcgtctactcgtcggagacgtgtgcgtggaacaagacagtgattcttgctgatggttatcaaacctggcaagagcgtttgcaagccatcactagaggtgaatcataccgtacaccttatgtccagcccaggcgaggtgcccttgttggagatgaaatctacttcacgcttcggaatgagaatgcaatcatcaagtacaactgggccgcgaactgcttatctaagattgacccgccgatacgagatgtgtatgacatttccctcatggagatggagaacggttcactgggttatgcctgcattcagggttccagcctttatgtgtggtcgaggaatgccagttcagaaggggctgcagaatgggtacagtgctgggtgattgagctggagcaaatggtacctgttgccaatcgcggtgatgaagcatttgttgttggctctgcagagggtgtgggtgtcatattcatgagcacaggtgttggattattcacgatcgagctcaagtcaaggcgggtgaagaaggttgaagagcctggggtctactctagcgtcttaccctacatgagcttctacactcctggtattgtactaaaaattgcttatctcctgtccttcatttcctttacagcttctatatatttgctttgtcataatgtaactgcaatattgtaatttcaattgacaaaaacagttttgtgtatgctagagaatactgaatagaggcattgcaaatcagagccttaatttttgtgatgagagtttgcttgctaagaaccatgaccttgcattggtctaatatattcgggatacaaacttgttgatctggtatatttgttactctgttactttcaagcatatctgttactcaggcccagttgattcatggaatagttcatgcagcagtaagtagctaataggctaaactggctattgctaaagatttatagaagccttcttgttatgatatttatagaaacattagattttccttaaatggtattggtaccttctggcatagatgaagctcatatctcagacccaaccttgtaacctttggaactggttctctgtacatagttcgtcaaactgtaaagtttgagctggacagttggttatgagttgtgtgcttgactgtttggtgtgtttctttttttcagatcgtggcacattgttatcgctagcgaggactcactgatactcaaaacatgttgcaattgacttcttccagaactaccactatgaaatcatttattttctgttcggcagtataagtatgaacaatgcaagtaatcatgtttcgaatgtggttctagtgtcgaattcatcctaccaaccatgaactgtatttaatttatcatgtctggcatatttcagttgagcctcaggtacaggaaactaaaatctaaaattatgttgacttttgttgcttccattcagagatctgcaagtcatgcgaagctgaatagctggatcatgtttacttcgattacaaccttacagggccggggtagtgaggtgggtttgatcagtcttgcaattttttggtggtcagttcaacccgaatatgagtggaatattcttttttttaccaactaaacccacctaatcctcaaaccaaacagctgcaaaaaaaaaaaaaaaaaaaaaaaaaaaggatggccccgacccgacgttcaacttgcagctacatactggtattcaagtagtagctcctgccccatcttaactgccatcttagtgaaccttttgcatcatgtcttattggcaggaaaatgttttggacaaggacgggaaatatggattatagcatcatcgatcctcttgcaccaaacaatgctgccgtttttgtttccgtttcatgaataaatgaatgtcaagtggtacagctcgatcgaaacttgtgctctcaacattttatctgcttgtttccgttcctacaatacttgtggactacgattactttttcagttgtagactactgagtaccgactacggagtactaggcttttgtctgatcactactgtgctcaacttattcaggagttctttatattgtttgggacagggagtcgtatgtttataaagttttcccaggttttactagttttatatatcccacgaaaattctattggctgttctgttttcaaatagccctattggtttgcaaacatgtaattatatatttgttagccatttatttattttaaagcttcataatatcttaaacttctatggtggcttcatatatgcattaatagttacatctctatttcaggtgaactatttgttcaagtttaggttcaaaattacagctaatatctccaatgaggaacaaaacataatatccacactaatttctttaatcaaggattaaatttctgggatgttaaagtcccttaaaaacttgatgtgcataaaaggcaacatcaagttgtggataatgaaatggaaaaagttacccccctacactattctggaagtacgaattacccgctcaattaaaaaaccaaatattcttcaccctcaatttttcatacgggacagatttaccctgatagattttggagcggttttgtttctatgtgacagtccagttagtataaaaaattataaaaaatataggacccacatatggtaaccaagagaagaggccgaacgaataagtgggcctattatttttaacttttttatgttcactggtcacgtgtgcaccatgtaggaccaaaaccgctccggaatcgtcagggggtaattcgaccgatatgaaaagttgagggcgaaaaatgtctaattttttaattgatgggggtaattcctaccgccacaatagtttgagggataatttggatttgtttcctaacgaaatatggataacgaatgggcggacaattaatcggaatttgttggaaatttaacatttttcaaatatacgttagttgataataatttgacctcttttagagagaaatatatttaaatgtattcctaccatccttgtctcatggtcgtcatcagaagcaaagaagaggaagtcagttccttcattccttgttactttcatagtgttgcgctgtgagaattttgggaaggcaaacgtctaggtctagccagccaatagcagtaaagaacacactaatgggttggaatgctagattattgtgggatgggcctatgtcatcgcacaattatattgttactagcaaaagtgtccgtgcgttgcaccgagtgattacggagtgtgtacagtgatcaaaaaagtgttgcttagggacctaaatcagactttttcccgccctagccggtcggcccatggcctcttatgcgcacatgcaggcgctccccacctcctcgggccgcaacctgggcctaggccgggaagcctccccacgcgcgcctccacttgggttgaattcggtctagccagtgccggccgtccgatcttagggtttcgatcagacggttgggcgccgacgtcggagggacaaaaccccttccctcccggcgccggcgaaaaccctagcctcctcggcccttcaccggtgtgcgcactcgtcgcagggtgagtgcgccgccgtcgagcggccttgccccaacggccctccccatcgtctttcaagcggcgcccctccccatcgtcttctgcggggcaccctcccctccactagatccagtgggaggggaggcggcggtggcccggcggcctagatccgatgtctcggatctaacactagtagagaaaccatctttggtcggtcgacccaaatccataatagtcccggttctattaaaaaccgggactaaaaatgatttttagtcccggtttataagagaaagatctttaggaccggttgttgttaccaaccgggactaaaaatcatctttagtcccggttggtaactccaaccgggatctttagtcccggttgattccatgtcagaccgtatcagggtactaggatctttagtcccggttagtaacaccaaccgggactaaaaacctatttttagtccctaaaaataaaaataaaaaacacactatataatccctattaccgatcctcttttcctgtccacacaacaaactcctccctctatctctttctccctctccaacttctttatctcttccttatctctaactcctaccttctctttcttttttttccttccattagtcacagcgaagcagacggcggccggaaaaagggaacagggggccggtgcgtcgtcggccggcgcggaggcgcggggagcctgcgtcggcaaccaagagaacgcgggngttgaaagtcgcaatcgaagttcacacgt

SEQ ID NO: 81288 - DNA, 996 bp, Oryza sativa
ccatagcaaagtggaacccacatgtcaatgacccaactgcatgtcttaggatctgcttccgtgtgcttcatttcattgcgattttgctgctgtttcggacatttttgtttggcatcgttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggtaaatagtccggtagcaagttacaattatttttgctggcggcccacttaatcaaccgccagccaaaattgatttacactggcgctcttaaaaaaattcgcacataaaaaaatcaccggg

SEQ ID NO: 81289 - DNA, 2942 bp, Oryza sativa
tatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttattttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcggcaggatccaccacataccatgtcttatacggaaactgacctcgagagagttatggataaggaaagacaaccagagttctccatggaaacgataaggattactcggattgtatccatattggtttccctagttctacttggacaaggggacacctatgggtataaatacaagcccccctaggaggacagggggacagacatccaccatgaagggatcaacatccaacacaatcgacatagaagccacaacatagaagcctacatactccaagacaagccgtcggatatcgacttcatggataagcacggctaataccctgcggtgtctgcggatactgtcaggagagacaaaagcgctatctctgatctcgccgggcacggattcgaggtgggaggctaccttgttgttgactacgagtcagatcgtcagaccgccatgtcaacaacagttagataggctaccccaaacattgtactggtgtgatatcatgaataagagcaataccggcttcggccaacaggatgtagagttattacctgacaattcaggggcccgaacctgtataaaaatccctgtctccatctcttttacctcagtctcgcatataccctagcaccgacgatccccataccatgcaaataccagaaccacgacatcaaacatcgacacatttaatgcctcatgcatgccggtgacgacgacgacgatctggacccgacgatgacgacagtgcaggcaccgagagctgcgtcggcgggaggcggcggcgcctgcggccagcgggaggaggcgagctcggcattgagagaggaggcgagccggcgacgagagaggaggcgagccggcgacgaccggatctggtgggcgccggcgagagagggtgagcggcggcggccggggagagaggaggcaaggcggtggcgggagagataggaagtgcggcggtggggttgccggcgagagaggaggcgaggggctgccgacgaagacctttggcgaggggcggccggcgatttcgagaagaattttttttcctttttctcctttcccttttatttatttctgtttttttatttctatctagatttttttagtagattgatatttgaataaattgcacctacggtacaataacttggcaggtgggtgcgatatagtataagaacttgagaattgaacgtccgaatgcaacaacttgacatgtgagtgtgttctagtacaagaacttaacaatttaatattttgatgtatcaacttggctaaacatatgctaggtgagcttttttttacgatgtcagtatgttattgcatagtaatcatatggatattaccttataatattaaatttaatctttaagaattattatactacacatagtagtacaatttacatccaattacctttaagattttttttgtggtcttcaccttctcaaatatcaactgaaatataaaaatttctacatccagtttagttgaccttcagttattagttattaggataaaaatataaatatacttatacaaatatgcgctagtatattttcaaaataagtacttaaaaattgaatttattgaaaaaatactccaaataattaagttgtcacataactttttaatttattgtatcaaaatcgtacctatcttgcaagttgttgtatttatacaatcacttataaagtttttatactaaattgcacctacctgccaagttattgtgctagaatgctaatttcttaagttattataccaaattgcacccacctgccaagttgatgcaccatggatgcaatttactcttgatattttttgggtgagaatgtggaggggtatactcaccacctctaatgaaagggtgattgcaaccactcatccatcccactcccccaaccaaacaaaaaaaatggattaccatatccactttcatccctacaaccaagggtgtgtttagttcacaccaaaattgaaagtttggttgaaattggaacaatgtgacggaaaagttaaaaatttatgtgtgtaggaaagttttgatgtgatgaaaaagttagaagtttgaagaaaaagtttggaactaaacaaggcccaaacaaaaaactggatcgccatattcactcaaaaaaaaaactggatcgccatatccagcaaaatatggaccgccatatcccatccaaccttgaccgggagccaaacacaccgtcaggatgccacgggctccaaccttctcaaataaatgctgccttaggagttaggtctgatttatggtttagttcccaactttttcttcaaactttcaacttttctgtcacatcgtttcaatttcaatcaaattttcaattttggcgtgaactaaacacaccattacaggtctcgaaaccacgtacaaactggttaagtgtttaaaaaatatatttaaaaattgaattctaaccaattttattgaatttcgtggtta

SEQ ID NO: 81290 - DNA, 702 bp, Oryza sativa
gtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacatgacggtctgaaggtctgactcgtagtcaacaacagggtagccttcctcctcgagttcgtgcccggcgagatcagagacagcgcaatgtctttcctatcagtatccagagacaccgtaggggactagccgtgcctatccctgaagtcgatatccggcgtcttgtcttggcgtatgttggcttctgttgttttgtagattgtggtgggtgttgaatgtccatgttgatcgtccccccctcctagggggccttatatttatacccataggtgtccccctgtttaagtaaaattagggaaaccaatatggaaacaatccgagtagtccttgtagtttacatgtagaactctggttgtctttccttatcgggaactcctcctatattcgcaggttatttccgtatagaacatggtatgtggtgggtcctgccgagatttagtcaactactattaggtatgtggtatccataatcctgaca

SEQ ID NO: 81291 - DNA, 54752 bp, Oryza sativa
caaaggggagcacggtaggcggcagtggccggccggccggcttttctttttttttcttttttacgatttatcctgtgatgtatttgatttgtgtgtggtggggatctgtgatgtatttttcagaacttgtgatgtaattttttaaaagtttgtgatgtatttggagatgatctatttgaggatttagagatgttctgtgatatgtgagaatttggatttgggatttcttgacatgattaggggatggtgtgaaatcaatattcaatactaaaacaatgaaaaagagaaaagaaagaaaaaatatctttagtcccggttgttgttaccaaccgggactaaagatcgatttttaatcccggttatttgaaccgggactaaagatagcgatctttagtcccggattcgtagtcccggttgaaaaaccggaactataggggggttacgaaccgggactaaaaagcatttctccaccagtgtaacgggagggaaggggaggtgatggcggcccggcctcccctccgtcggatccagcgggaggggagccagcggcggaccgttgtcccctcgacggcggtggcagttcggtagcgacggtggcaccctctccttccggtatcctttttcttcttgtgttcttgtatccaattcatatgcttcagttttatttgtgcgatggaattccgactgggacttggattgggggatgtgcgatggaattccgactggcgattttttttggggggggggggggcggacgaaagaccactgcacggatgaggtgataaaaggaaaaacacgaatcttttaattagttttaattagttaagagatggagacggatgattatcggtaatgacagatttattcgttcattacacacttaatgatgaccgtatcggcatgacggttagggaataaccgaaaattttggttttgttatttggtctttagtcttaagaccaattggacttcgacaaacctcaagaccaagcactttggccttaggtctgtttggttcggtctcggtcatagaccgaactaattgtaccagaagtttgatttgcaaaaaaaaagccaagtaatcagtacaagatcgatgagtcaaagcaattagacatatctgcagtttgatgccactagcaaatcgagcacaattcagaacaaaagaggcaaatcgagcacgattcaggaaaaaaaaaaaaagaagccaatcgatacttgcatgacttggatcccatcaatctccaccaaaccactagaagctccagggaccagatctcattcatcccaccgtctcctgtcattgttgttcctgttgctcctttcactttgctcatggccaacctcctcggcacagcctcttccgcatccacagtgctcatagccagcctcctcggccacgtaggcctccagagcacagcctcttccgcctccacggtgcagccaaccagcaaacaccagagggcgtcgagttgggacagtggtgttggttttggtgagaggtgagatgcggcggtggaaagggacagcacaacgcaggtcgtcgatgacagtgccacaccatgggaagttgtgatctccattttttctccaaaaactgggagatggggattggcgaggataagatcatgcctagtgatggtgcggtaaggtgttagagcatcaccaattctcctatttcattcccaaaactaatttttcagggattttaaggggtctggctagccatcacacgacaaatttctgacccacaaatcacacagatttctcagccattggattagcatccaacgagcaacagaatcaaatacaaatagacttttttttcttttcacagacataatgggccagatctgtagagaaaaaaaaaattaaaaaacccatccaaacaacaatagatccaaacataagcccaaataaaaaaatagatcaaatagataatttctcagcccaaacaatgatcacgtggtccccatgaacaaagatcaacttacaccacaaggaaacaaactcagaaaccacgtgactctaccaaaccacatcgatcgaacagaaaaaatcgcaaagatggagaacgagaagggggaagctaagaagaaaaagaagatctgctccaaatctgaaagtcaactccaaagaaaatttaaagaaggtgagtaaactgcatacctcaatttctaacagcatcttcaaacacaaaattgattgaagttcaccttctttgaatcttgaaaagaaatctggtcaattcccttcaaatcttggtagaaattctgagaataactacatcttgagatgaaaaacacaaatcagtttaaacagtagaccaaatcagtttagattgagatgcaggaacttgcaaaaataaacaactaacaacaaatctgacataaggacatgtcaactcagaactaaaatacagttgacaagatgaaacacagtacatgacctgaacttgtatattcctatacaacattctccttcaaacaaaattttcttccacttcttaacaaaacagatcatacaaattcaagattctccctgaataacaaaatttattaaaaaaaacaatgcataacaaaaacctaagtactatgcagagttttgtttctcacaaagagaactctactgcccgcgccgcgacgacagaaaccaatgcccattgcaaaacacctgacagcaacatagttaaatagccctaatctcccaggtaataggagctaggaatcgtgggcgaggtcctaatggtcctaccaatacaaaaatatgcaacactatagccaatatataatccacatcagtataaaaactaaagtatagcaaattacatacacagatttctaaagttacagttataacaatagcacaattgccatgtaagttttcaaaaattacactatgcagagttttgtttctcactgaactagtgctctatatggactacaaaaaaaaaagggaaaagaaccaaataattaacaagtcataaaaattacatgatgaaagatctaaagttacagttgtaactttagtacaaaggtcatgtaagttttcagatttagatttaggcatttaggcatgaaacattaaaatcaaatataatatagcagattacatacaacaaatatacaaagatcatgtaagttttaaatccagctaactaattattttattttatttcataattaaattacatacacagatttctgaagtaacagtagtaactatagtacaatgatcatgtaagtttacatctgattcctatacacttgttaaattttgcaggaaaaaatgtatttggagagtctactcaactgagcaacatgctgggcacaggagcagaacaagtcatcaaagaaaaagaactaataggtatttatttgtgtgatatatgattaaaatcaatcttcccaaaatgcataaactcaaaattacataggcacacatctaatattacatatgtaatttcagtggaattggactgtaactacctatattttcagattttcttttctaaaagactatataatcctatacacttgttaaattttgcaggaaaaaatgtatttggagagtctactcaactgagcgacatgtaggacaaaaaagctaaacaagtcatcaaagaaaaagaactaataggtatttatttgtgtgatatatgattaaaatcagtcttcccaaaatgcataaactcaaaattacataggcacacaactaatattacatatgtaatttcagtggaataggactgtaactacctatattttcagattttcttttctaaaagacaatatattcctatacacttgttaaattttgcaggaaaaaatgtatttggagagtctactcaactgagcaacatgcaggacaaaaaagctgaacaaatcatcaaagaaaaagaactaataggtatttatttgtgtgctatatgattaaaatcagttttcccaaaatgcataaactcaaaattacataggcacacaactaatattacatatgtaatttcagtggaataggactgtaactacctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacatgtcctatactgaatctaatgcaacatgtcattaatagtccacgcgttacactacaaccttcccaggtaagaatatttctagttatattaaagtacatataatatggatcagtaataacaaatattgcaggaagggcaacaaaacttcacaaggttgtttcagacaccaacagcatatcatgtaagcaaaaaaaaaaggagcattgcctatattttgatgacatagaaagaaaaaaaaattatacaatcatgcacctataaaaaagtatacatgtactaattttgtttattactaacaatgattaattattttaatcatgcagaactcaatgatctttaacaacaagcagattttccccaaacttgggaacaaatcatgcactgccaagcattgaatggaactaccaggaatttgatgaaatttacaacaacagcagtcacaatacttatgaggtaatattaacaacaaatttttccaaacttattaataaaaaactcattgctgtgaactaacatttgtttgaaaaaaatgcagatctcagaatggacaacaattgaagatttgtatgaattgaagaacacacatttcaaatcacaggtatatatatatatggttcaaaaataaacagttatattgacaagcatagaaaaaaaatagttaaaattaattttgctactaataaacatgcagggaaaatcaagcagtttcacaaatggagatgaacaaccagcaatatacacaaacaatgaacaggtgaaattgaaaacttgacagtgtaattagtagatatcatgcattattcataatagagcttacataatagtactatttaacttttgacaggaaattagtctatgcatacaagatcaacatatggacaaggagaatggaactgctcaagaaacagttgaagaaattcaaatacagcaaacagagcaacatgagacaatgccagaaagcaatgaaacatcaaattcagaacctaacagcagagaagaactaaatgaagaggatattgataatttcttgagaaatgatgaggatggcaatacacaaattgacaaaaagcacatacctgagcttggaatgaaattcaaaacagacaaagaagctcatggcttcttcaacttttacgcttatttagctggtttttctactgtgataactcatcactacaagtcaacaagtaaaaagagaaatggtgagattacaaagtatacatatagatgcaacttgcaaggaaaaaatgaaccagaggacaaaaatgcagaacaagaagaagaagaacaagaagaagaagaagaagaagaagaagaagtggaagaagaagaacaaatagaagaagcaacagaacaagaaaggcaaactaatgttcttaaaaagactggctgcaaatgtatgatgatggtggaaaaaatgtttgccctaggagatgtatggcaaatagcaacactagatttgaagcataaccatgcactttgcccaaggagagaggcaaaatttctgaaatcgcacaagaatatgacaataaaggagaaaaggctaataaggacattgaaggagtgcaacatacccactaggagcatgattgttatcctctcatttctgcgtggtggcttgccagcactaccctacaccaagaaggatgttagtaatgttggaacagcaataaattcagaaacaagaaacaacgacatgaagcaagtgctggcttatctcagaaaaaaagaaatagaagacccaggaatatcctacaaattcaaactagatgaaaacaacaaagtgactagcatgttttggactgacgggagatcaactcagctatatgaggaatatggtgactgcataagttttgacacaacttacagaacaaacagatataacatgccatttgcaccatttgtaggagttataggccatgggacaacctgtttatttggatgtgcattcctaggtgatgaaacagcagaaactttcaaatgggtttttgaaacatttgcaacagctatgggagggaaacatccaaagactataatcactgatcaagacaatgcaatgagatcagccatagctcaagtgtttcaaaacacaaagcacagaaattgtctatttcacattaagaaaaactgtagagaaaagacagggagcatgttttctcagaaatcaaacaaaaacctatacgatgaatatgatgacattttgagcaactgcctgacagaagctgagtttgaatcactctggcctcaaatgattgagaagttcaatttgcagaatgtgaattatttgaagataatgtggaaaaatagagctcagtttgtaccagtctatttcaagtatgatttctgcccttttatacagagcacaacactaagtgaggggacaaacagcagatttaaaagaggagttggcccacaacatagtgtaatgagtttcatgaaggaatatgagaatataaatgatactatctttgacactttgtacagcaaagatttccaatcaagaccaaagaagccaaagaccttgtggttcaactatctcattgaagagcaagcatcagaactatacaaccttgaaatattcaagaaattccaactagaactaaaggaaacattgagtttgcaagtatcagtgctacaacaaggtaaagtttatgaagtgtttgtgtcaccaaccagcatacagaaagaatatagaccaaggaagcatatagtcattgttgacttaccaaatgaaaactatagttgcatctgtggaaagttctcaaaggatggaatgttatgctcacatgtcctgaaagtaatgttggacctgaatgtcagaaaaattccagaaaaatacataattgaaagatggagaaagaaggaaaggaaagaaacaaaaaagcacatcatgcagaaagaaaatggagataattcagtcctaatgtttaatgtgctgtctaggaaaggagctgacatagcttcaaaagcatcaaaaagaaaaagaacatatgattaccttgtagatgaacttgacaagttggagaagaacattgacttaatgattcaacaggaagatcaaactcaattctcacaacatcaagacagtggtatagaaattgcaaatgcagagcaacaagagcaagaaaaagatgttcaagaagagcacatagaagatcctgatacagcaaatacaaaggggagaaaaccaaaaaggtatagaagaatagtggagaagataatagaaagttcaaagaagaaaattgaagaacaagaagatgcagaagaaaatcagaataaagcaaggccaaaaaggaataccaatgaagaaaaacaaacagcgaattcagcaaccaaaggtaatgctgaaaactaaagaaatgtcatgtacaatgaaaaaaagataaaataatactaaatatttaattgcaggaaaaagaaaggcaacagaagacaagggaacaaacaagaagcagaaatcaaaacaaggctgaggaagcaaaagcattgaagacagaaaaaaaagaatacatatatgacttttatagttcatgtaataggactgaatgagttttatatgtgctacataagtttctgtatgcatatcatatactatgtcaaatagaaaactataactttatgatgaaatatattctatatacacatttgactagacataaagctaaaaatgctgatgtgtgacactattcaagcatcaatagcacggtgattgcttggaaaccttgcctgcaaagaaaattaataatataaaacatatcaaaatttgataaataaaacaagtgtataaagcattatttgcaaaaaaaaatttgtggtgaaaaaaagaaacttactgaatcaaaccaattgacaccaacattttcaacttcggtttgcaacatcttgttgtttggatgaaaaaacatctgattcgcatactgtacgcggatattgttgatattttgtccagtgaattgattagaaagaataattcttggagaccaaatttccatgaacttcattgagaatatgcctgaatcaaaactacaaaacataacaaaacaataactaaacttattttgaattttttattacatctgagcaacaaaaactgaatatcatttgagcaaacaaaaaactgaatatcatctgagcaacaaagaatctactggcataattataaaattatgtcactaaactaaatgcagattttggtggtcaaaaaccaatcaaaatatcatcttccaaaaacaatacaacctacaaaaatgccaaaaaaaatttgatttctcaaaaatcagtttgaatttttttttgaaatgacataaacatgcagcatctaatatatttcaattcaattaccaagggataatttatcatacaaatatcaataaaatattgacagatttaaaaactaacctgtattcttggcgtggaacaggtgggaacttaattttaaaagtgctgaagttcattggagtgcgttcatatttatcccacacaatctgcaaattttttaactgcaattcatacataacaataaaaataattaccagcaaattcattcatatcaatatagttgttaaaaagggaaaaaagaacatggaaataaaagtacaggaaaaacacattaccagcaaaggcagaattggttcaaaaaactcatcatctggttgatgcaatgaatctaaaaacaccagcatcctatcttttatatcaacaacgagaacaaaccagtgctgaccatgtagtatagggaaaaaaagctgcaaaaaaacaaaaacagaaacaacccatacagtaaaaataatgaattacaacaaaacaaaataaacataattagaatagtaaaaatcaataccatgtcacaaaggtgtagtggccgagcactagcagctccaaggaaagattttttcactttttcttgatcaacaaaatcagggtcaagaataagttgtgcctagaaaagatatattgtacaatcagtttggggaaacaaaagacataattttaaatttttttacaaaaagatgtaatgtacaaatcagttagctcacttacaccaatggatgggaagaaataatgcttcttagattttgatggatgattgttttgaaacaaaaagcggcagaaaactgacatgacaaatggcaaaacaacaccagtctttttgagagaatggccaaagctagaaaacttggctctgacattgtcgatatcaacagcatcataactacataataaaaaaatgaataaatagtaaattaataatagatataaatgaacaacacatttttaagaaaaaaatcaaaaaaaaaatacagatggcaaattaatctaaaaaaatggctgtggcaatgtttctgatgcttctgctacttaacttgtaaacaaagggttcagctgtaaaaatgctattaactgagttcagtggatgaaatctagaatcagacaaaaaacatcgcaaatactctaataatgaattatgcttagcaaaggacaaatcagaacatatcatgacagagacatagaagcaaactgattgataaataacagaatagaaagtgcaaacagattaacaaaaaatggaacatcctgaaaatttaaaacttgtattgtctaataacaaaattgatgaaatgctaaaaatctataccaaaataacaacaaaaaggaaatattacctcaaaacatcaagataatattacctctgccacttggaactatctgctaagcgacagagagcaatgtaatatctgttctcttgatcggacactagaaaacgacgtttcattgcaggaacaaatggatcagaagcatgcctgctaggaacaattattcttctaggaccatgagcaggtaattttccgcctgaagagctcatcccatgtgtataccgtgatagattattggttgcattgtatatctcttcggttttaacacaagattctttaacagtttgtggaaatttattttcacccaagaaaacaacatctggagagttctacagaaaacaacaaaataaaaacacaactaaatttaatttgaaaaataaaatggcaaaataaattaaaaaaacacatttctatacttacagtcacatcttgaaataccctgttggaaaaaattgaagaaatttgattaatcccagctgagttctcattacttcttatattgttgtgatcaatgacatcaatagaatcagggacagatcgaaaagatttgcacagctacaacagaaaaatgaatataaatatatagaaacatcttctaaaagaactataaaatacagtattaaaaaacaaaactagtaccaatgatgaaggaggagtaatatctccatgagcttgattatcctcttcatttaactgattattggcatcatcattagaactactaacatcatcttcagaatcaagcaatttgaatgaaggccttgaaaaatcaataatattgtctctggcattttgatttagtaattctggaaatcttgtcttaaacttctttgcaacattatgaatagaagcagcaatggttgcactagcagaacctacagaaacatagtataaccaaaaaattataaaaatttacactatttagcaaacttataaaagaaatgaaataaaatatcaatgaaaaaaacataccagccaaattatgatcagcacaatatttgaacttcttcacaaaagcactcttaggagtcaacaactcataatctaaaaaaaagcactaagtgaagagaaaagaaaacataactaaaataacatcttctgaattgaaaaatgtattaacaaataccaaaatctctgttacttgatgagataagtgcagcagcatgaccagatgcaataacatcatcaccattagcctaacaaagaacaaatgaaaacaaatcaaacttaaaacttaaaaatgggaaaaataaatataaatgatatagaacaaaaaaatacttacaacaaaagagttgacacatggatcattttcaatgggtgtacagacaacaacatcatctggtattgaagcatcaacatctacatataaaaaaataaatttaaaaaacatgcatatagaaaataaaaacagaaactaaatttctaatcagaaaatactaacttgtattcattggggtagaaataccagcattatcatcaaatctagaaggaacagcattacaaccttcagtattagtatcatcaacatcattttgaactttatctgagggtgtaacactatcttcagcaaccagaactagagcatcaataagaacatcttcacaagtatgactcccagcagcatgaacttcagaacaatgatgttccatcagagaacataatttctctttcatactaagaggcaacacagaacctagagcagaatcaagtttctctttaaatgaaattcttctctcagcagtaggatgaggctaaaaaaaatgaaatctataagaagactaataccaaagttacctagtaataaatcaaaaaaggggaccaaaaatatacctgataataacacacagatttaaaatctctaagaggcctaagaccaaaattatcatcatcaactttgtcaagatcagagtaagtttgtatcatgttcttagtccaaacagcaatgcgaggagtgctatttccaggattcttcttgccaaaatcaacatggtcaagataaagcgcctaacaaatttacatttaagtcatatattactaaatagaaaaataacaatatcataataagaaataaaggaaaaaaatacttacagcccaatagaataagcaccctccaaggttgttagacttgaagaactttttcagaaaagtcatagtccaatcataaatgaactttgaccaatcataatttctcagattttcaatatcctcaaaaactgtcagatacttggtgctaggcgtcaaagatgaatttgggcaaagaaagcaagctagcgcaacaatcagaaatgatgtgatcactttatcatcagaaatctattcctttttaataaactaatcaccaaagaaccgaaacgaaggtagatcactgagaccatactttgatagaatgaacttctttccactttcaaaatccctactgaattgcaaaccaccttgaggcaaaccaaaaatagtactgacagaatcttttgaaacagaaatcactttgttgctcaaaataatttcagaagacttgtaatcaacatgctttgcaatccaagtggcaaattttattagaacataactgctatcaaacaacagtagagatccaaaatcatagcttcgaatgacattcttttgatgctcagacagtgcagctataacatcagagaaatatttgcaagaaaacctcgagaaagatacttcattcttcttataaatccttgctctcttataattcataaaatgaaaattaaattaataaatcatacataactcaaacatcaatgcaatgtaaaaattataaatacaagtaggaaacttaggcttaatgatcagggtacactaatatttcacacataacaaaacatttaattatcaattatacaaaaaagtgatgaacaatgaaagacatgaaacttgcattggctgaaaacaaaaaataataataataattcatcatcaagcacattgtcaaattacatgaaaggtcaaaattggattaaaatgattaagataaagtagatacataaattcaacaaacaaaaccaaaaaattaccaagttcaatactaaatatttataaactgcagaacatgccatacaacacttaaatacaactataatttacacttgaaaaacatgacaaatgtactaaatcaagaaggatacacataatgcatatataaaagatttaaatgcaagcatataaaaaaatgagacaaaatatcagaaaataaaacacataattgcaatatcagacaaaaataccttggatgtatggaaatcataagattttttcaaatgccttttaatctcatgaacaacctagaaaacaagaaacttatcataagaatgaaaggaacaaataatacaaaaataaatttataacatacctctttcctgtgcattcttaagattaaatcatccaattcagaatcactactggattcactatcaacattacagtcttctaaagcatcaacttcaattcgatccatctaaataacaaaatagacaatgcaacaaaacaacatgagtaaaaaaaaagtggagtttcatcagctaataaacaaagtatatatagagaatacttttataaactattagtataacattttaacagagataaactagtactataacatgcatcaaaagaatgaatatcaaatcaaaaataaaacattactactaaaaaacctagtcaacagatctagttaaaaactagatgtcaaacataaaagctcctaaacagatcatacataaaactaactaagttcatatttaaataggaataaacagatcagattcaagtatacatatacatgagtacttcaaattgaaatgtctgccatatatacctcaagtatacatatacatgagtacttcaaactagaaaactaagtcagaaacatataattaaaatgttcataaattgaaatgtacctacattcatacactgatagtaaaaattacattgctttcaacctaaaattacatttgtaaaaacagtagatttggcatgtaagtacattgtaattttagtataaatgcactgtaaattttggtaacttaaatatgttaactcatcaaaatttcataaagtctccatcaacagtaaagcataaacagaaattatataaaacaagacagggcacagataaagcacaaatcaatcagtcaagctatgaggctatatatcaagcacagattaaaaattttgaaacaactataaaaattgcataaatcatgaatttaaatactgaatcatcttaaaaataaccagagctaaaaataaatcatgcatttagatacaccaatagctaaaacctactcagatccaaaaccaataaccaaaaaaaaacatgcaacaaattacactacaaaaccaatcatcacgagtactgtcttagtgattcttaaactagttcaagcaaatcatgtagagctttagttataaatatttcagaaatgttggcatcatcaaatgtaattttacagatctggagtatactaatcactaatacaacaataacataagccatcttatgattttgaaataaaaatcaacagatcaatcacactgcatcccgagcataaaaggacacaaaaaaaccagagaaactgaaacaaccataactaaacctccagtttgaaccctagccagattcaaatcgaacctagcctgattcaaatcgaacaaaacaactaaacctactcagatccagaaactaccactacaaagataactaaaaaaaacttgcaagtttgaacacaaacacaaatcacggcgaaatcaaatccaaactcctatgggattccaaaaactacaacgatttaaaacaaaaacaaccataaatcacaaaaaaaacaaaccccctttcaaaaacatcaaactcgaatcctagcatgattgaaatagaaaaaaccacaaaaaaaaactgggagcaagcagcgcagcacacaccaaactgtcgaatcaacaaattttgcccccacgccgaccacgcaatcagactaccaaacgaactagaactcaaatcaacaaacctaccaaaccaactacatggaaaactaccagatctaccatacgaactacacaaaaaacaacaataaacaactcctcgtggacatcatcaacctcaacctcaaatcatccatttcatacatccggaaaaatgccgagcacacacacactctctctctctctctctctctcaaaaagcaaaacactccacacataaaggctggaaccctgaatgcaggcataacccagtgagccgttctccatctccatgagggcaatgtcatacacttctcgtatcggcgggtcaatcttagaaaagcagttcatgccccagttgtacttgatgattgcattctcgttccgaagtgtgaagtagatttcatctccgacaagggctcctcgcctgggctggacataaggtgtacggtatgattcacctctagtgatggcttgcaaacgctcttgccaggtttgataaccataatcaagaattgctggcttgctccatgcacccgtctccgacgagtacacgctcgccttaacgagttcgtcctcatcgtccgtggccacaaagaccactctgaagggacagccactcacggcacagaacactgcggcagtgtacatcagccacgggatgccaggctctggcacgcggtgctgttcgcctgtgacggggtcccagacaatgagataccaaccgtcgtccgacgcgtggaggagggcgcggccatggtggcaatcgagggcccggcgaaaggtgggatcggggaagaggggcactgcggtggtgcgggcgaggtggcggacgggatcaccctgtaggacttggcgcctgtgaaggaggccgagcaggggaggggatccgtggaaggcgcggtagcggcggagaaagccggggtcgcagatggcgcggagccactccttgcagacgagggcggcgcgaaagaggtgccctggctcgtccggagggaggcggaggaggatctcggagaggagctccggcgcgagcgaagcggtgatgtcgtccatgaactccgggcggtggcagcggcgccatggtggtcggcggaagcgagggtttgggtggggaattataaggattggagaatagaggcacggggcacactgccttctttgtactacaaatttgctaacccgttagaccaactttgacacctgcgttggatggtgtccatgatggacagtccatctgtgcatcatgtgcttcctccgttttatattataaaactttttagcattgttcgcattcacatagatatgtctaaatccattaacatctatatgaatatgtatgaatatagtcaatgttaaaagtcttataatataaaacggatgaagtatttattatggacacacacctattatcgtcagtactcggtagctgctatcaaaatttgaatttaaaacttaaaattcttgattatagtcagttttctagtttttcatcctaatcattttaatataatcttttacatgcgtttgtaatacatgaaaattttcttcatctttggtcagtcatgaccataccttggagtggtaatgggccaaggtttatacgcatttcgtatcccatctcaatctttaaatattctttaatcttaaaaatctactaaatttcagtctaaccctttttatccggtccttatattttgtaggtcaaaaaattgggctcgttaccacttctatccatactacgctaggacccatgtatccttaattgatttttttatacgtgcacccaaacacaccacactcgctgattcgcacctccacaaatgcatcctctaacacatgctcaaagaaatgaaaatctaaacggcacatccctggtctaactaaatcatattgaaagtccaactgcatatgcgagtaatattgaatcccgtagaaagatcatcaacatgtgcataatattcatgaacataagatttaaaccctcaaggtatcatgcatccacgatttcaccgcccatgattccaccaccacaccactagtacttacccatccattattgatttctatttgcacacatatacaaatggttaaaaccacaaaggatatctctactaccttaaaagtggagttgttattctttggtcacctcctcccattttgcaccgcccacgcatgcttagtgtactacgtaggtaaccaccggatcaatgttttatcactaatattcttacaacatatggacatgttaatagtctacaaataataggcagtcatacgatcttggatcgacagactagattaaactctagtacggggtaaatgtttgcaaccaattggggtagagctaacttgacatacgatattttacacaattttcattgtctaactaagatagcgtttaattataacagcatcatcatatttttacaactactggcgttgtaatctatacttaattaaaaaatacatgaggctttcgtaacctttgtcgtctttcatcgtctctcagttggccccgctccgtttctcccccctcccccaagcctccatctctctccctcttggatcttattccgtatttttttacaaggattccgttttcttagaagtccaatccattgcacgcatgctgtgcacacctccagctgccgcccgggccaaaccctacaccgctgacacatcaatctgcctccccgtgagtttcctccaattgattgcggattcgcatcgattatgggtgaaacaaaaagaggagatcgagtggatcaaaaacccttaactggttttgggagatcgagaaagattcgtccgaatttgatggggaggatcgactttggcattgtacgggcacaaggctgtcgtccggaggttaaagacgctactaaagatagttgatgtatcactggaagaaaaaaacacctttacccattgcaatgcacgaacattttttctagtaggaagagaagatagaggaagttaccgaaagaaagtatgatcagaggacagttcagatgttagtgtacaaggagagagtgttgttcgacggccgcgggaggcggtggtatcacaagttctagtagagagaggagaagaggattgtgataggaagatattagtttaagacccaaaattaataatttcatcgtaatttagctacgtacaacaaactacgtgcctgtaacacctcacacttttaccactatagataaaagcgcaaggttgtggaatattatttaacaaagtattgttttttctaaataatacctcacaatcagagaccacaatagacaaaataattataaccacctttactttgttccagagttttgaggccatctctaatccatcttatacttgcaaagaatgggacctattgttgacaacttttttttggacgagtcacaaaagacaatcgacacacctaaatgtcttgcggtaatatgggatttccaaccaccgcgatctagaaaagccaaataaagatgggttaccggctagcagagcggatttaaagaccaaaattagcctcaaggccagtttagatcaatatgagggtaaacacccatctcatgggtgaattggaaggtttacgggacaaacttacaaaggaatttcgaactcttgcaacgatggcgaacgatttatggtgcaaatcaacaaagatggacgaaccaggcttgaactaggaaaaaaaagtagacgcgatattgaaaaaagattcaattggctaattacgttgaaaatagattatgttggttgtttttccaattgaactggccttggcccttataaaggggttcgtcttgcctcctataggtcttcctccacctcaatttcagggtagaaatcaattagaactcgaaaaatacctccccatgcaaggaaactcaagactcggtgaaatttgacccggacttggactctgccaatctgatcggccacacgccgccagtcagactagctccacacaccggtcagaccggcctataagcggtggtcagaccggccccgtgaaggaaaccgggcgccttccaaaatttggtaatgttttcctatttcgaatctaggtgccaaatttgggggttaacatatgccccctgcctttttgtctatatttgagagccaaaaagcgtagaacacgtggttttagggcgataacctaattacctgccatatcacctcctaagcatcttgccagacgcttgggaagtatttcttcaaatatttcccattgattgctctttaaaatcattctccttgcaaagtttcaagaaaatacgcattccctcgaacgattccacatatccgataaggaccttcccatctaggcaaccacttaccgaagtccttacatctagaacccaaaggaaaaatcgtcttccaaaccaagtttcctacttgaaatgatttttctctcactctttttatataggctttggctactctctttttttccttttctatctcctctaaagcctttagacgtttatcggtcacatcatcaagattgtctcccatcaacgtcctatattcttcggccgataaatcatcttgcttgatatatctaacagagccaagatttacctctactagtaaaacggcttcttgcaaatagattaactcaaaaggagtaactttagtaccaccatgcttagatattctatgagctcataacgcttcaaagagtacctcatgccatctctttggatgtccctcattatttttcttgactaatttcaacaaaatcttattacttgactcaacttgtccattagcctgagcatagtaaggagaagaacttaacaatttaatatcataagattctgcaaagcttttcagttccttagacataaaagaatctctttgatccgtagttaaagtttgaggaatgccaaacctatgaataatatgcttattattcttcaaaataaagtcaattacctccgtgtgagtcatattcttgagttgcacggctttggcccacttggtgaagtaatctgttggaactagcacgaaccgatgcccatttggtgatgaatgatgaatttgacctatgaaatccaaagaccaatctcggaacagccatggcttgatgataggattcaacactacagcgggtgctaattggacattgccgaattgttgacaagcttcacatcctctattgtacttaaaacaatcatcaaccatctttggccaatagaatcccgctctattaagtaaccatttcatcttgttgtaggatcaaggaagttaactagaggggggatgaatagcggttttaaaattttttgtctgaaaccgagttttgtatgcggaagcataaatcaaaacggttttgcacaattcaaaacctaaacaactagtctaaactaagtgcacaaagaagcctatgttgaggtttgcaagcctaggatgattttagcacaaataaactctagtatgtaaacttgctcaaagtaaattggcacaaatataaattgcacaaaataaagaagacaagagacaaagtatttttccacctgatgtttggaagtttgccaaagccaacttcaccactcaaatcaccaaacatccaaacctctcgtcaacagatgagcaaggtgggagccggtctcgaaatggtctcccaagtctctatcactatggttgttcttcctccactctggagatggcaaacaccgagccactcacaaccaattccaggccttctccacaaccttctcggaaaggtcactgggcaactcatttgttgggtaaaacctatcgatgacgggttttatttttggcccaattgagataactgttatccgtgatggctaaatgcttgatacaaatgacttctcacatctatgacctttggttcgtgatgggagcccttcctgatacaaatgagggtttccgcccgattgagatgacctatcccgtgctagtggttcgtcaccaagattttttagaaaaaaaatactgaattttagaaaatgcatgtactagctaattgtaggagttagggatgaaaacggagcggatagtttccgtccgctccggacaaaaacggatatggatacctttcggatcagataattctcggatagttcggatacggatacgaatacggatattttctcccgaatacgaatacgaatatggtaccagggtttccatcggatacggataataattcggatatccggtgaacagtgctattcggatatccgcaggaaccatgagacataccccatttctttctaactctataaccttcaatatacctttatagattttaataatagtttatctcttaacactagtccatactattaatattatttaaattttaaaaaatatttataaattatacctcattttatataaaatgagctaattatatatgttgatatttgtttctattagaagttgagttggttttcgtgttccgagaaaaatttgtttccgtattcgtgtccgatcatattcgattcttattcgtattcgagataatccgtatttgtttccgtattcgagctatccgtatttgttttcgtatccggtaaaaaatatgaaaacaaatatggtatgagcattatccgtccgtatccgctccattttcatccctagtaggagtgatatgtagtagcatggttgctacatactctaatccctagcatggttgttatttagaactcgacagccgcaattttgattcatcacatagcaacaacggagtgagtgacgatgaccgcgaagggaggggtggagacagtggaatataatgaagggattgctacatatcttggcctttttggcttagttcgtttcccctttttccaaactcatcactctctttttccgcgcgcacgtttttcaaactgctaaacggtgcgttttttataaaaagtttctatacgaaagttgcttaaaaaaatcatattgattcatttttgaaaaaaatagctaatacttaattaaccatacactaatggactgctccgtttttcgtgcagagaagtttgttcccaaccatccaaaactaacacagccttagtctgtttggttatcagctcttaaagccaagtaaaacactgaacgctaaatcccagagtagggggaaaataaaaccaaaggctgaaaataaaaacggcctttgtgtctttctgatttggtgcaacatttggattgcacttaatttgtgcccacccctacccataaggttgtgaataaatataggagttaacttatcaatacacgatgctcttttccgatgcaaatgaatatcactgtgaatatgcatgtcactcaactatgaccctgtttggagaactagccagagttattttgaaagcttatttttagcacaaggaaatagtcctccaataaaatagccctaagttgtttggatccaagagttattttgagagctatttggtctttaaggtaccttcccatggagagagatagagagaagacatgttttcagtgggccccatccaaaatagccccaattagcaccccttgagtgggatattttttttggatgggttatttccaaatagctctcaaatagctcactcttttagatttttttggactatttgagctatttaagggagggttaaaaatatcccttcaatcaaaacagagtccatgtggcaaacaagtaatttccctaatatttttatcagatggaggttgtaccgaaatgagtatgaaggcctggaactaaaaaataagagcagcaattttggaaaggtgggaattcaacgacggaaacatggctatggcacataggaggcaggcccagatctcactaacaatattacacctactagaaatatctcatttgttgcaaatctctgatgttaacaaaaacatatagcaaaagcatattctctccgtccaaaaaaaaaaaaacccacttctgggtttaaatctggacataaccagaagtggatttttttggaacggaaggagtagcaaatatctcattaattggaaatatgatcaaagcagttatctgcataaaagttccagttatatttatctggatggcatgtttaaaaaatatgcaaaagcatagcaacttgttgatctaatgaataaaggctgaacacatggtaacatgtcctagttatatttatctggatggcatgttgcccttgatacaaatggacggtgcattagaaacaggagactagttttgggtaatagaggcggtacattatagaagaatagtgccttcacattccatcagtaaagtagttgacatggaactcttcaagcagttcagaagtagagttatgctcaaagagacggtgcgatactctgcccatcaagcatgaactgcaaggttgatgccacgctcatctgagtctggggctcagctgtttgcttggcattcttaaccacatcatttgaatcgacaatgtcatctattacattgaggttactgtcgaatgcctccaactcatgcagccccaatgcatttacatcactagctagcctcacatcctgaccacgctggtttttcttcttctccacttcattctcttgttgcaacttctggtacttcagattgagctcatgcactatgtcagtctcatcaccattgcccccatcacccatggtagggttactaggacccacaccaagtaagcgacgagtgacagcttgaacagtagggcagccaaagaaaaagggcttaccagcaggtgagagcacagcaacagcaacattgacaccacataatatgctgagttcgttagccttcttgattacaacctggcggcgcttggagaagcatacatcacgagcctttctatttgcaatgggcttgatcttaacttttccccttctcatggctgcttacccttcactatcacctaaacaaaaatgtgttctctgtattttgtcaagggatggtacaagaacctttatatagacctctatggagatgaaaaaggaagtgataagtctatattttgtaagaaatttattttgttagtcataagtatatacaaattaatagttgccaatgaatctagccaattttaacaattcgacttccaaaattgacgtttgtactgataaaaggataggctagaattgtgctaactctaattttagtcgaacgactatattgatcatattggtagggagtaatggacgtcatgacatattgctggctagtaacgcccctgattttacgaggcgttaaaactcttgtttagtaaaagattaattactttttttttgcttttccactgtcatctcataagctgtgtcaaataatctcatgttatgcagttcatccctccaaaaaagcaaactccataaactcgagtccaatccatgtttcaaaaacccaaatattcaaatcccttctaaattaatttaaatattacctccctctaatccaagttacaaaatacaaaaataaacccaaatcccaaaatcaagttccagaccaaacaccataataaaaagtacagttcacattttatgttgaaagttcatttaaattttccatggaattccctcattgtatccgtcttaattcaatatctcgtatccctttccatgacttctaatctcaatatttgaattaaagtgcaggtataaatgccgcaccacaaagttactctaaaatttcaccctttaatttcattccttaaaattggaagaatcatcaagagcctactacaatttaaaaaatcaccaagtagtaactcctaccccatcttaactgccatcttagcaaaccttttgcatcatgtcctattggcaggaaaatgtttttgataaggacggaatatatggattattggagcatcatcgatctcttgcaccaaaaaatgctcaaggcttgctgttttcgtttccatttcatgaataaatgaaagtcatgcagtccttcaaacctacttgttctgtcgaatttttttctgcttgtttccatttctaaaatacttgtggactatgatacctgtttcggttgtagactagtactgagtactgactacggagtactaaggcttttgtctgatcactaccatgctctattatatcccacaaaaattctatgtgctgatctgttttcaaatagccctattggtttgcaaaaatatggttatataattgttagctatttattttaaagcttcatactttcataaacttttattgtagcttcatatctacatttatagttagatctttatttcaggttaactatttgtttaagtttagattcaaaattacagctaatgtctccaatggcgaaaaaacataatatccacactattttcttgtaactattaatcaaggattaaatttctgggatgttaaaatcccttaaaaacttgatgtacataaaaggcactgacaaggtagtcaccttctgacaggttgaaactacggagtttaagaatcaagattttgtttgtcgaaacttgtgcaatgaagaaaggttatatcttccatcaaataaaaaaagaagggttatatctctctggactatacatgccatttattgatccaattcagaatttgggaggaatatataaatccatcctaaaagaaggccacacagcaggaaaaactgaagccgtcccatactcagagttggattcaaaaactgataacttgtaatacatccatgctgttcagaaatttccatagacatcacttacgttattatccaactatgttaactgattaagcaaaagcatacacaactctgtccagaaagaagcagcccagtagcagcacgggccgaacgaaacactcagccagccaaaacgaagaaaccacgtcagaggtaaatagcatatacaagggcaagaccactaagttcagagaacactaataaagttaggagaaattgataaaatagaattcagagaaagaaattctgatacctgagccttcatggcctcatcagcgtgttgatgcttattccgatagttggcccattcctgtaaggctggaatcaaagcaaacatcaccggagccatcatgggcgtcttgatgctcaatataatcacagaaaccatattacccaaagcgcaaaccatgctctcaaaacgaacaataaagaatagggagccagctattcagcttagcacgacttgctgatctctgaatggaagcaacataagtcaacataattttagtttcatgtacctgagctcaacataaaacaaacagtaactgaaatgtgccagacatgttagactgcttacagttcatggtcggtaggatgaatttgacacaacaaccacatttgaacatcagacttggcattgttcgtacttgtactgcccaacaaaaaataaacagcttagtagtagtagtagttctggaagaagtcagtggcagcagattcaagagtcaagacaatggatttgtccattttgcaacaagttactcttgagcatgacatcaaagatcagtgagtccttgctagcgataacaatgtgccacgatctgaaaagacaccaaacaggcaagtgaacaactcataaccaactgtttccagctcaaagtatacaatttaacgagctatgcacttagaactaactagtttcaaaggttgtaaaattgggtttgagttgtgagcttcagctatgctagagagcaacataatactttgtaaagaaaacccgaaacaatacgataggataatattatatcaagaaggttctttaaatatttagcaatatccattttagcgtagtagccacttcatgttttatcaattacatcaactattccatgaatcaactgagcctgagaagttagcttcagctatgccagataattaacagaaacctttgtagcagctaacagataccagatgcatggtcatggttatttcacaagtcgaatctcaataataaaatttaggttcttatttccaatgccatatattcagtattctctagcatacacaaaacagcctttgtcaatccatataacaaatgttgcagttatattatgactaataagatatatagaagctgtaaagaaaatgcatacagcagataagcaaagtcttagtacaataccaggagtgtagaagctcatgtagggtaagatgctaaagtagacctcaggctctgcaaccttcttcaccctccttgacttgagctcgatcgtgaacaagccaacacctgtgctcacgaatatggcacccataccctccccagagccaaccacaaatgcttcatcactgagattggcaacaggtatcattttgtccagcttgatcaccctgcattgtacccattctgctgccccttctgaattcaccttccgtgaccacacataaaggctggaatcctcaatgcaggcaaaacccagtgaaccgttctccatctccatgagggcaatgccatacacgtctggcgacggcgagtcaatttcagataagcagtgcatgccccagttgtacttgatgatggcattatcctcccgaagtgtgaagtagatttcatctccgacaagggcaactcgcctaggcatgacataaggtacgcggtagaattcacctctactctgtgcatctcgccatcgctgttcccaggaatcaagaccatcatcaagaactaccggggtgctccacgccccggtctccgatgagtacatgctcgccttaacgagatctttgtactcatcacgggtggatcagaaacaaaaaattagggaggctcaattacacagttttttcaacctccagccatttagggacttttagttcattcatagtgaaaaaatcgaagggggtgctccggggtatccatgagttttgtgggtgtaggtgttggatccgccccgtcatcggtggccacaaagaccactcggaagggaccgccgtggcagtcgaggtggtcacagccgctcacggcacagaacacagcgctggagtagatcagccacgggatgccgggctctggcacgcggtgctgttcgccggtgacggggtcccagacaatgagataccaatcatcgtccgaagcgtggaggagggcacggccatggcggcaatcgagggcccggcgaaaggtgggatcgggcgagaggggcactgcggtggtgcgggcgaggtggggggcgggggctccctgtagaacttggcggcgtaaaggaggccgagcaggggaggggatcggtggaaggcgcggtagcggcggaggaagccggggtcgcagatggcgcggagccattccttgcagactagggcagcgcggaagagttgctcgggctcgtccggcgggaggcggaggaggatctcggagaggagctccggcgcgagcgaggcggtgaggtcgtccatgacctccggcgtcggtggcggcagcgccatggtgcgcccgtggtcggcggagcgggggcaggcgagccgcgcgacacgagagggtttgggtggggattgggaaagagagagtgagagaccaagaatgggcaaggggggaccgaccgcacgcccgcacccgcgctgccttctacccggtccggttcgaccctatcctatactacaaatttgggtttgcgaaccttcgattttgagtaaacaaggcaatattcgtttctgttgaattttgatctgctttaagatctgcattggatggtgggcctgcatcatggactgtaacgtgatactcccttcatccacaaaagttacacatattatttttgacaccaagacgtaatctttcacattccgccaaagaagaaattagaaaaaaactataggctgacgccaaagattccatccaaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactttttcatttcattattatcttcttgggcgtagttagaattatctaagataaaatcgatttcaacgtcctaaattagaccaaaggaattctgtctgctagaataataaaaaacgcttcggaattcatctcatcctttataatataatggtatttttttctttgttcagcaataacttaatcttgaaatgaaacactcgttataacaattaataaacgaagaaattaaatcatcttagatgttacaaaatcaagtagtaaatgtaaacatgcaaccaatgagtatttcgaggactccttaggatctaataaaaacatttaatttatctcttcatttaagtcctgaatgtataaagactacaaataggaacaacttatttggaaaaactcaaatatgaaataggtgtaactgttgtggatggagggagtagttttattctcaaaataagtagtctgcaaaacaatgtgaagatgatatttatcatggaatttgacgatgtgtttggcacgacaagaaacattttagcatagcaacccatgagatggcccactacctagtaccacagtgagaaaggtgtaagactgtctccaacagagaaggcaaaacgcaaaatagctcgtgcacagttttttttgcatgtcagaaacagcctccaacagacgacgcaaacagaggaggcattttgcgtatgaggagagagagaacgcaaaattgcgtcgtctctctccaagacgcaatcgtctgcacggcgtggtggtgggcctgaagattcgcgtaggggcgcggtggccagcggacgatgacatcgaggcgagcccgcggccggcgtttccaggcatgtccgcgacggggcgaggagggccgatgacggatcctcgtcggggggcggcggcgcggcgcggtgagcctgcgggcggtgcttgcacggcggatccatgtcggcgaggcgtccacgtcgacgaggcgaggaggatccgcgtcggtgcgaggcgcggcggcgaggcgaggcggatctacgtcggtgcgaggcgcggcggatgcgcgtcgacgtgcgtcagggcgaggcggcttgtcgggcacggcgggtgcgaggaggaagacggaggatttgcgttcgtttgttggagttggctttgttttgggtgcccaccttttcctttcaacgcgaggcataccaggtataggtctcctattttgcatcgtattgttggagacagtctaatagtcggtgaggcaccttgctactagttccattgagaaagaagacgtgataggcgctagccgatgaggcaacaaaatgttttgtacggtgtcaacgatatcaagtggattgtgttaagacgaccacttaatctaaagcggggtgtggcaatatagccatagcttctcgcagtgttagtggtagggattctttttttttttttacttgatgtagggtgactaggagcacctaatttgtgggcatcgtttttattttgttgcacgtacaaatcaaaatgatgttttataatgattgattaaaaattgagtggatataagttgataggcaaaaaaaaaatatgttagggtttagctagttccgtgatcagtgtcggatggttaactggttatatcgtttgtaaatattacggttccttaaaactcctctctattttctgttgttcctttgttacaatgttttggtatatgttcgcaaattctacacatgcatcattatgttaattgtcatcaatgaattatatagtaagttgctcattaatattgcagcaaaacaaaggacaattatacacttattagaccctcttttatattaatatattagcatataggctaggccatctaacaaacctccaataagaggttactcaactgtctatttttttcagccaacaggtaaatactattatccggttatttggaaaaaaataaaagataagtaataaggtctttaaaaaacagaaataagttacgaaaagaaaagactgggaacaccagctcaatataaatgttctccaattccatcagaggttgtaaacgatgagacgctcatcctttaaccctaccacgattcaaagaaacaaacatagacaaattggagcagcaaaactagtcacatcctcatatcctctggcagtacataaccgctccaacttcttcaccagcttctcgtggacaatgtctagacaggcgcggtctttttgttttataagcactttccaactcatatgaaaaactatcaagacaatttctgtctatttagaactatatatataaatttcaaatttcaatactctcatgaaacaacattatacaatcgctaagttataagatagaatatggtgccaaacaatctagtatcaatacgattgacaaggagtgaaaaagaaaaactatgcagatggtccagttagccacgtaactatactgtagttgtacaaaagatgaagatgttctatcaggacatatttagctatgggaggggatgatttgtcactcgtagtcagtcactctcaccacaacttcatcttcatatcagcagcaggccagttagacaacatcttcagttcatctgttcttattgcatttacacatttggacaaacgaacaaatccaattcagtatgtacaagttcttcagcaagcggaccaaccttccgaggcaaagcatgtttgcagagcatagcatagtacatcctgtaaccttgatggtttttcatatgctgtatgagaacgatgaggtcagggagtaagggatccgcgtcaccgtggcaggctgctgctggagcttgtggatgtccttcacgatgtcgaacacggcttctggctgcgctagcttcagcgcgttgagggagtatctccggagctcgtttgtgtgtgtggtgaaccatctggcaacctgtctcgcggcttccctcgggtccttggagaacacaccggcaccattgtccacgacgtaaggcacattcccgacttcctgtgcgacgacaagagggacgatatttgtttagcctcaatatcttggccatcccttctttcaaaaaatattttggcccactcacgtgtatatataaccatggcccatatacatgcattccggtccatctaaacaagggctccatttgattttttttttctgagagcgatgtaattgccagactccacttaactaaaacagggactggatgactctttttttccaaaataaagtggagagcgctacggctcggacgtccgatatctcaccaaatattggacgcccagccgcagcgagcgtatgtgtgtgtatattgctgcacttcattcttcactcctcaatcatgaggaatcttcccatctaacgtcctatgtcccaaagaaaattggttggtcaaatgttctagttgaccaatgagtgaaacatcaaattatatatggtgaaacaaaaaatcagcaactgaaacatttaaaaattttatgaaacatgaaaaagatacatgttgaaacatatcgctatcacatataaaacaactagtgttaacggattgaaacatatgtttttctttcatcaaaatataatcatatgatatcttgttgtaaagatttaattacaacgaatataccgatgtgttcggatcatagattggataattagtttacgagaaaagttgttttgaagctcgctaaaatgcatgcatgtatgtatgaggtggagagaggagagagagtagtgagatgtagttccacgaaatttgtgaaacatgctgaagagacatattgaaacatattactattgcgtatgaaacaaagagtgttaatggattgaaacatatgattatttttaatcagaatataatcatgtgacatcttgttgtaaagatttaattacaacgaatacaacggtgtgatcagattgtagattggataagtaatttaagagaaaaattgttttgaatatcgttaaaggtatatgtgtataggcttgataggatgtgtgtcagactcagtccatccgatttttctccttcagtcggacgtccgaggagaagcattttcgaaataaagtacgcacgcatgttgtcatattgggcctgttcggtcggcattactgtgaatgcagttgcagttgctgcaacaacagtgtacacacgttttgactactttaaatttgactatgtttatgcacaaatatagtaatatttataataccaaattagttttattaaattaataattgaaatatattttcataataaatttgtgttgagtatagtcttaaaatcagaaaaacaattttgttactctaacgaattcagtatagttgcatccgcacacacctgtccaggtatgaagtcgttgagaataattgggagtcctcttatcagggcctctgcaattgtaccaggaccagcctgcaaacaggacacaaacattcctaagtaaaaacagtaaaaaaaaaaaaaccatcaactcctccatcagtccaagaaccaacctttgtgatgatgcaatcgcaagcgcccatccacttctccatctgcttttcgaaccctctaatctgagatcaaaacaaaaagagaaaagaaaatgtaaaaatgtcagccagtggtcactaccaaacgcagtaagagcagaaatgcgcatctagcacggcatcatcctccccagattcggcatatacatggtaccttgacagggacattccaccgtgacgactgcagcgtggaccgcagcacctggttcctgccacagatgacaacgatctgcccgacaggccggcgtctccggcgatcgtagagctcgtcgctgagtgctctcgccgtctcctccaccggacccatcccctcgccgccgcccatcagtagcactgcaggcaggtcgggatccatgtccagctctttcctcagctcatcctgtcaccccaaaccccgagcagagttcagttcagctctgcgtcagtgcaatgcagcaatgtgcggctcatgaagattatctgaaaatgcgcggcaaccggatcgaccgaccttgtcgagcacggcgcggcagaaggacggcctgatcggcaacccgtacacacggatttgggacggctcgagcccccggagcagtgccctcttggccacctccgccgacgggcagtagcacctcgtcacgccatggtggaacctgcacaaataagctctatcgatcaatctgagatcgcgccgcgccgtggcgaggccggcgagagtgcgtggctccggtgaactgaactggttaccatgtcgggtggcaggtgttgaggtcggtgatgacggtgacgaatggcaccttggggtggaggctctgccacttgagcacccacagcgggatgtgctgcatcagcgggtgcacgctgatgataatgtcggggttgtacctcatgatcccggccaccacctcgctgaaatcaaccatgtcagttttcgcgaatcgatcggatgaacagagacggaaacagaacgtgatttggattggacgatcaagttgtgatggctgcgtgcgtgcgtacttggcgtagaaataggccagcgcggcgaggtacatgccgtgcacccagcgcggcgaagtgccgtggaacgccaccttccagagccggacatggcggatcatgaacttgtacgaccgctccatgtcgttcagtggccacccgccgtactccttccccaaatctctcacgaacacctgcgcgaaagcaattcagttgtgattggagttcaattttttttcgcgagaaatcaagagattcatcaaaccagtttacaaacaattcatgtgattgtgagttcaaatgttttggcgagcaaattgaatttgggggcggctgtaatttcggagcggggaggagaggaccgaggcttggagcgcaaggaacagcgggcattgagcggacggaccgaccgacctggtaggcgtcgccgaactcgaggcggaaggcgtcgcggagggcctcggcggatgcgcggtggccgccgccggtgtcgctcatgaggatgagcacgttcttcgccgccgccgtcttcctcccgcacgggagggggacgccgccctcggctccatcctccgagagcgcggcggtgaggccgcccccggcggcgccgtcgtagaaggcgcagcggaggggctggtagagctggcggcctccggcgccgagcacgccacccagcacggcgtcgcggatggagcggcggggggtggcgaccgagatcaccatggcggcggcggcgggggcggcggcttctcctcctcgtctcgtggatcgagcctacgaaaggtttgccggcgaagagagagagacagagagagaaggcagggaggcgagaaggtggcgaggaagggaagggcggatacgccatttatcagtgctctcatatggattacttcaaattgccccttatcctttacatatttcttgttccaggccatttcaagttttgttccaaaatattcctctggctagattattaataagtatatagtcgagaaaattttcatgataacatttactcatctctactctatccaaatttcaaattcttaactagtcgtcattcgtagttacagagaaatataggcatttatgcgacaaagctgggttacacggtgcccaggcaaagtacaagcgggcaaggcaactcgggcaggcagtgcaaaaccacgaaaaagccccagagcgtccggtccacgtggcgaaatgctagtggccgaacgaattgcttttggggggttgggcacgcgcggctagcgggcgaaaggggatgattccgtcggagatgctgggattatgcttggaggattgcttcgttagcctcatgtctgttgctcaatgagtcgatcgagtagtcttttaccacacgcttaaaaaggataagagacagaaactggtgacaaatttctgatgttactaaacctatttgcacttgcatgtgctttacatttgtgggaatcagaatttaaaccttgatggggtggagtcatacacgtttaacgtctttaccaccacagaatcagtgcttctttgtctttggcttattttatttgactagtacatgataattatgagtatatgagttaaaggccctgtttagatcctccaaaatggtaaaagttttgccattttgaagcactttttgctattttggatctaaacactagtaacaaaacttagcaatttggcatttggcatttgctagtccatagtagcaaattgtgccaaaaagtgctttgggaccactccctctctctttctctctctcactttagtgctagaatggtaaaagtttaggatgcatctaaacaccaactaatacttttgcaataccaaaacttttgccaccaaaacttttgccatttaccatttgctattccaaatggacctaaacagagcctaagtattatgtggaaataatatagtaattctaaagaacccgtttaacaataattgatgaaaccatttgaattttcaatacttcaaaatctatagaatagctattacatgttacaacatgctcccttactccacaaataaaagaacttaagtttttttattttcaaaattaggatggaactatgatgcactccctccatttcattataagtcacttctcttttttttctaatcaaacttgttaagtttgaccaattttatagaaaaatttagcaacatctaaattatctaattaattttattaaatttaatattaaatatattttgataatatgtatgttttgtgttgaaaatactattatatttttatataatcttgatcaaaattaaagaaatttgactaagaaaaaagtcagacaacttataatatgaagcgaagggagtacccattaaattaggggtgtgtgggaggataatattggctaaatattacatgaggataatgaaaggtggttgggtgataaagtaatactctaagtacttatatttgtgaacagatggagtggtaaatatcagtaacaaggttagtacaacactacacaaatttcagattaacaaataagttttagactaacacactcttgtagtcttgtgttccttcctcctgcatctagaactcctagaccctaaaccctcatcatataatcaaataaaaatgacatttttcatatttctatgtttacaattgaagttggctattatactttttatgtaactgtatatgcatgactttagctaccagtattttagttatgatatttataattagatggatatgtgcattcacttttttttaataatggaatataacatccctgtctttgctcaagagagttacaaccaattattacagagaatgtgcattcacttattataatacaagttttctcaatatttacgaattagaacataaagaaaatatattctcattcgttgcagcccaagtgatgaggacatcctacaattgatacaaacatacctagtgcataacaaagaccaatgcatgacttgagcttgaacacaactaaaattgttccctgttattcaaacaaattctttttcgaatgatgattttattatgcttaggaacttgggacacgaaccatgtgggtgaaggaacagccacgacaatgaacaagtggaggccggcatgagcaaaggaaggattagaccaaatgattgtactacaagttcggatagcacgtttggacctccaagcaatggtaactttaattggacatagctctttactctggagggtgttgaggtccatgagtacttgttgaaaatgtcttgatgtcttctttgtagatggatcaagaaacactactacaaaaataatttttttacgagaacctctttatctgccaccgtaactggttgcatctgcaaaaatcatcctctatttttacgtgaggctacttaagaagactgcacggaaaaatcgattttcgcagacgggccttttaagtagaccgtacacgaaaatgagcctattttcgtagacgggcctcataaatggaccacgcacaaaaatatcactatcctttacagatttttttatcccatcatttctctcttttccctctcactcacgtcaaaattttcacctcctctctctcactttcccttttattttcactcttctctctctcttgctctcctctcctctcctctcctcttctccgagcgcgcggctagccctaccgcatgcgaaaacccctttcgggttgtccgcaaaaatctcttttataatagtgaaacaccaataaattccatcaatgttgcctagaaactacagaagagatgttcaagactctaacccgcgagttgggcctcttgtatctagaagagcccatcaagggagtgtcttagctagggtttcccatacctcctactattccccccatatataagatagcagcaaccaccaagaacacttccttaccttttatttagatgcaagtttcgcttcagctacttccttttactcacgtgtattggctagaccacccggatgcttgatttagaaccccaactttgtgtgtttgttttatcatctggcaagtgatgtaaatcgtttccttgtcaattggttcttgatgcctattcttttattgcttgcaggttcaaggttgtcggggcccaccctgtcttgataggtaaggaaactccggcgatcgaattctatactattacatttagcattccaccttctatttccagccagatagctgcgatttttagcaacaactatttggattttcaacagtgctgtcatggaatgtagaaaggctacccaacagccctctcaagcaccttactgctgacaatactatcacaattgacccatatatgccaacaaccttgtcacagttagtaccatgatgccatttccacttcaatggatgataggcttgttgggaatgtaccatgacaactagacactagcaatctgtcggagatatgggcccgggggtatgtggagtagaggggaattactttccctccggccacgtgactccgcaggctggccccactcgcgtgccacgcgagtcgtataagcgcgcgggggggggggggggaggggggggggccctcgagatatgacgtcaccctctcgggctctgccgcagcttcgccccgaggccctcacccgactgccgtgtggcagagggagagagcaagaggggagcgcaggctgagcaagccataaatgtgcgacgccccaactgtccctcaccgcatttaatgcggtcagggcagatgtgcggcgtgcctagctaacccctgtccatcggatgtgaccggtctgtgaccagcccgtctccgtcacatccgatggataaggcaaacatgtccccacgtcgccctttgtccccggcggagtgggggtgagtatgacccatcacatccgggcgccactcgaggaaggactgttgcatgtcaccgttcatttatgagggaatgatagggctgtcccccgtgtcaggcgggggacggcaccgggttccgcgcaagaatcggttattgcttagcttccggaagaaggcacagttggaagccaaaaaaggtggagtggggtttttcctccccccccccccccgcgatggaggggaggtagaggcggcatatgtggtatccccttaagctataaaaggaggaccctgcccaccgaaaaaagggggaggcccagaaaagcctgaactccagaagagaggaagcgagcgcgctctctggagtaaagaaacccttgtaaaacttgtccataatcccaaacacaggagtagggtgttacactctatagcggcccgaacctgtataatccgacggtgtgcattcactcctaatagtcatagggacgagcaagcgactaacgagagacgagcctccgcccccggccgaactcatgaaaagggggtctcacgactccctgctattgagggtcttccctcaacacaatcaatgtatgatagtgctgttgcagatatattttgtatatattttttaacatataagttaaaaggcatgaatttgccttaattttccaagagccaaatatattccctttattattcctctaacatattacttgtgtgaatttgacactcaccattcacgatgttgctttaaaacttttgaaaaagatacacaaaacttaattagagtatttattatattcctcataatacattttgttacgataaaaggcttttattttcttaaaacatgtactaaaaaagatatcatgatcaaaatattgaaatgtgaggcgagaaaaacaagaagaaatgtgaggggggaggaaaaaagagagaaaaataggcataattaggaagaataggaaatacatgagaaaatggaaaaaaaagaagaaaataggaaaaaaatatgtgaaattttaaaaaaaatatagggggaaatagggaaacagatgggtcggttgggcaatgctcatgcttgggtcgtaccttgtcggaatatcggcaaccatgccgtggtgtgccaagaatttatataagatactttgtgtatgtgtgaacttttttgcttgtaaatatataagaagaaagtaattagtttttgcaataatttcaaaatctgaatttagtagttacaaagttatatatagaagcaactgcgtattcgtaccgttaccttttatgttattagcttaatagttcttagatttgaaattcataaatacaaagttttactccttttcaaaattaataagttccatccttttcatcaaaactaataatgagtaagtcctatatgggaacaaatttataaatagaatgttgtatttgttgtggagtgataactattttgattttattcttcaaatttcgaaaataatatatacaatcctgtcaaaaaaatgttatatacaacgttgtatttttcttgtagtctaaatatcagttttcgtgataaagaactaaaatttggaattgatatacatatataaatatatatgtaaaattgtagtcagccaaaaaactagtattatctaaatctctaaaaatctagtatttccatccacttattacaattttttttgaatattttctagaaaatttgaaccagctttggtctaaaggaaataatgccttcgaaaaatacatctaaaaatctagtatttccatccacttattacaaatttttttttgaatattttctagaaaatttgaaccaactttggtctaaaggatttttttttgaatattttctagaaaatttgaaccagctttggtctaaaggaaataatgccttcgaaaaatacttcaaaaaaattgtggcaggaatcgaacaagggaccttgtgtttctcatcaggcatgcatgccaattttattctatgtgcgcgcgaaaataattcacttccctcggtttttccgcaggaaattttcatttccccctaatcccgctacacgatggcgattctcctataaccccgcgaactagatctcgcttctctctccaaagaagtgctcgctcccaagatttaggatcctaactgtcgtttccaaattagtttacttgagctacctatttcgtcggactttccagacagccatctccaaaaaaaaatcaccacgcagttctttcgattctacttggcgacgacatccatgtgttgaaccatgttcatcttcaacaacggtgattcaagggagagccggtgtcatattgcctgatgcaagcatcttgtagaccacaatcacaggtgcattttcttttgactagaagctgttcgatctatttccccttccgtaacttgagcgtacacgcatctgtgagttggtgtggggaacggggcgggggttgaagagcagtgctgcaatgatgccgccgccggtggtagtgaggtgtggtgaatggaggctgcggtcggctgggcacgtggttgtcgtaggggtgaccggtggccggtagaaaggcgccgggccaaggcgtgattgcacggggtggagatggccagccggctaggaagctggtgcctgcatctagaaagctagagactagagtcctagagctaaggttgtggttagtgtttcttgattactgaaaatggatagatgtaggaggagaaaagcattggagttctacaaccgacaggtgcatgtttctctgtactagttctattctctgcttttgtagtagggaggcactggatagatatctttgtttatctggaatcttgttggatgttgtggcaatgcacctgctatggattgcttcacatggatctgcagctttacattctgtaattggaactcagtagatacattgctcttttacatcagtctagattcaggatcactaaattgtattatcagattatatctaacagctaattgaatttattgtgtcatgatgtttcttggatggtaaaaatattaatattgtttcacagttggaccaaatgttatatgggtaagggcacctttggatgcacaggttatgtacgaatgcactggacgcaaggcacatgggaagtttgcaatggcggatggtgcaattgatagctcagaagtgcaattatccacaaatgctcatccttctcacacttacacagttagacctagccaaatagaggttgaactgcgtcaagagcttgctaatttcaagcatcagcgacaagaggattgccaatcaatacaaaatgctctatctgagttcaataatcagacaaaggaggttattcctcttttcatgatgctatattactgttctttgtttttactgcaatgtgaacgtgtctaactattgcctaatgaattcttattagtatatgattaatggatctgcaagtacacctccacctcagatcaatttggctgcattatttcctagccattcatctccaactactcagcaggtaagaatattctgaaaaaagttttctactacagatctgtactactttggagcattcatccatctttgtttaaaatatatatgtttgactaatggcatcatattttcttttattgtagaatactacaaataatagctccagaaatgtgttcaaccaaatagatggaaataatagtggaaactgcagccaacaagatgctggtttgagcaacaatgaacaggtattaacaaatctactcttttggtagttcctttttcagaatgattgataaagtaaaaaacttgtaatcatttgtcaattaaattgtggaacttagtcaatagcaatttctctgtcttctcaagtgtagatcaatatgaccatggaacattatattagcctagctatttttttgtacccacactataccagattatgcatatatgttacatacataattaaagataatgtgttgattagatatagtatgacatatcattccacatatttaacattattctagctttttcacttggagcttttattgagggccggaattgcttgatgtgatgtatcctaaaaaactgaagtcatcaatctctagcaaaatttacaattttcttactagctagaagtaacttttaccaagcagctttactatgttttgtcaaaaactagtttgatcataatcttgcgtagtcattgatgatcaccacatgagagtataaactagcttgtacaactaaaccattgtttcatatgctgaaccatatagacattaacctatccatagaacactttccaagtagactatatctgtttcaaacatctttagaagatatttttgtactgttagctaaattggagattggagggatacattgtcacctgatcctttttccttttagggtgacatgggaaacaactctgaaaatgtggtgttacaacgcatggatggaagcacatttggttattctagccaacaaactgctcctgctactaatcaaggcaacagtaagcgagggagagatggagactatgttgatagtgaagatgattatgctgatgatggaaactatgatgatgctgatgaaactcctgaaccgttcgttgctgcagttatagttgattatccttgtacaaagtagtgctcactgttttatgttggttaggaacttcaatttacttatccttagtgcaagacaattacttttatttaggaacgatgatttatgtttttattgtgaaacctaatgtcagtacaatttctgattatatgtgatattattaattaagtcatgagatcactggttcaagttacctttgcagtctgtaatagtattgaaaagtgtagtgctatgaaaatggttggaaatggcagtggttcatttataataaacataattctaaagtatatccactgatttgatttttgacagtgctatcgtggaagcatctgtatccatgacatgcctattgtggttactgctataatacccttgttttattttgctacttgtgactgtgttgtcactatgtatgttgaattttctgacattgcagtcatagaagggggctagctggacaccatgttgagatagcttgacaccaagttaccccaacaatgtgggcagtcagtaaacaagaaccacaacatggctgtcaacgatgagaccatatccccgacatagcaaccccaacaggaaatacccaagagctggctgttgacaaatggcatccgcgacagtttcgtacctttcaccaacagttctaggctgttgcggttgctatagtatggtgttcatatcctccacatgaacctataatagtttctacatataaaacaccacatattcaacacgcactgcaacgcaactaagttaggcaaatcacccgtttttacatcacatagttatccaaatgggaatataaatgaggatatttttagcatattaccatttgctatccagggtgagatccaacacggcatattgtacccccaggctccattcgaatgagatgcagatattaaaccttctctttcgcgtaaaacaagacgagtcattagcacataataaattcagtattaactagtacaaacttaaaatggtttaattgatttaaagaaagttaaaccagaccatttaacagtttgggaaatatgctcatgaaaaatgatgaagtagcatatcccaattgagccaaatcaaagatatagtcttagtcggctgtaggtataacagtaaccctgagtatcattagttcattaatcattacaagaatgcattagcatggcagcatgctaccgtaacgtaggttaattatgcggaaatacttaaaagtttgtaagaggatgtgcgtgatagtgatattatccactcatggaatcatctcgcttgtgtacttgaccaaagagggaatatgccacggaaggcagtcgctagtcacaaatgtgttgttcagggctactgatttggaattcctttttttggaaggcagttccgtttaagtttgatggagacgagcatcaagtaaaggtaaattgagaaaaccattagtgtttgattaattgagttttatttatttttaacttgaaaaataaatttatttggtattttatagcaacttatatattgaaagttttcgtacgaaacatatcatttaacattttaaaaaacgtgctaacgataccaaggtctaatatgcatcttaatcataaaacaacgggcagaaaataggatgtgctcgtatcattggagaggatctattgagcacaatccgcagcaacgaaaaagattcggacaatgatatatatattgcagaataaaatagtaaacactagtggccaggaaggcaggaaggagcccatgcaccaaattgtaagtggcagaggataaaaataataataataattgtacgaggcataatcctcggggtggtatacaggcctcagatttagaaaatgtgctcaacttttcatccaagtagaattgaattcagtgaacttttcccctgtcgctgctagaacaggctgtgacaggtacatgctatgttttccctaggatggtgaaatacggttatttgatgtcatggtccttgtaaacctttagtatgagaatgccatttcattgaattcgtgggtggtatatacctccacatcccttaaagaggcaaaaaaaaaaagagaattaattagctaaacggatgaaaaaaagactggacgattggcaaggtacaagatggaatttttgacataacatttgatcattggtcaaattaaaaatacaaatatatattgatcaggtttaaagtacatttggtaaaaaaaaaatcaaagcaataatacatatcacgataaatgaccaaatatcatgtctaaaagttaatgttgccatacattgaaaaaggagatagtatatatatataccttaactcatattgttacacactaagtacatatagaccttgcaactgtttttttctctctctaaaaataagttttgcaaaagaaatcaagtcagcccaactgattcttgatttgttttgtgaaacaacgccacaacaatgattccacgtaagctctatagactcaaaagatgtacagcagaaaaccaaataggtggccgcatgcttaaagctgattgagtactctttagctcgttcgaaaacaccctctgctttcttgtcccgcacttgtatgttcagacacagtgttcgttatgtgcaccgttggtaggcaagtggattttcataattttatggaacatgcttgaaatacagcagctatacacgaagcaagtacactttcagtaaaataaaaaaaatcaactcctgagaataaatgtggataagcattcatccttagaagttgagttttctaaaacagagagtagtattcagcaagcatagtagtgaattacttaaccctagttggaagcccaatttcaagcccaataagatggtaaattgtggtacctgaaactttttaaccttgctcatttgccatgagaaagaagtaaaaaattgtaaattttacaaaactatagatattttaacaaaattactgtaaaactacatatttaatatatagtatcgcaaaaatacatattcaaaaatgattttatagtttcttagaaaaagaaggaatggttttatcataaaactacatatataatctatgctatcttcaaagtataaatttagtgttgtttttttccacaaaactatagattttagatgctcccttcacctattatcatggtaaatttctaaaatgtgtagttttgcgaggaaatcaatgctctatctgtagttttatgggaaaaaaaagatgacactaaatccgtagttatgaaatataatagcttaaatctagagttttatgataaatttattactagatctatacttttatgatactatggtttaaatatattattttgtgatagttttataaaagtatttgtaataaaactatgttgacttttgatataaacattatacatagagaatattaatagaaatcaaaaaaaattttagttataaacttcgtttcaaagaaagcagtgacatcctgacaaaaaggtggggagcattcgcgcaacgcctgcagggcacccacccaggtagctttgatccctgcatcagaaggggccccctaatgggcgatcgctcgcttggagatgggggcagcgatcaattcgcccccccccctccagcctccctccctccacttggttttcttttttggcaccgcattactttcctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaagtttatacacgtaaagtttatagacctaaattttatatatccgattcaaatttgaatttgaattatatccgattcaaatttgaatttgaattcaaatatttttcatatatagtaattctatacatctaaagtttacacacctaaagtttatagacctaaagtttatagacccgattcaaatttaaattatatccgattcaaatttgaatttgaattcaaatattttctatatatagtatttctatacatctaaagtttatacacctaaagtttatagacccaaagtttataagtcaaaagtttacatacccgattcaaatttgaatttgaattcaagttttttatacataaatttttttaactttttgtttttttaaaaattttttgtggtgtactgtaataggaagagaagaaggggaggaggaagggggagaagagagagaggagcacagggggaggcgaggggtgatcgccagggcagcgcgggggcgatcacccgcgcgttaggatttccgcatcagaagaccatatcaattccataatgcgagccatgcagccattatatccgaccatacttaacattctctaatccacgtatccacagttcgttaccctaggtgtgaaaacgaagtagatagatcaaaacaaatacggataccatttggagcaaaatcttcaatagtctacaggggcaaagggagctagatagaagagggtgtgcccagaaacccggtcaagcaaatttatagttatagtttatttattttcaccatatgtgctcaatccaaattcaggcgctcaatcaacctaaacttggtctaaagtagactaaggcccctttgaatcacatgaataaaaaaatggaggaataggaaaaacataggattctcacaggaatacaagtgtaaaacagagaattacaaaacacaggaaaaacataggaatgactgtttgattgagccgtaggaaaaacacaggattttgaggagagataaagactcaatggattcttaatatgaggttctacctcatgctaaatttcctccaaaacttacatgggaagaggcattccataggactttcataggatccatatgattcattcttttgattcaaagggctatataggaaaaattcctataggaatgaaatcctttaaaatttctatgaatttcctttgaatcaaagggggcctaagggtgagtttgaggaggaggagattgggaagatacacaaaacgaggtgagccattagcgcatgattaattgaatattaactattttaaattttaaaaatgaattaatatgattttttaaagcaacttttccatagaaattttttgcaaaatacgcaccgtttagtagtttgagaatcgtgcgcgcggaaaacgaggtgtttactcaccctatctcacacgaatgaacgcagcctaaggccctgtttggttggagagatgtcccttaactttggtcccttccgagcataggactaaagtttttagttagggattaattttagtctcgggactaaatgatccaaacagggcctaaacggtgtgtccggcaccctttttctcaactcctctcattcgttttccacgcgcacgcttttcaaactgctaaacggtgtatttttttgcaaaaaatttctatagaaaagttgctttaaaaatcaaattaacccatttttgaaagaaattagctaatacttaattaatcacacgctaatagattgttccgttttccgtgcgggagagattagttcccatcccttcaaactgaacacaccctaaagtaagcgaatgttacccctctctatttcgttccggcttcatccgtgatagtccatatacaaatacaaacacacaacaaatacagatgatttcatgacctttcttccctacagccagccaacccttatccaaccttattgtccggcacggacaagcaaacagtacgaggaacagaagcagcatggcgcaccagcgattctatcgagatatgcacagcggagacatgtaaaaacattaagcactatgtgtagattaatgttagctaacaaactttcagtgtgtactacggttgaaatgtcaaatttatgcatcctaaaaccagaagcatcatcatgtttttaaatagaatgacaagtctgaactctgaactgaatgtctgcataagagtacgtacaaaggcgcatattatacctactcatatttaccagaagacggctgtatggagttccttttttcacaataaggcgatctttaataagcaacaagagaaacaaactgtaaaaggaaacacctttttcagaaaaatcattacattcaattcacaatccgatttcgcaacacagcacaagcaagtacactagaagagtgaaatcttcagtggacaggcaacaagatatggctgtgttcggcattgccggttcccatcctctccctagcttttcacgcgcacgcttttcaaactgctaaacggttgtatttttttgcaaaaagtattttacgaaagttgctgaaaatcatattaatccatttctaaaaaaaattagcaaatacttaattaatcacgtgctaatggaccgctccgttttccgtgtgtacatcctgtgttgggaagactggcttccgaacgcagccttagggcccatattatgtggagggatgaattggggtgctcgatgggaaggcgaggctgttgcagcctcgccgccccggagcctaggtgaggccgaacatagaagaggggagactagagatatgtttaacttcttttttgattgattccaaatgactgcggtgaggtcctctaacaaacatcctaacaaccttatctaataaagcctaacaaatctcctaacaaccttatagggaggctgagttctgcccataacacgtgattaattaagtatttattaagtatttgctatttttttttgctaaaatggatcaatatgattttttaagcaactttcgtatataaacttttgcaaaaaacgcaccgtttagcagtttgaaaagcatgcgcgcagaaaacagagagtagggagttgggactagctcttgcaaacagagcccgagtctttgtgctaccaagatctatataagtgttaacttcatgataaaaaatgaaacatgagattctaatcaggtggtaccgtggtagtaccttccttgaatgtttttttctaagtaagagaagggattcaattgaaatttgcaaccaacataatgaaatcacaagacagagaaacatctaagctatgtgggtggacactaagttagagtacataagcaacttgaagaattcatgtagcccatcacacatcagaaccgttttgataaatcaggtgcattgctgaagtgcagtatcatcttgattaactgctccttttcaaatcatatacatatatagctacaaatttcaagaatcaagttaagaagtgatgcagcatgtcctgccagcataacatgtaatgccaagagtgacgattgccgacctccacaagaatgaacacagaaaatgaggatgaaggggatcccctaataatttacagggttatacagattaaaattgcaatttgccgccacgaggaagttataagcataaggaactataccaaaaggaggaggattgcgatagtggcatagtgccatcaagaacactgtttttttgggacatgagaaccagttgcccaagtcaacaaccatagacaagtagaagagaacgaagttgatgaagtgatatatgcatagcaattaggccatgtacttttgcttgatcaatctgcctaagggattagattatgcaatatctgataatcttgacatcacctaaaaagatcaggaggagagcagagtagaatgtaatccgcaattgacatgccatgtgcattgcagttagttacatatgaaaccaaagcaggaaacatatgtagtttgttggttaggcatgtaacaagtgtagcaaagatacctaaatattgctagctgtaagctatcagaaaaacgcaattgaacataacagaatcttattttcctcacaattggaatagcgaaattgcaagagacaacgatattttgcttaacacattgttattgcctcagaaacaataatcatgtcttaaaatcaccaagagtacagcaatggagtatcacctagttaaggaagaagctttccagccataaagcaggcaaacttattgctccgggaatactcatacggcacgccggccacggtgagcaaccgctcgaggacctgcttggcctgctcgggctccgccgtttcacactccagctcgtagttcgtaccaaagtcgaagcgcgtctcgtcgagctccacgacgagcccgagggtgtcgccctcctccagctggtacacggcgcgggtgttccggaacccgccgaggcagacgaacggcgcggcgtccccgccgacgccgtactcttcggagacgagccgaatgatcggggactcgaccccgccgaggcttgccgggtcgtcgacgcaggcgagggcgatggcggggtcgagaggctcctcgacctcctcgacgcggctgacgcccgcgtcgatgcgcgggcggcgcttgagcgcgaggacggcgcgggagggggcgcggtcgtcgagcccgtagaggcggacgcggagcgcggcggtggcggcggcaagggggcgcgcggcggcgtcgaaaaagaggttgcgctgggcgtcggtgcggcgaaggcggggcgcgaggaagaagaaaagccggcggtgcgcgccggcgtcggggaggcggagcttgatctcgacctccatcaaggcgggcgaaggggggagaggagaggctagggtttggggttgggattgggattggtagggaggccgatgcggtgggacttggagggcgcggcgccaggcggcgggtggaggaggtggaggagggggttggagttggagggcggcggggtcgtggtcggagtggatgaggcggtgggggtgctggccgctgcggcggcggcggcgcggaggtggtcttcgagctcgtcgcggtcggaggagcggagctcgatgcgggtgggcttgcggcgcagcatcgatgtgaaaggaatgggttggcccggtgcactgtggtgaccgggtgggctcgggatgagattataatggagctggaaaataaactgcgatgaaaaaaatcttaaaattaaaaatttaaattttagcttgtcggtgacatgggaccgggggtatcttgactagaggtttggggcagccgcggtcacccacgtggcctgaccccctcgggggggtcgggcccgaagggtaaagtggccgcccctccctctgtctccccgaggggtcgggccgctcccgtttcggccccgagggctggggcgccccgaccccctgtgggtttggcgccacgtgtgtgggtgagcacagcggcgctaacctaaccgcgtttattgcgggttggacgagcgccccacgccgcatttaaaaaagcgtagcacgctcgttcggtctgtgacaggtcacagtgtgtgaccggtcacagaccggtcagatcgcgggttaggtggcaacagacggccttttacacgcctcgccctgtcccgtcggaatgatgagagcctctaggcactcgtccctagccggagccggcgtgctaactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacagccgtgctcccacgttgcgcctgcttccggcggagtggaggtaggtatggcccatcccatcggagggtcattcgaacagcagccatggcaaatctccgcccattaatgagggagtaacagggagatccccggtgtcaggcgagtgatgacgctgggcctcactcaaagacaagctgtgatttagcttccaggcgaaggcgcaagccagttttttttgggaagatagggtgagtccccacccaaaagaagagtaggtagaagtggtgcgtgtggtatccccttgagatataaaaggaggaccttgcccacttaggagggggacaactcagagaacacctgagctcgtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacagatcgagggcttagaacctcacctaacgcccccggccgaaccggcaaagtggggcccgcgcggtctcccgatgaggagccccacgctccgtcatctggcgcgccaggtagggggcgcgtgtgtctttctaagccctcgtcctctttcgtgtgcgccaagctactcccgctcagcccaatggccgaacgggcagtggcgcacaacctctctccgagcgctagcggtgacgatggggagcagaacccgcgctgtcgagctcgtactccaccgtccccctctcgccgaagtcttgggcgggaggaggcgctcgagggggtcgaaaaatccgcgacttcgccgctcgcgggcgatggagaaggacggcgggacggggagcgtcgcctcctcgtctacggcgacggcagcacgccccagggcatgctccaggctgcgggcgcgctcctgcgtcacccgcccgtcgtccccgatccagagactccagcccgacgtcggctggatgacgggccaacttggtcatgacggcgcagcagcacctaggcaccggcag

SEQ ID NO: 81292 - DNA, 1208 bp, Oryza sativa
ggcaaagcttttcgataacctcgcattggcagtacccgctccatgaacttaaatcctcatgcactctaggcgtccatgtttctagcagtgagaggagttctggcgctcccgggaaaaaagaagtctcacacgcatattaaattatggttcaagttaagttctctctctcacacactcatggcagtcctaccaatggcaacaccgatgtagggcacgcctctcggccctacctcaacggctgtcccatcgtaacgcacctgcctcactcaggggtgaaccatctatgcagggatactgcctccgctcggctatctaatctgttaggtctatacccattcgagaagtacggttgtacgggggtcgtttcatgcttaacttcatggctcggtccttaattaactggggacggtactagccttttccagataccacccaaatcctccatccgccccagtcgaaaacagttgttttaattttatttctcctttcacaaatcatgtcatcaacatcatggtaatgtggcgctcatgtctccacatgccgcatctcaattaccttcccgaaggtaattgcccaagcatatagcatttgataaatatgagtatgcatgattctagaatagcatttctaagcaattgtcatagttgaatagagactcatacgtaaacatggttacaaagatttaagggttaacaataatcaaggcatggcataatcacaagtgggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcaggcgctatagttacgtgcaaaaattgatttgaattcggttagaattcaaataaaaatccaaataaattcaaatgaaagtcgaatgcgaaagtcgattattcgcgaactaaggcaaacccaatttcgagttttaatatcctaaactattttgcgggtataaatattttgttgtcctaagtttttaatttaatctacccgagcattatatccatataataggttagaaatttctatcgcgagctaaatgtcggacgaaatcctagaaatattatacgatttaatttagtctatgactaaatgattaaatataacacatggctaaaatccctagtaattaaatccg

SEQ ID NO: 81293 - DNA, 4038 bp, Oryza sativa
ggggtgtctcgcatattatccaaaaaccatctgatacgagatcgaagcttcaaggagtccgtcagtctagtcctccagccatccgcaggatcccggggcaggtagagggtggtcactggcacgcgcaaacctgagtccccacggctcagaggtagtggcccctggatctggcttgggcctcttgcccggaggtcgtgtgctcttgcgagcagtgctaagggtgcgagggcctccaaggaaggtgatgcggggaacaggggtctcatcctctaaaggatcagtgatgtctggctcgatctctggctcggtgtcggttccctctgtctcggagtcgacctggatcggagtctccaaactggaacccagctgtggagaaggtgtagggatcagtggagtgtgcaccaactccggaacaggtggctgtgccgctgtcgggtccactaggtagggcgttgactcggtagctagcatactagcctctcccagaagagcgtggaacgccggtgggtacggcggggtgaggaagaagtagcggtcacggcctactgctgtggaagtagaagcccctgtagtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtccatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcactatcgggttgtagcagcagggcgtgtcttgaactgtgcaaactgagttgccctcctcccggaacgggtgatgagcaaacttggtactcactaactcagctcggtgaatagagctgagtcggaggaaggcctcccgggcggcatcctgcatcgcggtctctggcaggtctcggtggtgacgtgtctggaagctgtagtccaacttggaagggactcgggggtgaatctcgacccgagcctcccaaactgagccacactgtctcactcggtatgacgggaacccagggtatcgcagacgcctcaacattccgatgcagctcaatgacatacccctctgattgaggtaagctcaactcccaggtagcgggtgaatccgaatctgccatctaattttaagaaaacccaaagtcagttaaggttaaaaattgtttttgtaaagaagatagttaagagtaagatgaatattgtacagagttttgtaaacatagcgtatttatttttgatagtattactaaatgggaatttctcccttggccaacttagaaaaggggtggggcgccttttggtcttttcctacagtcgtatggctctgataccagctctgtagacccccgtttttataacaggaatcaatcgtgtaaacagtaccatttccctggatcaagtagtttggtacacacgaattcatagctggaataccaagtgcacatacacgagtgtctaatacgaattattacatcataggcccgcaggcatagtcttaaatcatcggaccgagcggtctggaatacatccaaaagcagaaatagataaggcagcggaattcaggcagcggcatgccattgccacaggcaacgaccgtactaagacctactgaacgccatcgtcttcatctccctcctggtagtaggcatagggatcctccgaggcttcatctcctgcttctgattaattttatatttgcaagggtgagtaccaaccgtactcagcaagccatcacagcaatgatgcacatgacagaggaattcagaggatggctatggttcttttgcgcaaagcaagttttgtaattcttttcacaagcctaagacctagcatagactgatcaagttttaataccagtattcatattaaacaatgacggttctgtccaccatccattgtgatcccaaggatagcttcccgccattgagtcgttatggttttctgaggacgtccacattcccgcctctcaggaagtggctccatcagtataaaaatcatcatgcagatcccatcccacacaagtttaagaattttagagtctagccaagtgtaatacatgtcccggtgctcaataaccgcgagcatggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggtgacaccgatgtagggcacgcctctcggccctacctcaatggctgtcccaccgtagcgcacctgcctcactcaggggtgaaccatctatgcagggatactgcatccgctcagctatctaatccgctaggtctacacccattcgagaagtacggttgtacgggggtcgtttcatgcttaacttcatggcttggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgaatagagactcatacgtaaatatggttacaaagatttaagggttaacaataatcaaggcatggcataatcacaagtgggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcgggctctatagttacgtgcaaaaattgatttgaattcgattagaattcaaataaaaatccaaataaatccaaatggaagtcgaacgcgaaagtcgattcttttatattaactttactattcgcgtactagggcaaacccaatttcgattcaaactattttgcgggtataaatgttttgttctcacaagtttttaatttaatctacccgagcattatatccatataataggttagaaatttctatcgcgagctaaatatcggacggaatcctagaattattatacgatttaatttagtctatgactaaataattaaatataatacacgggtaaaattcctagtaattaaatccgaatttctaccgtgaaccgatgacttatagagattaccaaaaataatctataataatctataagaattcatctaattgtttagttattaattatatctaaattactaccaattttaatctaatttgatcaagaaacatatttttataattaactcggaatttcgaccgaaatactattacgctcgaggaatttccaaaaataatctatgattaaccccgaccatttttatttcctaaatcctcctaatttctcccccaatttcccttctattttctccttttcttcttttctattttccctctttttctctccctctctttctttttctctcttttctctccctctctttctcggctctatcccacccgagcggtggcggtggacgcaaggggaaaggagggcggctcaccggttgtgggagcggcgaacgacggacgcggagaccgtggtgcacgg

SEQ ID NO: 81294 - DNA, 33340 bp, Oryza sativa
  unsure (1)..(33340): unsure at all n locations
ctgttaggtggtaaaagaagtccacatttttttgtagtttaagctggaaacagtccgctaattttgattagagaaggggtcattaacaaagtctcttaatatagataggaaaggaaaaaggcagaacaaggaggccactaattgaacctccaagcttttgtctaatcatcgagctaaaatgatttaggggttaaatatataaagagaggacttttgtgagtcgttaccatttcaaaatgttccatgaaattggtatgcagctcagagcagccgctagcacacatagcacacactgaatgcagctttttttttaggtgaactgaatgcagcatttttagtggtacactggtacttctatatattcacgttgagaccattgctcaaagctcactgaggatcaacaaatgagtctataggaatatatcaaaggaggattcgtccttgtgaattttcttcctaacttgctgtagtttgaaaaattcttttggattacaatcctatatctcaattccaaaggaaatttacatgtgagctcaaaccttattttatttttcctttgagaagtccaatatgcatcttctgtctttatctctcacatctgtatataatccactaatgttccagttcacttttctatgatccatctttcaaattcatgtgtgctaaattctagtgcattgctcttttcccatacgtatacctctatttttataatcgtgagtttcaaagtaacatagcatacaatctagcacatctaaatatgagcttgcatggtacgacaaaacacagggggtgaaggtgagggtaaaccataatgtggtctagatgtgatgtagatattgaatttgttgaaggccggatatcaataaagggtaccgccaacaagtatgcgtgagttcgtcatcttctagatctaccttatccgttgccgctcccatgcaccttaatatttgtacaccataccaaccaaagttggatcttggggaaaaaatcaccagggtcacttgtgttgtatacgttgtaccatagagtcaatcttgttttcttaaccgtgactaaatgatttaccataaagtttatagaagttcactgggtcattagacccgttaataattacactttagctctacccttgatatatactctcacacctattacctctccatggctcgtgacactgtggctcatgctcgtgcctacctcgatggctgactgtccataggttaaaaaaaacaactaatgtatagtagcattggcatggctggctttagtctagttttacacatctacacacgttaagttagttattcatacttttttttattctctatgaaaaagtatataatcttagaaaaccatgatatacataattattgatggtctatatcgctcattataaacctgtcacatattatttttataaaaaaaatttaaagaatgcacatctgccttaaacaatcttcgaaacattgagaccgatagctagtaccacgagactctacccccttgcttcgttatcttgaaagataatgtatctacacggttgtctctattgggctatcatatttgtacttccatatcttaaaattgttgatccatctgtatccgtgtgtagctagttgggacagaggtagtactaggtatttttgcttgtatatgctcaattgctgaaacaatctctgttttttttttgaaaggagcacaacacgggaggcccccgctggtagaaagatttgattaaaaataaataaaaaagaaaattacaaaaaaattgatccaattcaagattacatccttatctctctccttaattctaaacagcagaaggaggatgtcaccctttaagagttgcgtccaagaattcaaggaaggaattttttgctcaaaaataaaaccattcctttatttccaaatattccaagtaccatataaaaatttgtccatgaagcactgtccctgataaagggattaatttgcatggcgcgacatactttccatgctcattgaagtatcccaataaataccaagaacattccaacaattctgtgtaaacgagcattgaaaaaagagatggatcaagtcttccatagaattaactggaaagagcacataacttagatcacagtcaggaggagcacaatgcttatgacccaacatatattttgtatttagtctattcatcaatagcaaccacccaaagactttaactttcgaaattgccttgcactaccataatcagagaaaataagaaggtggctgcatagctctaattaaagttcaaagcataggatttctgagaagaatacttcaaattaccccaaatgtattcccagacatctctatcatgagacagattcacatcatttaaaatgactaacaaatagttcagctcttgaaaagcttaatgagagaggggtaaatgaaagttatcctcaatatacgtagagagaaagttatgcaaacctttttcaccctcgctttcatatcaactacttcctccgtttcacaatgtaagtcattctatcattttctatattcatatagttgttaataaatttagacataaatcatatagttgttaataaatctagaattattaacaactatatgaatgtgagaaatgctagcatgacttacatcgtgaaacagagtgagtatattttagagtaagaaccacgtgatttcatgtcctcgaaaaaaaaaagaagaaaatccacatgctaacatgccaagttcaaaagagacgtacacttgcacatacattacatttcttttctttagaaaacaacattactacattcttttcatatgccctatacattgctccaactcctgtgtagcgttgtttgctccgctagccaccacacacacacacacacacacaaattaaaagaagaaaaaaaaacgcctcaaaatgtactccctccataaagtaaatgtagttttataccggtttattgtgctaacatttggaccggttcgctatccccctttcattttctccgtttatgtctaacatttgaccgttcgtctttcttgaaatttttttatgattagtattttttattattagataataaaatattaatagcactttatgtgtaactattttttaaaaaaaaatttctataaattttttaaataagacggacggttaaacgttggatacgaataccactgctgacggcggacacctcagccgatgcagagatctccgcacgaatctccacgcctccttatccccgacccaaacatcgtctggctcgcacccgcacccgtaccaaccccgaccgagcgagccgcatacgcattccgtcgaacacctcacccgcacccaccaccaccaacctcccaccccacaacccacatccatgtgcacgcgcgccctcctctcctcctccgctatatatcccctcctctccacccctccccaccactcccctctcctcccgcctcgccgccgcaaccaccgccgcctcgccgcagcatcacccgcagccgccgccgccgccgccatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcnnnnnnnnnnnnnnnnnnnnnnnnnnnnnnnnnnnnnnnnnnnnnnncacgctcctcaacccgcacgaccgcatcatggggctcgacctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggtataaaaatcctatccagtccaatcctcccacccccaactcgtctcgattagttgttgcatttcagaaatgaaaaatgaaatggggtaaaattctgtccgccggcatttgcttcgttgctgtctgctgtaaaggttggatttggggatctggatggtgagtaatcccgagttgggttttagagtgaattggatgcccgatctggggggtttggttgattggatctacaccttggtcccgaaatatagcaatctagtatcggccgagaaacattctaatactatgaatctggacatatctttgccctattttcggatggaaggactgggttagttgggtttggtggttgtatgtgattaaactatgtggtaactttagctttatacacatatatctataaggacctaaattgggtgaggggtgttggggttgtttggaataggcaaatcttggaaggatgtatgtctctttgtcttctagcttgttttgtttattagcaattcgatacaaaatttgagtctttcagtgtgctttagtgcaattctttaaatatgatagatctggtagtctgtggtagaggatttgttttcctgtgttcggtcatgcaacttgccgagcactctgatagtggatacacaatggaatcctagttgtcttcaatcaatttgctattttgcgctcgcccatctaatttgtttgttttgggtgttatagggcacaatatattcatttgtgacaagttgtgttttgcttcatcttatatatttataaacattgttatgaaacaatagcttttttgctgagtggtaacagatctctaaagaattatctgagtggatattcctgttagccataagaatacatgtttgacatattcctcaatttcttattacgtgcaccgatgctgggatataaagggcaaaatcataagatatactgttcattcaggttgtttttctttggtgtctggcatgtctgaactgtatgatgatgtattaatgttaattttagtcctatagtctctaaaatatgcttgtttcatttatttaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaagatgtgtgacctttgcagcattacacttaacaagaatgctgtctttggtgacagcagtgcattggctcctggcggtgtccgcattggtgagtgcattccccttcacagaaaatattatcatgctaatgtagtaacatcttatagtccggatcttgctgattgctatggaattgattcatggttacaaaacacaactctgcaaaatcatgaattaatctgatgcgaattgcttcgctccatgtttcactacagagcctctgtccatagatgatagttatatcgaacacaagtgctactactggacctttctttgcacaagcaagtatctcagacggattctggctggttttcaggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaaacgctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcctaccttgtgttttctgtgggattgctaaactatcaaactgtgcgaagctacgaaaaaaagaaatgctggaatttttcagagttgggtacatggatgtgccactgtcgtgcagcgcattgccaatacgccgactgctgtagattgcaacgtgacggtacgcgtcgcgcgttggcggctactagcgtttaattgtgtagggatctctgtgcggcgttaggtctcgccatggaagggaaagggagaaagccattacactagctgtacaggacggtctggcctggcggtgcccacacatgctgtgaggagcgtgtggcaccgctgctgcaaccacaacaacattgatgtgcttttcacgtaacctttttaccttacgtgccgtccttttttagaaaaggaaaactctcataactttattagatcaaagagcagttacatcgctcactaaccgcttaattgaacctactggctcctccaaccaaatagatggtggattaagccaggctgctctagcaagctcgtgagaaactaaattagcctctctaggacagtaaaacaagagttaccaatgtagaagcttcagaaagaaccacacattcattatagatcgccccagctgctgtcgtcgagaaccctccattttgcatcattgtgatgacttcgatacaatctaacttagtgatgattcgatcaacttgttgacctctagctagtaaaattccattcctcaaggcatgaatctccgcagtaatactccatgcgatcatttgcaatgctatgtactctactttatcatcccaaagaacatctcctggcaatggcatctacattcaatttaaccattccctcttatggttgacaccatcccgatctagcaatgcctatattcctcgggttggcttttcaatagtttaggggagtacaccaatagccattgccgccctcgttggttcttgcaccttctcaccatgaaccaattttctcccaccaaatataccagatacctaccaagattagaatctgagcactcacataggcaatcaaacttgctttctcatcacaacataatagatattctagcgatgtcgaacctgcttgtgtcatcttttgtaggggtacactgtactttcaaataaccacgtagaattcatgttgttttctttgagattagatcttcattggtcgagactattgggagaaggattaagggtgctttctagagagaaggttgggaatttctctcctgcacacgtaaaacgtgatgactcattagtacatgattatttaagtattagctataaaagcttgagaaattttataaatacgatttttaaagcaacttgcctatagaatatttttaaaaaatacactcaattaaacggtcgggaaacgtgtacgtgtaaaataagaaaatagaagttgaaaacatgtagttccaaacacatcctaaacaaatattactgtcacttcatttccatttctctttgaaaatccttcaaagcgtgtagacggctccccagctcatgccgcgccagtgtccgacaggcgacagttttgcgactctttaacaaacttgtttagtcacttctgctaccattgaacggttgaacctgaagtaattttattactaatcacaaatttatggccatatagtgatgatattgtaggatcgaatcacaagaactaagccaaccagaggggggtgaatggttggtatacccaaaaaccgaaaacttttagcggaaataaaagttatcctcgaagttgatggattgcggtctgaccgaaggtattgcgccggtctgaccgcctgatgaacgtcggtctgaccgatgtagatcgatcggtcgaaccgccgagaagcctgccgcccctgtcgctgccaccggtctgaccgcccgtatgccgccggtctgaccgccggtagatcgccggttagaccgccgaaacccgatgaaacacaaatcgaagaactcttaaagtagatgacgactttattgattctctctgtgtttacaaagtgcaccaacagcactccttacaaaaatttcgactaaactcgaaaccataactcaaaactcaactcaattgctctctaaagcgataccgggaagcctcacactccctctctatatatacccgaggtaggcagcctaaagcccacgaaccaaactcatactaagagtcctaaacaccttaggaaaccctctagtacaagaaaaaaactttacataaccaatcgtaccaaatttggagtccttccaaattcgactccgcatctcatacgcacacaatacctccatcgtatgccatatggaatctccatcaaccacgtgcattaactctagcctaagtatctcgcatgatctctgaccaccacagacgtcgtcttatccccaagccgactcccggtccatcaccgcaaatactctcccgaggcatcgagttagcaaacaacagtattacatacgtatagtatccatctagaagccataatcatgaaataatcacggatatccaaacaaacaacccgaaaccgaaaccgacacagcgtcggtcggtcagaccgtgagctggccggtccgaccgctcgaccaccgccggtctgaccggcatgcacagcccggtctgaccggtcacatgaaataataaatcctgcgatcacctgtgaatctaaatatttccaaaaaccacttcgtgaataaattccaaataacaaaaccaataatctccaatgcccaattgttcatcatagaataataaccaaaaaaacacctttgattttacagatattcacataaaaaatattttaccccattgaaatgttcttgtaattctaattcatgttgctcatttacatctccagccaagaccggttttattgcagttgattatctagatgattatatgtataaattaaatattttgatgaatatacttaacaaatagcttaaaacaagagaactaagcaatacgataatccacaaaattaatccagtgaaatagctgaaaagaacaatactcctaacttcttccaacagttttcatgaaaattggttcaactttcatatgaactgggaaacaaaaatccagcgaaaccttcgacagttaggcatccacaatgtgatgcaaatatagtccatagataatattatattttattcagctacctattaacattatgtaactagtccatatagagaaaacaacaaaagatatccattaagcatatggactacccataaataaataatactatctatctctatttctctctcatctcctaagagcatccacaatgtgagccactcctagagtgtcactaactatgaacactcgtaggggaactcagctcacactgggagatacccctggatgggctcctcaaaatctgaagcaacccggtgaggatactatagcccacaatgggtgtcttggcccaaagtatccctagatgaaaaatccccaaataccccttcctgccagcctactctccttttccttctcttttcttccgccctctcttctcgcttcttttcgcttcgtcgtcgcccatctcgccgccaccaccacctccctcctctctcccccgccgctgctcgcctctctctcctctctctcccgccgccgccgctcgccatccactcttcctcgccagatgtggccggagtgcgagggagattagaaaggccgccgctaccgccggagcttaatcggcgagggcgacgaggagggccgcctactccaccaccggatccatctctctctctctctctctctctcgtcgtggggtcatcgctggaggctgtgtgccgcgccgccacccctcttcctctgcctgtcaccgacggggagccacgcgcggatctggcatgccgatgcggtggtcaacagcgagatgtggccagatctggtcttcttctctccctctcactgccgtcatttgcctctccctatccctctccctctctcccatcgaggtggtcaacggcgagccaccggtggcgacagcggcggcagatgaggacgaggaggtcgccggccgccggctgtggatgagggcgagggtacaaggggaaatatcggggtagggcgccatgtccacgagctccccacgcttcaatgcagtgcctggctcagaccccccacgaaaaagtaggcaaggcgcggagggagccgcgtcccctgcgaggcgccgcgctcccctgctagggaacagatcagcctcaaaaagcgacgggaggcggacggccgtgaggagagacacgggttgaggaggtgcccattgctgatggcctaatgctaccttgtatttatatacattgtggagattgctatagttaaaatctctttacgtgggtctatctatgtggatcactttagccatggcgatgccaacgtcattgacctgcgatacaaacacactgtgcaacagtcaatttcttgtcagggcagtagggcactatttggggagtgcagcgcaggccggtgggagaaatgtgggtagatgacatttgtgtgattgtgtcggtgcatccatgtgatctctgcattaaggattggtggctgactacaggtcagcatgtggtcttcttctttttttttttaactcaccaaaatctctgttctttaaagaatctccctcgaaaaaaaaatccaaattcatgtgatatctcttgtctgtagttacaatatctaacatagtagcacttcggagtaatgctcattgttttgttactgagacactcaagtagatgtgtgaatttatgaagcaacagtgccagtcataatctattaagagtgctttctgaatttattcagacttatacccttctcttctgtacaattcagtatgttcggaagttgatacacaaactgatgatttcctcaccaagaaaaaagaggaggaatcacaccatgaataatgaattggtgaaatttgagtctttttcccctgaaaacactgcaaagcaatatctttattaaacaagaacgaaccaggtttcatcacacgactagctattaaaaaaaattgaagaaacgatgagcatccgaaaagattcaacgtgctcaattgcgtataccaactttaacataccagtacaattgtacaaacgaagaaaaggagcaatttccatgtcaattgatggcatcaaatcttatcaatgccgacaatttcaagcacaaagcagcacacctcccctgatccaagcttccttataatattatagcttgcaaccagatcttacatatacatactcataagatctttgaacatgtaaatcatccatgaatcacctacaatgattcagcaaatgcagaacataaagaagaagaaagaacagaagagagggtaaaagaaaaacaaaaaaaaaataaaaaccaagatttgcatctcaggtagccactcctgcaattcctctcatggcaagatcatccagcaaaacaagcaggcagtgcagtagtaatcacggatccacatccctgcacctggtgatggtctcgcatccccgggtgtaagggttggcggtggtcatgatcctgcagttatagtaagggacaccctgcctcgagcacggcaccacgtcgctcctcagggcgtcgtagctgatgtacctcctgccgttgctgctgctggactcccacagcatcctgctgtgagcctctgaatccatctccatctccatggccatgtccaagctcttcaggcagtggcctccatggaggaggaggaggagcaagaacagcttggtggtggtggtggtgattgatggtggtggcattgttgatggaagagggagatctctctttcttcttgttgttgtttctttgcttcttctctcactcagggtctcatctaggagtagctgaattttctctctctatggggctctggagtctggatctgtatcctgtgatgtactccttccttgatggaggaggaggcagaggcagagcctctcttgtgtgtgtgtgtgtgtgagagtgagtgaggaggtgcattcaatgcagtgccagacagccagttgtaggcacctgccattgtgtcctttctggagctgttcaatggaggagcaaatatcgaaggagagtggcccaggtttaccaggtcccgttcttttcttcaattggatgaaaattaagatttttgtgacatatttttaaaaactattaaatggtgcgtttcatacgaaagctttatattaaaagttgctctaaaatattatattaatctatttttaaagtttgtgataattaaaattcaatcaatcatacgttaataccacatcgttttgcgtaaaaaacttaatcttcatcttcaggagaaaagaacatcacctaaggtggtgtttgaatctctgtagataaagataaagattaagtgttttacgcaaaacgaggtgataataacgtgtgattaattaagttttaattattacaaacttgaaaaatatattaatctaatattttagagcaatttttatatatatataattttcccacgaaacgcaccatttagcaatttaaaaaacgtgccatgagtatccaaaatttcatccaactcttgttggagaaacgaacgcagcctaaataagttcagatttaccattggttttggatcttggggagttctgaacatgtttggaaaaattcatggtcgatttctttctttctttattgtgaagctcatttgacacattaatttggactttggggagctctgaacatgtttggaaactcatttgagattcttggttttgtgcaattttgttgaatgattgaaccataggggtggtggggttcatggtggctcagatctggaccatccatttgctaatcagtggttaccaggggagcagcagagcatccttctctcatacgccatcacgagtctctgtcgctcatgtggtcacaaatgagaaaattgtccaattgccagcagtgatgctgcttggtgtaattctgggcatgagttcagtcagttccatattttctgggtccaatccaaacactactgaagttatcaggtgctctgagagtcacaacatggtagtagtattaaatgtttcaagctttcaaacgattacatcgagttaagcttcagttttacagtagtacttatgtaaaagactgcaaactatactccgtatgtaaaaaatgaatagcggcagttaggaattcctggagaaaaaaacacaaattacaagtacgaggtgtacctggctccagaaatcgtaccaaaacctttataggagtagcaaattacggcagtcattcagcaccctggcaatctgggatgctagaaatagcaaaattttgacaggaagatttacatgcataagaagctaaatatctaatcatatatacaagattcaagaatatttacaaggcatcaggagtttcctgcatgtacttttttcagctatcatgcaacttgtaaatctcgtcaacataatcctcaacatcccaaagaaaggaaccaaatgcaatggcttcaagcaacaatctctttagggatgacggatcgagtatcactgcctcatcaggctctaggaaatctttcatgctttctctgaacagtgcccaactgtgcttctcaatgagattagaagcttcgcatgagcgcagccttgcgcataactccaaggtctttggatcaaagcccatcatgtaactcttcaagtcatgcagatcaacaacagaactcggttttgaggaagatgatatttctgcagaacctccaatggactcttcctgttcttgtttctgggtgctattaaattgtgcattcagaaactgaattggtgggcaaaattcttgtgactgagcaagaatcagctccaaacgatgccttgtagtgacagatttcagaaagtatccgtacattattgaagcagaataaatccgactaaattgcattcttttgattctaagtgttgagcgattgatcttgggaccatttctatgtacccatctgataatactggtcaagtgttccctaattaaacctagcacctcaggtccatgaattgattctagttctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtctcccatcatttaaccattgaagctagcttttataatttcaagcctcacttgcaatctacaatattcacatgatttcattaacccaacctatattttatttctgtaattagttgagaaattttctaatccaacatatatgtccaaataacaggtagcttatggactgaagaggtatcacctaattggttgttcttcatcagcacaacaaaataaaatgccattctaagtgaatgctgttttttattctatcacaaaagtgcaacgttgtctgtttaataattaattaatacaatttacgcttgaaatataacagagaacttgaatggggaaaaaataaggatagcagcatgtcgacctcctgagaccactaaacacttttgacaaagggcatttgtaactaacctgtgaaggcagtcctcaggagaaccgatgctatgttcccagcggatcaaggtgtcctttctttgattagatagttcttgaagttgctttgccgcagcaactgggagtacttgtggctggttcttcaacaaaccacacaagaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatcaaagatgcatgttgtggctgtggactagtgaatttttgaaatatcttgtctggaaaacaattttgacggtgcagtggataggatactgatagaagaaagacgacaactgacaaataaaaaaaaaagagaaactaaagtataagttttacttcacataaacatacactctaaagctataaaaactaagactactattgagcagtaacaaggaaacactaaaacttaatagaaacagacattagaaatttatctcctttcacacatctcagtttaagtaaagagctcgaatccagtttgaaacagcctacttgagaagtaaaacctctcatttaggcagtacaggtacgtcgtaaccaaagctcctaacttccaaaaacaagagtgggaagaattgcagcgcaggaggtcgtttgctacacctcatctcaaatcaatcactccggtatgcaaagcaccgcccctaaatataaaataccacgtcatcatcatcataatcatcatccgccatgaacaccaacgatcaatgaaggcaggaaccacgagactccacgcatcccccctagtggatttacacatcacgggcaagagaggaaccgagaacgtagagaggcgggaggtgggggggggggacctgcagcttccagcgggatgaggaggagacgccgcctcggcgtacggcgaccgggcgggcgactgcggcggaggcggcggcggcgcgggggcggagggccgccatgccgtggttgaggggggatcgaaggggataagagttggatagcgtttggggtgcgtgcggtgcggtgcggtgcggtgcagtcagcggcttctctctcgctcgcacgagtcggcgacgagtggtggagagactctcgtgcgaggggtggacacgcgtggtggctgtacactcgctctactcggtggtgtgggtgtggcctgcctaccccctgcccccacacactggcacggcacattttgacacgagagcccttgtgggagaaatccaaacacacggcacaaactttttgaaggatggaaaaagctataaaaaccatcagttttacattccaccatgtaatttatgccttgtttagttacaaactttttcttcaaacttccaacttttatatcacatcaaaacttttctacacatataaacttctaactttttcatcacatcgttccaatttcaaccaaacttctaattttggcgtgaactaaacacacccttactttgttataaatacccaccactctacttggtttgaacacacggttcaaaattttcaatgatggaaagttataaagaccatcagtttggcattccatcctgtaatttatttatttttcaaatgcccaccactccacttagttttgatgtaacaaccacccagtgcgcactggcttaccaaatcagctattattgctactgtagaggtacccccagactaagctagctgagtcaatcttatcgaggtacttgtatttgatttattctttatatttcatcgatttttttaccgtacatagcaaaaataagtgagacattgtttaatctctcatcaacaattttatttatggaatctcaaaaaaaaataaagtcaagattatactcctaagggtgtgtttagataatgggaaataaaggggagattgggattagaaaataaatgaagggttaggattaaatggaagagagagaatgaatggttatgatttaaagatgtcttttggtgagtgggaaatcatttccttatcccattagccaaacagtacctaaaagtatttaggttgttttctcttggggtaggaaactttccccagctcataaacggagtggtagattagcatatgattaattaagtattagcttgaaaacttaaaaagtgatttaatgaaaacttgaaaagcaactttcttatacgattttttttggtaaaaaaatgtatcatttattagttcggaaagcgtgtgcatggataatgagggagtagaatttaggaaagtgtagtgccgaacacagccttagctttgattaagatcacgttaactgctcacaatttatgaaaacaaattgattcggttaaatatgtgtatattagggaggtttttgcaacaaatgatttatgtgggggaacgtaaaacttcaagtaattttatggggtgagttttgcaaattttcctctaaagaattagtagatatatgatctaggagacatttccctattttctccatcccaaagtatagctatctttagaggtatatatggagattaagaaaacaagtatagtgaagtggtacatggttgtgattggttgagatggtaaaaggtagctttggacaaatttaaattgtaaaaaacaattgtatttaaagatggagggagtagattcataataatattggtcctatgtggtgaacttgagaacttgatattataagaagtagcagatgagaattaaaaatgctgagtttgttagcttttggtttcatagtttattttactgtgtggagcggagtggttcggattttaaagcaatggtttactagtgtgaagatatgggtaaaacagttgtgcttgcaagactatgatcattcctactactcctatattctattgactggcgatcgaaatcaaagaaattcttggaattagattaggcctggtaagatccattgaaatcaatggtggcacactggcgataccggtcctcttttttcctcactcgatagatttcacacgaaaactccagtcctaatctaatttcaacagactcgataattttttaaaaaagaatatatattgtgttgctgtaaagaacttattgggttatcttcttttgggcttatacttcttccaatcaaatcaaaattatttcctttttgttttgaggggaaaataactttccttatgattgcaataaacttgtgagaaggactaacaccatcattcctagtcctcttgccctacatcacaaatcaaccaggaaccaacaattgtgagaatttcatgatttaaaaccgaaaatccccctttcaaattggccaatcacaaattgaattgnnggtccgcctgagctcttgatgcaatctacagatggatcaagttactgtcataatcagtattaccctttggagagaaaccattggtagcatcatctctcttttcaactttttttttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatacacttcacactttacagtgagtttatgggctacaacgcctatagacacgacatacaaacaaacagaaaactactgtgagctagcaaagctatacctatataaagaatgaatcaaatatttgatcaattgccgccgccgagcaggtaacccttgagcgctttcgcaatggcaacggcgaccctcgtggctccagggaactggccggcgacgggtccaagcagcacaaaccacaagccgaggaggacgaagaagaatgcaacaagggcatatgcaggaccgtcgatggcggaagggtctccagcagtgtggaaaactatggaggacccggcagtggcgacgaggaagatgccacagttgatcagtagtctagcggcaggagggagctggcggtttgcagnnnnnnnnnnnnnnnnnnnnnnnnnnnnnggaacgggcattggtggatcagcggctgccgggttcaccgccgcgcgatctcccgtgatcttggaggcgcttctttgtgaaggctgtgagatttcagaatcaaataaacagggcattataagattcatcaaaaacaaaattaaaccattgaaaagcatgcatagctcaaagcagggatacaaacaggcataaatgtttgatactttgatatgaacttaaaatgcacagctcacttgttaataacgttttttatgcatttggtaacctactcctaacactacacaagcaggagtattgcatatgtgacttgtgatgagataacaataacgtgtaggtagcaaatattcttcaaaatgtagatacagaaatgataatgcattgcaacaatccatagaattagatcactcttttctagcattatgcatgtaaatcgcccatggggctaaactcttaaatctatctatcctgagtggtgtttcaggatgttgtaatcccttgattaagtttcttaggttgtcttatcagtaatcactgtcacgagatttagcctggtttccttttttgaaaatgatatacgtatgaccttgttgtccggctactgtgtacgaccatggccacaatgaaaggctcagacggcaaatgtctcactccgtgatagaatctgacatgcgcaggtgatgccgtaacggagtcggacatcagtctaacgctagcgtcgtatgtatagcagcgttcttaatttttctccctttccttttctggttgttgactcttttctggtcagttcttcaaagctgatcctcccattctatgcttcttctttcaccttcttttaatacaaagaatattgaactgcaattttcagaactagcaagaatccatgacacatgtaaaccatctcaatatagtgttccccccaacagggcatctttcagtcgaagaattcaattagcatagtttcatccaaaatggggggaaaaatccagttatatcagttccctgaaattggtcttggtttccacagaactcaaccgaacccccaccctctttctagtcatccctgcgctgcgaagagaatgcacctcgagctattacgtaaacctgactgcaactattccagcaagatctgtgaatcccttcgagaagggaggcacgaatttgggatgggaaagggaatccgaatcccttcggattcgaggagaagggcacgaatggggagggggaagggggggaggctttaccgggaagccggcgtcgcggttatcgaggccctcgccggagaggacgtcggggggcaggatgccgctgtcgtcgtcgtcgcagtcgtcctcgatcgcgcggcggatggcccccgcctcgaactcctcggcgccggagctcttcgcgataaaactggtcatcttcttctcgccctcggccgccgccatccctcctatcgggtcgcgggcggtggtcgctccccctcgcgtcgtcgagcaaaccctacctctcgccgcggcggcgccggggggagcgcggtgatcgatggggatcgattgggtttggggggatctggcgcgagcggggttgggccttcggatggagcaggctgggctggggactatatgtattattgggttatttgagttggaggaagaaatggaggcattgcggacgcggtgtggccgcggtgtgaaaaaaataaaggttaaaacttgaagccaacagagtggctatctcattcttcaaattaaattttgatatttttgaatcaaaatcctaatccaacaaacttgccaaccggatgaaaaccatccgactggccaaagtcctctatgcgttagctaaagttggccaaccaaaatgacaaagttgtcttaccacgcatgggccccacacattttcccctttctcctttcctgtatgtattgtctttccatcccagatcgagcaccctccctgcgctcctagatcgagcacgaggccaccacccccttcccagatctagtgtgcgattgagcgcacggccatcgcccccttcctagatccaacgcatgaccctattgcgcgccgccaccggcgtctatctgctacgccccttgtccatcgccgcgccatcgtccactgttgtggccgccgccatccccagactgaaagttgttggccccggatcaagcgctcgatgctaccgtcgtctctccggtttccaccgtcatcaagagccctgccatcgtcgcccaatccacaccgactcctacagcctacaggttaataccctcttccacaaaaatagccaattttgttggagatgctcttattagagcaagtaatatgctatctaaactaatatggtaaggtggaggggagaagaaaagagagagtaggagttacaacttaacttacatggataaaattaggggtggcatttgcctcttctataaaacttgctcatagacagaaatttttgttaggctcttcaaccaaccgaaattaatttggttataattcggttagcactctcgattaattgacattaggaaatagacctaattatgtatcttgatcggtgttaagttgtaagttaaatctagtcaaaagccatgtgtgttgctgcggcactataggatgaacatatggaaaaatattaattatgctccacaacactcaatattgtacactaaatgaaaaaacatactccgtaccaaagaaacaaaattgattgtggataacaaatctgtgatctatataacccatgttcttcgttagggctagctgattcttgtcctttcatatatccttttcatatccacatcattacagattaaacaaaaaattccctgtcaaagtttagtgcattagccattaatgcggtaaaaggcaaactaccataataatatcgttgaccgttgtaaacatgtaagaatggttgaaaaatatagtaaattcaaaattaaaatgaattgcatgggacagacccaaatgttcgtaccaaaatgtaaacctacttgatagagtgtgttgcacttaagcaaaatgagtaaccgcacaaaataaaatcaagcaaccaatttgccaaagaaaaacacccacgagcaatctcaaatggggagaaaaacagaacatctttaaaatctgagactaactcaccaaatcaatggtatcgtgtgatcgaattgatgcatatataatataaaagtcagacaaagaacacatgtactaacattgaagggaaagcggagggcaatatgtggtttgaagtgagaagtttatgcaatagtctaactatttttatagtctaagagatagaaaaagtaactgcaatctctgaagatcacttaatgaccagaagtattacataggggaaagaaggcagtttcagaagaggaaagaaggcagtttcaggagatcaattgatcatctgttgtaatggttgcatgcatgcatgacaatagaagaggaaccggccggtgtaaagaagtgtagatgggctaggcttggtctaacattaacagaagatcaaatatggctggttgctacttggtgattaggagctaatctagacacacaagttaaatccaacggttagcataaagtaagatgatgtggctgcaccatagaacaaaaaattggtactattgattacaccagagaacaaagaattggtattgattacagttagtggggatcaattgtttaagtatactagattactatgattgatgctcttgatgagttgatgtgttatatgtgctatttaattgtcaacatatatgttctgcagagagaaaagttgctacaattttctaccacacatttcggttatgactaaagaccggaccgaaccaaccaaaacataactattcattcttgagttttttaaaaatgtaatttgatattgagttttaaatgactgaatttccttaaacatgtcatatacttgcgtgctatactccttttcctaacttatgtttcctcgtttttcgtgtgcacatttttcaaattgctaaactattaaaaaaattaggaaagttgctttaaaaaatcatattaatctattttcaagtttgtttagttaattaaacttgtgctaatgagtccttctgttttgcttggaggattagttaccaaaatgcaatgccagacattgcctaaggtttgcgttcggaactacaagtttccatcttctaatatctcattttccgtagcacgttttccgaactactgaacaatgcaacttttttgcaaaataaaaacttaagtgaaattgtttttgaaaacttatattaatccggtttcaagtttatttaagttaaaacttagttaatcatgtgctaatgagccacctcattttccgtgtatgaaagagaagttcccaaccttttctctcgaacgcagccttaagtggtgctcgaccccatatcttcttttcttgcctcgcacgggaacatatgaacaatttgtatgataaaagcatgttagcaaaattttgtaataatatcgtgattatattgttttagcttaacacacataaaaaatggatctttgggagaggacctactcaaaattgtgctaattggtcattgacacaatccccatattcttattctcaagagtaaataggcacacctatcacaaaactactggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaagggagaagagaagcctgttctgaacttcgcagcaggtaataattcttttcccccacttatttaatgcagatttggctatcttaacaaaccataattgtctatatggatgatggatttgaaatttcccctctaattgcaagtactatgctataaaagtacttattatttatgttacgtagcatccactaagctatatactctgaagacatccaaataatctaccatatcttaccatcctaaaaaattggtgattttctagaaacttttgcacataacaatatataagaatatttggcattggtagcaaaccaagtaaaacccacacacttcaatcctaccaaattttggtgttgaaaggttaattctagcatcaaactgaacaaacccttaatcttttaagttgtactctctatggtcataaatatttgatggtacgaagatatcatcaaagttttgaaatttggccatcaattcatattacatctaataatttttaatgttatttaatattttttaatataatatgcttataccattttttttaagaactatgcactttgagaagttattgataacataagccttaaaagttcgccctaacctattctaaatatcaaatattttattatcactaaagagaataatatgtaattataataattttcattatttactcaattaataaacaatatgaaaacaaattctattacttaccattctggccctattgtcccatatttccgtaacacaattttaccggtataattttcatgcaataattccacccatctccagcctatatagaggttaaaaaaaaggggaatatttgcccaaccctagtaaaacgtacaaaaaaaaagcacaatatcaaacggagtctattattcctattccaagtacaaatagagtggtattatttcccttcttcttcttttattcggcaacggattctatgggctcggccggccccacccagcgtgcggcccggaccatcacacccaatcgtggccgtccacacctccgcatccgacggctcctccgccctccacgtgtccccacgcagccctcgccctcccatttctcctatataataatatcccccacctccccacccacccccaatccaacccccaatctcgccgcaatccccatcgccgccgctgcgaaagctagggtttcgtgcgattcacctcctcggcgacgaccgagaccgcgagcgatttcggagggctcgatcgatggcggctgagggagagaagaagatgatcaccctgaagagctccgacggggaggagttcgaggtggaggaggcggtggcgatggagtcgcagacgatccgccacatgatcgaggacgactgcgccgacaacggcatcccgctccccaacgtcaactccaagatcctctccaaggtcatcgagtactgcaacaagcacgtgcacgccgcggccgccgcggcctccaaggccgccgacgacgccgcgtccgccgccgcagccgtgccgccgccctccggcgaggacctcaagaactgggacgccgacttcgtcaaggtcgaccaggccaccctcttcgacctcatcctggtataaaagcccccccctctccctcccccatcgcgcccctaccttttcttgatggggattcagatctgcggttattgctagatctggatttgttttcttggtcaatagctcgaggtgcattctgttccaagctttttgggatgtatttcatccggtatgtttgttactgggttggatgtggtttccatgcatcacgcattcattcatgtcagttgtggaaatcatggttgcgtgaatatcattagggaaaacaagtgtactttgtgcagatggggtaacggtatgattctgtatcctcatctgtatggtcgatgattgtatccatatgattggataaatgtgccctgctatttgtttgtttcatactggtaattatgtaaatcaggactgcgtagatgtggtaattgatattctgcagattttttggtatgatcggttgatgtattgctaccatgggtttttattaaatacaacatttagttaaagaaatacataaagagctatgcagttttgcgattgtatatatttgaagtatgaaatatgtttctagtgccatgttgtaataaactcgtccccttctgttttgttgttaactgttacacaattccttccctgttcataaggattttgtgcttctctatataacaagcatgatatagtatgaaattgattgtttagatgcatgcttgccaatttggtagattaggtcaagctttaaatttgttcccttctgtttgttgttatacattatttcctttcgtgttggtaagaatttgagattcatatatcaagcatgatatatgtttgtagttctatgttgtaataaattctctcccttctgattgtaatgtttttctttcctgttcataagtcaattgcttttgttatgtccttacattgatgcagcctccttatgattatgttcataaggaaattagggctgttacagataatgatcttacattgatgtagtcttgtgatgcatcttttatgtatgattgactactgtattgctaaaatggtgaagcattatcttaagggatttagtacttgttctgtatctctaatttatgatgtttcaggcattgagtaattgtgtctctgtatcttcactgtgatatttctttgatatccagtaataaattcattgcatactacagtttgtgatcacaaattcgttcttctcttgatcaattcattgcatactacagtttggggtcataaattctctctgctcttgttcatgaattgtaaacagttctgttattttgttcatttattctttctgctcttttttcatgaattgttaacacttctcttgatctaagagaaatgatggcagtctcatttttttctttgattgtcacaagaatttactatctaaattaagttgcttgatggtggtggactattaacaacactgcaattttacaatgagacgggttatggggtatcagtgcatgttaaattattgcaaaacaaaatgtatcatgttttaacttgttgctcaagtgtttgtataccaacttctttctatggagggtccttttttttttcttttttgtaaaatgccgtatttgttcacatgcactgttttatttgtgtactccactattgcggatctaactttgttgtttgtttctcatcccacggtgtcacgtacctatttctagtatttctgcatttcaatttggatttgctacacactcgccttttttcttgaagtttttacatatatctgttatttctaactttgttgtttgtttctcatcccacggtgtcatgtacccatttctagtatttctgcattttaatttggatttctacacaatcatgtgctaaagtaatttgtttcagttcatagtgttctcatttctacatttatgctttcttttatattccaaagttgaactatgtattccttttgtggctgaatgttgatctgtgctttagccatagtgattactgcttcttataccatgtttatttgattctcaaatcccacaggccgcgaactacctcaacatcaaggggttgctggaccttacttgccagactgttgctgacatgatcaaggggaagactcctgaggagatccgcaagaccttcaacatcaagaacgacttcacccctgaggaggaagaggagatccgcagggagaaccagtgggcttttgagtagaaggcatcaaggcctctgatgtcttggtgcttagatccttactccgtatctacgtatgctctgcttttatatgtcgtgctggttgtaagtattttggagtccgatgggggttcatgtgcacgtttagttggttaaatggttaagttctatccaggaaaaaaagaactgatgtggtcagaactactgaacctgttatctgcattaattaatactatcaatctgcagtgaaatgctttgctgaaaagtatgtcatattttttgtgcgaccttagcccggtggagtggtggagttacgatctgatctcaaatggcatgggtcaaatatcatctctttgccgtagcgtctcttcgcctttttgcctgggctgcatggcatctcgttgcttattgactgtctttcctaaatagtgttaggttgaatttgggttgttgtttcgtggacattagtattctcaggagataactacggatcggggtatgattctctgcagcttgtatttttctctcctctcatgggtcgggttgcctcacttctatgcaaactttttttttaaatctagttttctaaatgattgatacaatctacaatccgattacgccgttttattcattttcacccttcaatttaaatctttataagcatgaccatattatgagaacaattgataatattgttaattgaaacatttttatatactatatgaaacatcggggtgtaacgattgaaacatcacttaatatttactgaaacatccaaataatacaaggtgcaacattaacaaatgaatcaacaaaatatcaaaataagtcacatccacataacaccacgtacaacaatagataaaaattgattataacatgaaaaattaaaaatgtccaacatatttggattccaactaaaacattcaatgtgcaacatatttggattccaactgaaagattctcttttcttttcacacgtgaaacatcgaatttgaacggtcgaaacatatatattattttgacgatataatcatgttagatcttgttatgaagtttaattgtaattagtacgatggtataaatagattcaagaaaagatgagtaatttaaaagaaaaaaagtatttaaaacttggtaataaaactttatcctttattacacataaggcacatggtaggttgcacgtgtgagcagaagcacacactaggctgtaggtgtgaagagaaaaaaatagaacacataaagtataagtagcatccgattttttccacaataaagtatagtagtagaccgatttaaagtattttcggtattctcattgaccgttttaacgtattatgtaatatagtagtatgtagtatcactattggcaatgagatctagtgggtgagtcaactatatgacacttccattcacacttcctcccatatatgagcgtttgagaggagataagaggattgagaccattaacgcatgattagttgagtattaactattttaaattttaaaaatagattaatattattttttaaagtaactttcctatagattttttttcaaaaaaatacacggtttagtatattgggaaacgtgtgcgtggaaaacgagatgttctctctcaatctcccaggtctcccaggaacgaacaaagcataatgctcaagtgaatcatctgctcgtgtcaagccgtccgcggtttagtcgctacagtcataattcagaatttgttctttatttttttttaaaaaaagaaggtaagaagtttgccttatactagctctgtattaattattttaatagtagatgacaacgttggttttgaaaaataatgtttggctgttcgttttattaaaaaatataaatacggtaaagtgtaaatcatatttaaaagtttatttaatgataaaatatgtcacaacaaaataagagatatttatataaatattttgaatacggcaaatggtaaaactggcgaaagtcaattatgttgtctagtttcttaatataaactggcgaaagtaacatttgattatttgttttattaaaaaattaatataaatatgctaaagtgtaaagtttatttaatgataaaacacgtcacaacaaaataagtggtatttatatattttgaatacggcgaatgttatggcgatgccaatgatgtcatctatcaaagagacgtagaggatatatatcgatgaaggagatattctgaccagaattaccggaaatggaaggaaaaaagggccaattgcatatttgccactagtttgaaccggtatcgtggatttgccactgtaaaaagtgtaattgcatatttgccatcaaaatggttggaattcaatatacttgctattggactgacagtttagataaacaccattagaagattggtttttatgaaaattaggacaagaataccccttcccatgaaattgaaagattaacacatcatatgattcattcaaaatcttgcaattgacaaccctgactacacaacagaacattgctacgaggtcacaaaatcttcctagcagttcctgctgctagtgatgtagtatgtgttggctttgttgctgctgcccaaacagcctgttaatgctgccgccattgccgcccaaaccgcctgttgttgctgtcatccaagccgcaaggcacaaccgcttgctgctaccgtcggcccaacccgtcaccgttgcctgctgttgctggcttgctgctgcccaagctacctgcaaacctgaccgccgcagcgcctgcttctgttgagaataacatctccatggtaggacaagacgttgaagcataacagatgttattctccaacccctttggagatgttaccttaaaccatgtactttacttctatctcagaaaaaaaagcctgagagttccaccctttgtaagaagccgccttttgctcttgtatgttccttgggttttttttcctcccatttctggtaattcttacttcatctgaattttgactcttgcactctttttaaggcatagttcggtaggatgggttcccaacccatctcgctcgtgttccgcgcgcacacttttcaaattattaaacagtatgttttttgcaaaagttttctatacgaaagttgcttaaaaaatcatattgatccatttttgaaaaaaaagcatatacttaattaatcacgcgctaatggatcgctctgttttccgtgcgctggagataagttcccaactagtggtagcgaacacaatctactatactactccctccgtcccagaaagaggcgatttctggaggggaggatttgtcccacaaagaagcgattccagcctaaaaaactagatattttatgtatcgcatctatctgtgggccatagtactgagggcggtaacctttctctcctctcacaccacagaaaccttcgccttgtttgaatcctccgatctattaaatagccctccggaatcttgctattaaggagtattaaatatagattactgacaaaacccattccataacccctgggctattttgctagacgaatctaacgaggtatattaatccacgatttgctacagtgatgctacaataatcatatgttaaccatggattaatatacatcgttagattcgtctcgtaaaatagcttaggggttatggaatgggttttgtcagtaatttacgtttaatactcctaaatcgtaagattccggagggctatttaatagcccggaggatccaaacaaggcccttatctcttccccttcccggaattgccacctctctctcgcgtattcctctctctcgcgtattcctctcgtctctctctcgttctccgcacctccagatgtcaaatcgaagccgcaagcttcccttcctcctgatcctccccgcacgcccctccgtgctccacgtcgcttcccctcgctcccgcttctcccttcgatgttctgcgttcaccaggatgcggccgctcggatgtggtggcagacagttgcgagggtttagatccgataaaggagacagttccggtgggaaggattttgctcggtagcaacgttcatgaaagtagggctgggcaatcggttataaccgaaagttcgggtcgggtagttcggtttttttaaaagatcggtctttgaaaatagatgaccgaagttgtccataaaaatccagaaaccgacaattcggttaaccgagctttcgggtcggtcttcggtctcaaccgagtttgaccaaacactacatgtagcgcccggagcctaggtagctggcggagagaacggcaggcggcagccgggaggcacgcgtcgccgcgtcggagccctgaagagcagcggagaagacatcagagggcagaccggaggcacgcggcggcatgggtggaaagaaacccttcaacaggcacgagcagtgcagagcctcggtggggaagaagacaacgattggctcgaggaagagaggacaacgacatcgacgagctggctcccggagggcgggacgtggtcccgtgcgcggcaaagtcggatgctccgattggatcacggccgtatgtcgccgttgt

SEQ ID NO: 81295 - DNA, 30870 bp, Oryza sativa
atgtggggcactttgaatttgtggtcatgccattcaggcttactaatgcaccagctatattccaggccctaatgaacaaaataatgtgaagtaccaggtaaaaaaaataatgttaagtagctcaaaagaataggaggctaaccctatgatgtagtattatatattcccatggaagtgaagttaaaacacgcctaacaaagatgtgtgttgattacttgattgcttccatgaaacacgacctagcataataaatttctaattgaggctggtaattcaacttaaacaaagttgcccttgacatagaaagatataaataaacatgcagtattccataccaagaaaaaaaattacaggaccattatcatataagctaaaatcattgaaaacatgatagacagtagcaacttgatcataggggaagcaaaagaaacaatggtgcgtgctgagtttgacgtcccagagctgttatatttaactagaatttcttctctcttttttaactcttctcgtgtttttgctaaagcttcttggagtggcatgttgtacatatggctgtggactgtaatgtcacaagttttcttattcggcaccaggtagaagaatccaccctttaaacgacgatccttgtaacggctgagcttctcgttaatgatatctatcaagtgattcatactgcgtctatgtttcttatagaccgtccatgtaagcatggctaatcccttaagcatattatggtaaaccaccgctattcttttttgcactaacaaggatacttcacggtctaatgacgtcgttttagccatagtataaccttcactgcaaatccaggtaccacgctcatctcggagacataaccgaaaattctttttcccaaccttgaaaccagtcttccttcgtcctttcctaaaagattaaaaaaaatctctaagaaaaggaaagagactctagttgcatccatcactccatttaaaaagacatttgcatcttcatatacaagaaaatgacaaccactccagatttaatttttcaaaactttaaccaccaaatagctctcaaaagattatgtttataaaagtaaaaattacatgggtataattttcgttacaagtacttttacaatacaacaatgtgctgtaagttatcgatatattctaataaaaaatagtaatccaaggtacatgtaactattttgtacatattatgcaatctcaattattttgtacatattatgcaacttaattttccgcagcaacgtagcggggtattcattttgtttgctttcaagtacatcaaaatttgttttgtggagtgacaattgcaatcatattctgcatatatagtaatctatccgttttatattataaggcggttgacttttttttccctaatcaaactttgttaagtttgaccaagtttataaaaaaacagtaacatctaaaatatcaaattagttccatttaatctaacattgaatatattttaacaatatgtttgttttgggttgaaaatactataatattttttctataatcttgatcaaacttagagatatttgactggttaaaaaaaatcaaatggcttatgatataaaacagaaggaatatttttcaagtccaaaagaaaaattctactatactattgttatttattattagtatctttcaaacctaaaaaaagtgtgcaacacgaggaactggccattacgtaccttgaacatatatatgccttgaattaatacacgttatatgatttgtgccggcccccatcggtgcacttattcaacgaacaagagaaacgacatatttgtaaaaaaaaattgtgaacaaaatttttatatacatgttcttagcgatctaaaattattaaaggataaaaaataaacttcgataaaaaaacctctaaatttaacttcaaatttaaagttgttaattcaatttttgactgataagtataagcgaaaagatgataccatacatgtttttttgaaaaaaaagatgagatgagcatataattatagtacatacatacctgaagctgcggcaggtacaatcattgtccattggctagcagagtcgcgggtgctgcaaaattgtcgtctctgttaatcgcgcggatgccaatgattttcatggatcaaccgagcacataagccacatatgttatatatacacgtagtattataccttgataacgtcgaagtgggtatggttggagtaggcagtgttgtatttggatacagtataggtgtatccgtgtatgtgtggaaaaaaaacgaaaaaaaaaacgaagtacttgagagcgtgccggtgaggcaatggactttgtatttatacctcagcgacacctttaccttcgagatggacccgatcggacggctacgatcagccgcaccccgcgtctcaccacccaaatacccaacacacaggctacgctataaacgcaggcaaaagcgaccgaaccaaaacccaaacgcgagccgagcctggtcgagacgcttctcaacgccacgccccctcacctaaccgggccgacgacccaagggcccaagcaccagccaccctctctctctctctctctctctctctctctctctcctctccgccgccgccaccccgccgcctccctcctccggcgaccgccgcgggcagagcgcgacaagagggagggaggagagctcgcccgaggtgggggcagggagcgcgaggagagggtgaggggaagatggtgagctcttcgtcgccggtggtgaacgtgtacccgctcgccaactacacgttcggcaccaaggagcccaagatggagaaggacacctccgtcgccgaccgcctcgcccgcatgaaggtcaagtaagtgtccccgcccccaaacccctccctgatctgacgctaggtttcttcttctccccggaaccctaaaccctagagctcagatcatgcccgcttttttccccccttcggtttgaacaggtccaaggtctgcttaaattagatagtactgaaacaggagtgtattaggcattttttttgtgaactatgcttgcttaagccgttacattttaactgggatttaagactaaacacttgtgttctgactgtttatgccaccctagtgttcagatggtcatcgtgggcacttattttgatccgtatgttgatatgggaaattgttttagttacatggcttataatggtgggtgattcgttgggtgttgacttgaattatagctaaaatgccacgaccatctatttatttgctcatgtatttttcctctcacgctgttgatctagctgccaagcactatgtcatgaatagttttacaagataatttacgtttgtcagaagaatacccggaatgtcaagccaaaatagtatgacactggaattttttttctgtttcttcagttgattgcgatgcattgttgtgttaattacatatatctactttgtttccgatgtaacttatgaacagctaggctccttcctcagtatattcctttctaagattatctgtccaataatgcaagttaattacaagttgcttctgtaatgacagctacatgaaagaaggaatgcggaccagtgttgaagcaatcctattggtgtgtttatactttcttcacattatttatgtacacaattttgtgtttgaaatatccaacagttgtcaaattttgtgtagttattactactagtccatataaactgcagtgtgtcaaacaaactgaaatctttgcttgcattgtcctaaataggtgcaagaacacaaccatccccacatactgctgttgcaaattggtaatacattttgcaagcttcctggtggacgtttgaagcctggagaaaatggtgtgttatgtatagctcttttttaaaccctgtcagtttcttcataaattgtaatataatgtatttagctgttggttctgctactggaatttgcagaaattgagggtctgaaaagaaagttatgcagtaagcttgcagtgaactcgccttcctttccacctaactggcaggtaatgagctcaagagaaatttagatgcaactcctttgaatttaagttatatctggtgacattttgcatgtgattcatagttaatccggtattaatgaaggttatccacatggcgtcctaaatttcatagctatttctgatttgtatcggttgccttaatattgatctagaagaaagagaaaactcaactgttgtttcggcaatcctttacctattgatttgcaatatctgtattatttgttactcatttcttatttcaggcacacatattagaatgttactgagtttatgtgtgtcatattgtggcataggtgattatgtgcacaaagttgtaatctgaagcttcaatggtcagctcattgtcttgtatacctcttagtcacagggctagttttctttatgtatgccctttgtttttatgtgccattcaagtacatgtgtaggttatggtatggtttgctggacctggaattttttggagaattgttgctgatgatttttcactagatataaaacgtgcagattcagaatgaacttttaacttattcatgcttgccactctttatagttatttccttatcgtgttttgtattcaatcatgttgataatggttttattgaatgcctttaaagatggatcttgtgtagtttaaattatatccaatctgataaaggtgtaaacattgtttccaggttggagagtgtgttgctgtatggtggaggccaaactttgagactgtgatgtatccttactgccctccacatataaccaagcccaaggtacattcttgcttcaaaaggctttttttcttagggcctgtttggcagggctccaactcctaaaataactccaggagtggagctgtggagtggcccgaacctagctccacccatctagtatattttttcagattactccagcccgctccactccctttttaggtggagctgaaaccgtttggttgggccccagctccatgagaggtggagctggagcgctgccaatcaggcccttataacttagtgaaatcagaaaatctaaatgtgcattgtggtgaacaggagtgcaagaagcttttcattgttcacctatctgaaagagagtattttgctgttccgaggaacctgaagctgcttgctgttccactgtttgaactctatgacaacgttcaggtaatctaactcatcctatagtacaattagaattcttgaagtttgagaatatttttcccatctgtgaggcgttatgaactatgtaccagtggttatagtttctttctgtttcattaggaagcatttccatattatcaatttgattttgcttcattctttcttttttctatttccacttaaaatcatacttacacagaagggaaggatccctatattaagttggtttctaaaagaaaggatccatctcttgtatttagattacttccctgatcttcgtcttgtttggtgtcattgacagggccttagttgtcacataatcacttatctttaacgaggcaacatgattaggacatcttacaaacagaatttccaagtttgataaaaatagattggtgttacacaaaatctaggttcaatcataatgtgccacattagcttttgtaagaacaattttgtatgtatagcctttcctttgtaggccatcacttctgcacagagtttgcttattcttctgatgcagttttttttgtgtcttatgttgtgcttattcttcaattactttgctactgttgctgaaatttctttgtgtggatgcagcgatatgggccagtcatttccaccattccgcagcagctgtctaggttccagttcaacatggttagctcgtgaaggtgatgagagatggagattagtgtgcactaggctctatttgatgggatcttcaacgggctgaactacctaatcgacttggcatgactaatttgttctatcacagagaatttccatgaattagcttgggaaaaatattctggatccatcgttggactgttagctggacatgcatttcgactgtattttgttggattgttttgtatcacatcgcaaagctggtgcctggtgtatttttagatgatcttttgttggctctgcacgctaattgttggtgtacatggctctgtatgcttactgccttgatgttgtatgctgtagctgtaactcttcaggctgcctagcttttttttctagccaggaactccccctcttaactgtaaaaatgctttggatttaagacaacatagagaggattaagctttttacagtgttccatcacatgcaaattatcgtgcgtctgtatgtggcatgcttgtcagttgtcactaaaaactttgcggctgaatgcaaatgcttcacctagcagcatcactaaacgcggactaatagcgctactattgtgtagttcatcttgcggaaacaacacagtacgtggtgctcataataggcggcaattcaggggtttccaatcttggggtaacaacaacacattgcgtagtgctaataataagcggcaattttgggttgaaagatcgactcggtattcttaaaaaaaaagagaggaagcagaactaagtcaagatgatatgggtcgccccttctttttgcgccaaagagtctcagtgagatggagcattgtgtagtgctcataaaaagcggcaattttgggttgaaagataagagtctcagcaagatggtggatttcgtgaaattcgatcactctttgaacaaaatccgatacaagccaagtggttcggacttagcttcggtacaattccgaaatttggatgacgaaattcgaacaaattttgttgcgatcaaagccaagtggtttggtagagctccgaaatttggatgacgaaatttgaataaacttcctttttgaatcggaaaactcgaacaatcttgtgaacagtgggccagtggctcaccgcccacttcaccggtttccggcgtccggcgcggcgcctgcagaagagcccctcgaaaacccctaccccccatagctgcccacgtccccccgtttcccgcgcccacctccaccgccatcgccatgggcaagccgaagcagcaagtgctctcccgcttcttctcccccaagccgggggcctccgcccccgccaccgcggacgatccgccgcctccgcctagacctcccgccgagccgcccgtcgccgccgtcgtctccttctcgcccgccaagcgcgcgcgcgccctctccgtctcccccaaaccaccgccaaaagggccaagccctcccctcccccttccgactacgttcgccgcaggctgctcgaaccgccccggccgcccccgcccgccgctttgaaccctagcggcaaaggctacaccccgctggagcagcaggtggtcgacctcaaggcgcgccaccccgacgtcctcctcatggtcgaggtcggttaccgcttccgcttcttcggcgaggacgccgccgtcgccgcctccgtgctcggcatcatcgcccaccccgaccacagcttcctcaccgccagcatccctaccttccgcttgggcttccacgtccgccgcctcgtcgccgcggggcacaaggttggcgtcgtccgccagaccgagacggcggcgatcaaggcggcgcacggcgggggcgcggccggcacgcccttcgcgcgcgggctctcggcggtgtacacgcgcgccactatcgaggccgcggccggggagctggagggcggcggcgcgcccgacgaggggagcaggtacctcgtgtgcgtggtggacaaggaggtggacgccatggggacggaggggttcgaggtgaagatcggggtggtggccatcgaggtttcgaccggtgaggttgtgcacggcgagttcatggacggagtctcgaggaatggccttgaggccgtgctgcttggcttggcgcccgttgaggtcatcctcgggactccaatatcctctgccacggaaaaggtatacctgtgcggtttgtgatgtgcgaattgtaggctacctgatttgttataatctgcaagtaattccaggttgtaacttacctggtctgttttctcagctattgtagttgttctaaatggaaacttatttaggattgttggtggaaagactcacagtcatctgggtagtttggcagcaatagttcggcattttaaaatttctcagcaaaaaaagaatgattgcttgttgactctgccaaattaagttctagcaaattattcctatagtgaactttggaagggttatttgccttacagtttaatgagttccccccagaattgtttaaagttcttacaatctgtgtgaaagttccttcctgttttgatgtgcttgagacccctctgtttgatttgttctgttctacatgttgtccagctgatggtggcatatgccgggcctacctctaatgtccgggttgagcgcacctcgcgtctttgttttagtgagggtggtgctttagctgaactgctctctttgtttgagaagtctggggttgatgctccaactgttgagaatggcagacatttgatggagatgaacgaggagaacaataatcctcgtgggattgaggtaccgttaagttcttctgaactcactgtcatcgcaccttatgattgggtctccatatgtagtttagtaagttccaatttctttttttctttttggttcaagcagggtatcatggctatgccagaactagttatccatgcactggccttgagtgttcgctatctcaagggttttggtatggacaggataatctgctttggttcttcatttcagccatttacagctaacactgaaatgtctctgtcagcaaatactcttcaacaacttgaggtagacttttatacaacaccgccaaagtaaattttttgtttgcatatatatgaccttctgtttatttactctgcactgtctgtaagtctcatcttgaatcctaactatatggaagaaagtgcatcctatcattaaataatatatatatatatatattatttaatatgagacttacagttggcttttcttagaaacacatggatcacgtcaactttttgtttttatgacctatgttcttaatacacttttccactccattcttccatatatgaaagtaacacctggagtgctttcaggtattgaagaaccactcagatggttcattggatggatcattgttccaaactatgaacaacacatgtacagcttttggatccagattgtttagacactgggtaagactctgtaacctggtcatggaatgaatattaatccatgatgcatcatatcactatgaaaagtgataactagacagctattgtttatcttgactattgtcttaaaggtctttggttgtgacatttcttgcagctgactcaccctttatgtgatagaaatcaaatatgtactcgtcatgacgcggtctctgagatctctgaatcaattggatcacaacaatattcaactaacaatctccaggatgaagtggacatgtcttgctcatcttctgtgagaagtgatctgagcaccattctttcatccgttttgagaatgctggcaggaactcttgatatacaaagaggaataacaaggattttccactgcaaagccacagcgaaagaggtcaaatatttattattccttttcggttctagacttctagttaatttgataatgacacctaattatgctagtttatttcattaaactgacattatacagcatgaatatcctgcttagactaatcccttttttttattatactctctgttcagactgtacatttttattatttactgtccaaatattcccatgatttcaattcaatattcatgtaatcagggtacttcaaatgatactcccttcgggctgataatacttgtcgttttagacaaggatgaggtcaaattttagaatctttgattatgaatcatttttaaaatatttgtctttcaaatatggtgactacatgtatagattagtcttaaaaagtactttaataaaatcatatatttgttaacatttttatacatattataatggaaaataatggtcaaagttgttttttggagaccgtgcccttgtccaaaagaccaaaacaacaagtattatcaacccggagggagtaaatgttatgctgctgaaaaattatggcttggttcttatgccaatagttgactggtgcattctgttcttgacgcctgattgcctatagttttgtattgtagtttgttggggtcgtccaagctatcctgacggctggaaagcaactgcagaagcttgttcttgaggatacagacaccatgtcttctcagcatagaactgtgcactctcctttgttgagaaggctaataaatacggcttcatcatgtactgtcctggctaatgctgcgacacttgtgtcttgtcttaacaaagatgctgctgatcaaggagatatgctaaacttattcattgcatctgttgatcagttcccagaggtataaccttctcttttagggcttgtttggttaatccccatgagggagggaattggaggggattaattccacaccccttcaattcccttgtgggagggattaactgaacaaagccttaatggaatgatcttgttattccctagtttttatgatgcatcgtcttcatatttgaaaaaaaaattataggttgcagagggtcatgcaactgttgaaatggccaagcagaaattggagctgttaattactgagtatcgaaagcagcttggtgtgcgcaacttggagtttaaaacagtagctgggacaactcatttgattgaagttaagtcgcttaattgaattcagttaacttctaactattgttaattgcagttccaagtagcaaatgatgtccatgagaaaagtagcacagagcaaaatattttacagttttgttatacgattaatattaccatcatcatgtcatatcttgtgcctgcagctaccggtggatagaaaggtaccttcaagttggatgaaagtaaacagcaccaagaaaacaattagataccacactccggaagtctcgaaaaacttggagaatttattgctggctaaggaaaagctagcagttatctgcaggacaacatggaataacttcctcatggatttcggcagatactatgcgcagtttcaagcaactgttaaatctcttgccactctggactgcttatactcgcttgccactctcgcaaaacaaaatgtaatagactgttcttaacccttttgtgctcatctttttacattcactttgttccaacagtacattgctaaacaaccaatattccatctgccagaaatatgtacgaccaaattttgttcgtgagaatgaagcaagtcagattcacataaaagatggccgccatccggttagttttggatcacttcccactccattcctaatatgaatgcaacttcagtttttaacaggcaaatcacaaacagtatcattgcattccttttattagttgtaatacagtactgcctcacaagttttgcatccctaagaaaacaaatagaagaacctgaaaatttgagatactcatactgcagttgaggggattagttctattggtcaattttaattactccttccttttggctgtacatctaccgtgctttgggcattttggtcttttcaaatatttaggtacctaggttttgtaagggaagtcgtgtgtacagatttgtcacgaaaagtactttcgtaatatttcaatttgatcgggtttttggccactggtggtcaaagttgtttttccaaggccataccattgttcaacacgttattatatctggcctgagtagagtagttgcatgaaattgcatgcatgtttcaactttaagagctataaagaatagtgtcatgataactgcatgctttcttgaaagcttagattttacctacaattatttcaggtggtcaatatgaaaataatattctactgtgccacggacactatttccaatactactggcagatcacacacggtcatgcatacttcatgtgaagcatttagtttatgttgacaatgtttgtatttctatgctgttggtttttaggttctggagtccctacttggagtcaattttgttccaaatgataccgagcttcatgcaaatagtgagtactgccagattgttacaggaccaaacatgggaggaaagagttgctatattcgtcaagttgctctaattacattgatggcccaggtataaatattgtctcacacttgtagttcactcatgttaacatgttctggatgtataacatagttactgcaaacttagttgttgggcttaggacctgaggaagtaagggtttactttgttgttatcttaccctgactctgagattatcctaacacttggtacactgatttccttaggttggttccttcgtaccagcttcatcagcaacattgcatgctgttgatggaatttatactcgaatgggcgcgtccgatagtattcagcatggaacaagtaccttttatgaggagttgagtgaagcttccaacatattgcataactgctcatctcggtcactagttatcatcgatgagcttggtcgtggtacaagcacacatgatggtgttgctatagcttatgctacattacactatcttctgaaagagaagaaatgcatggtaatttttgtcactcattatccaaagattcttaatattctgagagaatttgaaggttctgtcggtgcataccatgtctcatatctagcaacacggaaactgttggaagtagctgatagacagatggtgattaacaacacagagacaaaggatcttggtgaaatcactttcttatataaacttgttgctggagcttcagacagaagcttcggtcttaatgttgcgctgcttgcacaggttagttttaagttgtcatgtctttttgtttctatatttctagtttggtccaaatttgattagttattaagacatgtgcttaataccatgacttgcaagtgaccacctttcttcccttgtactctagactgattgtagaataacgacatacattcttcagtttgcttgttgctgtctatatagggaataggttctagttttgggttcattgttttagtacaggaaataagtcctctgttttcttcaatgacgatgcatgttgtggttaatttttgaagtacccttcctcctttgcaagctgagttacagtttgaagtgaaacagtgcttatgatctccttgtttttgttacttgtttgctgatatgtgttcctatttgcagcttccatctagctgtattgagcgcgcttcagtcatggcagccaaacttcaacaggagttaagtgagcgtgagaaaaataagttttgtaggctaatggacgttccacgggaaagctctccgaaagagctttgtgcacagccttatcaagggctggctgaagcatgccacaggatactatttaacgttacatctgctcaaagtaatgacgagttaacggatacactatcttctttaagggaagccagggaaattgccttgaaggcaataaaaggctggtgatcatgttcttcgaagcagtggatacttcaccactggtttccttttgtttttttgaagggatcaggtattgatgctgttccattctgttcaggtattgcttcgttctagctactagtttctaatgtagtgccttgactgatctttgcatgaaggtggcatcttctgataatctactaaaaatttatcgaagatgattttgggactaatgttatttatcgaagacgattttgggactaatgttagccattgtgctaatggcagcagtgtagactgtaaaatatagtggatctggaaggtggaggaccttgaagttaaagccaactctatggaagagcaagtaacttattgtaaatctgtagttacagcatcagttgatgtatccagacttgtccaaaccatattaaagctttgcctccattttgaagtgtagatgcagaaatgagatgcatctcttatatcctattcctcagtgaaatatccctgtgtttctaatttgtgtctatttgtgataatcctggaacttcaaaatgctgtcctccgtcttgatattttcgatttgaatttggactgatctatcttttttttaaaaaaaagttacactaatctatctactggagtacttcagcaacattttctaaaaggaaagaaaggaggatgctgaacgcagcacagcaacattttctaaaaggaaagaaaggaggatgctgaacgcagcacatcctgaaggcgtacttaagaaaggccagcccagcccagcaggggcgccggcccattcatccacttgggggcgtaccatcggtccatcgcacgtgagaggagaggaatatcccgtaaaatccgaagagaaggaatcctcctactacacaaatttcatatttttttagattttctttgtttgagaaagtttcaggtggcagagtcacgaatgcatcatcgctctcctgccctgcctcgtctcctccgctcagctcagctccggtccaaaccaaaacacacacacaacataagaggcggcggccctaacaaatcccaagagacttccactgcacaaccaacctagagcagctttgagacttgagagtgagagctcgcgagtcgcgcacagactcaaacagaggcagagagagatgggaagggaatgaggcggcggctcctctccccttctccggtgacgtgacgacgcccctctcctcctcctccgctgccgcatccgagttcataaaccttcgtcccttccgccccgccatccgtcttcccggaatcccggtatgtaagccccgcccccgcttcatcagttcggtcggattggatgaacgcccattttttgtggggacgttcagcgtgatgtatcaacgattcaatcgaacagccattggttttttttctcccgtgtttctaatctaatgccgcttactttttttagccaaacattttgttggattcctccggggttctgatttgggtttctgttgatattgtgttcgtacagggggcgcgtggggatggatttgtctaggtttactgccccgcggccgggcttgcagatcggcgccgccgggaatggcttccgggcatgctccctgcggcgtctcaggtatcgtgtctgcggcgggaaccccatgggcgcctccgccctcggaggctgcggttcccgtagcctcttctacttggctccaaaccatgggagccctcttgccctccggaccagagggagggcgctgaggtgccagggaaatgactcactggcctatgttgatggccctttggaaggtaccaatggctcagtagtcgataataccgaggacgaagcaaacagctctgggttggatgaggagaagggtgatgatgatgcagaaaatctcagggacttgcttcagaaggcgaggaaagagctggaggtggccaggttgaacagcaccatgttcgaggagaaggcgcagcggatatccgagtcggccatcgcactgaaggatagggcagataaagctcagagcgacgtctcttctgccgtgacgaccatacaggagatcatcagcaaggaggctgatgccaaggaggctgtccggacagctacaatggcgctctccatggctgaggcccgcttgcagttggcgtcagaagctctggatgccaaaaggggatcagtcgggccgatggaagttagcattgatgatgtggaggaggaggcccttgcgtccgcgcaagaggagattaaggagtgccaagaaagtctgtcaaaatgtgaggaggagctgagacgtatccaagagaagaaaatggagttgcagaaggaggttgatagattgacggagcttgctgagagggctcttttggatgcttcaaaagctgaggaggatgttgcaaatataatggttttggctgaacaggcagtagctcttgagatggaagctgcacagcgagcaaatgatgcggaactagcattgcagaaagcggagaaggccatctcctcggttgatgccgtcgtagagttaccagcacctgctgaggagcaagtaagtgatgaagaagacaatgtttctgaagtgtatgattacagcagtgatgctatagatgatattcctgaaagagacgaggtgtcaaatgttgagcgcctaactgttggggacttagctgtagaaggcattgagcaacttgaatcatcccgtgaaatgtctgatgacgaaagcactgacaagttgcttgttgagcctcagaaagaagccgaacctgatatagataagtcaaagcaagggaaaaaacaggaaatagaacgaaaggagtctcagccatcgaatgctcctaaagcatcactgaagagatcatctcggttcttccccgcatctttcttctcctccaaagcggatggagaatttacacctacatctgttttcaaggggttgatgaaatcgactagaaagcatgcgccaaagcttgttgttgggatagtgcttcttggagcagggtgagttgcatagtgaataatatcttttctctttggtttctgtttgctagaaagtaagaaaattctgatttcccatatgtttgtatatttatgctggatactgttatagtttgtcatattttctatctgtataatcaaataactgaaagtacttgttcttacaacagttgaagtgatttcattaatgttgataagccaattctttatgaaacggtgtttctattctctgtctacagagcattcttcttaaatcgggctgagaagagtagtcaattatttcagcagcaagaaataaccacaagtattgaggaagttacctccactgcaaagcccatagttcgtgagatgcgaaagatcccacaacgagtaaaaaagcttattgagctcttacctcatcaagaggtatgttccctttcaactgaacctgtacattggcgaatttatttcccttttttgtgagtacattctcttgctgctcacacaagttagacaagaaatttggcttgtgtctaactcccttctgctctttgttaccctaggtaaatgaggaagaagcttcactcttcgacatattatatttgcttctggctagtgttgtgtttgtaccattatttcagaaaatacctggaggtgatacatttatttctgacatctatatgtgcatagcatggtatcatggcaatcaaactttccttatccatctgccttttttttacaaatcatatcaaacaaattcgtctctgttctactctagttttagtttcaagtttcaaccgaacactacaaagtacaaacattcactttgattttctaatttgaaatatctgaacgtttgttcactgtccgatatttctttttctaatatgcaccttgatatcataggtagtcctgttcttggatatctggctgctggtgtcctaatcggtccctatgggctttccatcatccgtcatgtccatggaacaaaagcaattgctgaatttggagttgttttcttgttgttcaacattggccttgaggtagaaactgagtttcttttagattctttccttaatcctcatgcaggatatatcagcttaccattttttacctgcagctttctgtggaaaggctaagctcaatgaagaagtatgtctttgggttaggctctgctcaggttatactcatgctatgcaaccagtaaagcaatagttccatgtggatactccctaacaaattggagcaattgacaggtgctggctactacagcagctgttggtatgatagctcaccgttttgcagtgctaccgggaccagcagcaattgttattgggagtgggttggctctgtcctcaacagctgttgttttgcaggtacttataactggcatttatcttgtgtcatagattctgacattttgatatttctcatagtcaccgtgatcatatcacaattggaataaattgatcacctggaaaccttttttttctctgcttcaaactttgataccagagtattgtggaaacttcctttctacatatatatttgtggtcttcatttttttagttacactgggtgttgagcacttatggtttgcttctctaggtactacaagaacgtggggagagcacatcacgacatggacgtgctacattttctgtgttattattccaggtatgaccaccatgatcatgaatattggtgattatgttccaagtttctcttcctccctttttttttcttctgatgcacttccttatgttttatcttgagttcttgatgacaccccaccctgtggttgcatttatttgaatgtcctttactgttccttgccatgcatgtatgcaagcatggacttagacatacactcatctgcaagcacatgcttatgcttagggtttattgtttcctcttcccatatctattgccatttacaggaaaaaaaatgcattgacctgactagtgttaatgtaatctaagtctttcttctgatagatatttgttgtgacatactgttgtatgcaggatttggctgtggtggtcctgttgatattaatacctcttatatcacctaattcttcaaaaggaggggtaaccttttttgatgccatgttctttttccctgtctgagttaggacatttttgcttgttggtgcaaaatgatcaacgtgtttactacaaatgattcttcgtgcatgaacaatcaagtactctacatcactcttgtaacagtcagtataatcatgacatgaactgatgagataatctagatgttttatcctatagcatgatcaattgaccaattaaaattgttaaatttcttgattggtgataaattttatgaatcactttaaaagccatgttccattgcattgccctttgtaggctatttaagccagatgatctatttattgttctaagtgctcattctatatttctgatgacataggttaaattgacagaaatataacataagtaactgttgtgtaagatcagctagtgttatatatgtttattgaaatgtatgcttgacacttggacacagccaaagacattaatttagcaagagttttaattgcaatatgaccatggttgcttctcgcagagtctttccataaccatgtggtgtcgcaatgttctctttttatctttttctttctgtttaaactttcttacacaatttctgcttcttataggttggtttccaagcaatagcagaagctatgggaatggctgctgtaaaagcaatagctgctataacagccataatcgctggaggtcgtctggtgagtcggctgttgtttcatttagttggcattcttatccgttgatgatttttgcattgactctaagtttgactgccagctaaacacgcacacctacatgcatgcatgtgtgccactgcacatttatagcccttgttgcctgtgtgctcattctgctctctagaatttgattataactgttcgatttgtaagttatcctttttatgttgaacagttgcttcgtccaatttacaagcaaattgctgaaaataggaacgctgagatattttcagcaaatactctccttgttatttttggaacaagtcttctcacagctcgggtatgtatatttttcttattatatcccagccttgcatagttgcattccttgaatctactttgcatgttgttttactctctcatttcaggctggattgtcgatggcactgggagcatttttggctggtctattgctagcagaaacagaattctccttacaggttgagtcggatattgctccttaccgtggtcttctgttaggtcttttctttatgacggtaaggactctgaatataatcatcattttttttgtctatgtcaatgagctgataggagtttgcttcaatgtttatatggataatataacaatgtacatatcgaatgcaacattacagacatcgaattatgttgatattatcttgctagttcattagttatgatgccaccgacatatgcaatgaataactttacacgcttgttcactatccaactgtttgacttcacatatttgtcaagttgttatgttttatttatttaaatttttaatggtcatgtattgtgtagaacagtattaatggttccagtgtcatatcacttatgtttctgtctttgattcttattttagatttttttttaggtccaacatcgtggtttctattatttactctggaatgacgataaatcgctaattcttcctgtaagctactatcttatttgaagcccttgcttaatgcttgcactgcatttgccctttccaggttggaatgtctattgaccccaagttgcttctgtcaaacttcccagcaatctctgtgatattaggtcttttgattattggaaagacaatgttggttacatttattggtagagtatttggaatttccaccatagctgctgttcgggttggtctgttgcttgcacctggtggggagtttgcttttgttgccttcggagaagctgtcaatcaggtttggccctggttctttctgtttttttgtattgttttaggtgataagatgtatatgtcacacacatctgagttaagacaaactcatggacaatatttttgcagggtcttctatctcctcaattatcgtcattattatttctagtggttggcatttcaatggctcttacaccatggttagctgctggtggccagtttttggcatcaaaatttgagcagcatgatgtgagaagtttattacctgtggaaagtgaggtatcttcttttcactctcatagaccaacccatgttttaccttctgtttcgatgacctttttttttttgctgcaatagaggacatttgcaaaaacttagtatttttcccagtttagtttgtaatgaactgtcaagttcacagattttaacaagaatgcataattccatgctatgttcaattcagctagtataatacaaattttgtccatgtagacggatgacttgcaagaccatattataatattgggatttgggcgtgttgggcaggtttgtaatcctcataagattttatctatctatctatctactttgctcgataaatttctactaatacgcctttcatatatttttagataatcgcacaactcctgtcagaaagattaattccatttgttgcacttgatgttcgaaggtatggtactgcatcttgcaataaccttgttaaaggcagctacaagataatattgaagcatatctcagcattactattggctattatatgtataataatcctcgttctcaagcatgcatataagctgctatgtgttcaaacactttgttatgatttatgtctggctggtgatgcctacttgtggttagtggcatgcttgttagacagtgaacatgtagctggagataaattctagtagatccacaaaatattagaaaattcagttaagtgcatggaaactaaggaagtggtggcaaaacctgcaggaaacagatgttacactttccatttatcgttggttagttacattttggtagattgataaggctggtagcttccctctgaaacaaaagtgatgtcgtgtgtgatgctattgccgtaacatttggttgtcatctccatctgtcttgggctgccaagcctgccacatgtacttgttcaattagtcaatacctctggttaaacctattatcttcaactatttaattcttgggcacctttttcactcagtgatcgggtggcagttggacgcgcgcttgacctaccagtatatttcggggatgcaggaagtagagaggtagaacaagttcaactaaaaattctaccatacaacttgtcaaaaggtgctgatctcaatcgatttttgccaggtactgcacaaagttggggctgagagggcctgcgcagctgctattactttagatacccctggtgcaaattatagagctgtctgggctttgagcaaatattttccaaatgtgaagacattcgtccgagcgcatgatgtggatcatggtgttaacttggagaaagctggtgcaacagcggtaagtatgtgtaacaaagttgtgtgcaatgatttcagcagtgtctaggagtctaggtgatgacatactcctggtgcaacttgaatggacattactccatgtggttcagtgcaagtttttttttacacattttattttattggaaggaacttttaaaatccagtaacctgcctattaacatttgcggcaagtagtttttcacaaatatatgaattgaaatgtttattaaaaccttaaaccttgtggcagttagttttggaacctggtagtacacacccttagttgtacagtcatttgcatagaccattagaaaaaaaatcttttggtcactaatgaattaaatgttgaacatggaagggttttaggtgctcatttgccactcatgggattacccaagtatctgtcggtgcaattgtaatatttggtgtcatcatttggtaccgatggttcttctatacttgtgggctagccatttcgatatgatatataacctgccattgtgctgcactgctgcataagggcccattctttgtcttatgcatatccttttgttatatactgtattctatcaccgatttaataatactatctcctaatggaactacatctacttttaaggttgtccctgagaccttggaaccaagtctccagttggctgctgctgttcttgcacaggtaagcaatgctgttacagtattatactgttatgctctttcatcaagtgtggaatttaatgcacaaacatcaatttttcctattactgtatttcaggcaaaactcccaatgtcagagattgcagcaactgtcaatgagttcaggaaccgtcatctgtcagagctcacagaggtttgtgactgcattgcaacttagtgatcttagtcataaactcataatgatttcaataaaatccatagagctgtaaaattttcctatgtttattgaagaccttaatgaagtcctacgttggtctattggtggatgattttttattcaggttcaaatgctaactgctaagttcttttttctgacagttatgtgctacaagtggaagttctctgggctacggatactcgagagtcatgtccatttccaaatcaaagaccgtcacctctgatgatgagagtgaaactgttgatggagcattggcgatttgagctgatgcgttagtcacctcccttagactgtacagtagataatctgtcatcaaagataatttgcgtatagaaaagtagtagcaaaataattcacgcaatgacgattcccatttttgaaaacttagcattacccctttttttaatgtatggtaggacataggatattacttatcttctaccatcagttcatttatttgtagcccttttactccgttagcaagtaatttcttgatggagaactaggacgatgcttgcaccttacatggagaacactgagaatttcacaagtggcctccaaatggcgcatgatggataagtcgtagtcgtctcttatgaggaatccatacaaccaagattttgggttcagaactaaatattatgattttgttagtactcagagctgatgttggaaacaagtggtgtcgggtttcttttgatattgcattatatttttaacagagcttgtttattattgttcttgtatagtatcttttgttagagctgcaaataacaaattaaatatcaaactagtaaacatttgcttaattaaaaacgagtaatgctatacgtacttaaaaatatttacgaaactcttattaacaaagatcttaaccgtcggatttaagtgggtatttgtgaaaaagcaaaattcgataacaatgtttgtcacgtcagtttttgtacgtgtacccttctccattaaaaaatgcagcagtaatgcgaactgcacatctataaagcgtcttccatctctgatgggcccagttttggaagtactcctgcagtcaaaaaaaaaaaaatccatttctaccatcccgtagaattagtggagagtgagaatgactaaagtaactttaattattaaaaaaataataagagtattgaatggataaaatttttcgtttcacgtgttaatggtaggtaaaatgatagaagttaatttttcgtgtgataaaattcaaactttgagtattttttggaccgagggaatcttacgtggccgcagcgtatactctcaaaaaagaattaaaaaaaagtggccgcaaagtacgctctcatacgacggcgcgtccggtcaggtgccgctccatgcggcctccgtctcctacgtggcgtgtgccaagcggttctctctggcagtctggcacgcggtccccccctgccccaccttgttgcgtccgccctctcacgcaaacacacacaccaacgcagaacacacagaagaactccaaaaaaaaaacagtcagagagagagagagggagagagaggcagaaaccatatcgtttctctgaacaaatcactactactacctcaaatagaaaaaagacgaagtgaaaaaaaaagaaaaaaaacacgcatgaaacgtagaacaatcagcacgagcacgccgaggaagtagtagacatgcaaactttgcaactcctcgatcggaaaagtacttcagtttctagtaccattcgcaggtctcatcacacaaaacaccatcactagctacttaacagataactgaatccatctaggactatagtacctatcaaacgacgacgaatctgtcatgagacgataccaaaaaaaaagataggatatcatctcggtaaacacacatacggagtatgcccttcacgatatgatctgccgcgaccgcgagcacgaacatcctgctgctactcctacggcgccgcgcccgcgtcgtccgcggccgcccccgccgccggcgccgcgccctcgtcgtccgcggccgcccccgcgtcgtccgctggtgccgccgccaccacctcgtccgctgcagccacctcatcttcagcgaactcctcaaggtcgtcgtacttgttgaggcggactagttggtccttgcgcagcggcttcttcaccgggacggccaccttgctaccgtccggctgcacctccagacgaagctgttacggcatcaatacagagcactacccataactctagtatcattgggcctagaagatccaaacgagaagtccacaccaacccaaagtatatgagctgtgattggtctaatagttgaggaagtctataaatactagaagaatcttctagaggcgggtgtggtaattgaatctaacttctatctgaagaaaccattcctcctcctaactctgtttccttcttcctctgctctgaaatgctatgttctgttctgttcttcctcctcatccccaatttcatctgtgattcgatctagggttcgtaacatcttggtatcagagcccgatcctggagcggccaacattcaagacgcgtttgcaaggtcaagtggacgccatggagaagcagcacgaaggcttcgggaagatgctgtccagtattcaagaggcgatcggcgccttgtcggtgaagcaaggcgaggtgcaggagacgatgaacaaaatggagaaatccatttcaagttggcgacctcaagttgatgctgcggtgcagagcttgcagcgtgacatggagttgctgagaaatcaagtcggtgcggtggagcgacatcaagcggaagctgacaaatcgtcgaacacctcgcaggcgttggaggagcgggaggaaattgctcgtcgcacatctctgctgccgacgccgccaaccacgtctctgccagtatcgcaggcgttggaggagcgggaggaaattgctcgtcacgcacctctgttgccgacgccgccaaccgcgtctatgccagcctcgactggcgaaattggtctggatggccaccgcatttcaactcagttccgggggagggcaccgggggtagtcactactctcgtcccacctccgggcaagggtacgcactctctaccgtttcctcctcgtgttcattcaaatttttcggagtttgttggtcgcgaggagagtgggggatcagaggggcgtgggtacaatcacagattgccgaaattggattttccccaatttgatgacagtgatcctcagaattggcgtttaagatgtgaacattattttggggtttatggcactcatccagatttgtgggttagagtagctaccatttatttcattggtcgagctgcatcttggttacgttcttcgcgagctcatttgctttgtgggagttggggagttttttgtgatacggtggataggaagtttgataggaatagacaccttcagcttgttcgtcagattgatcagctcaagcagtcagggtcggtgaatgagtactatgagcgttttgatgatttgtggagtcagttgttggtttatgatccaaccttgagcactgtgagttgtgtccatagattcacggagggattacgcagtgatattaaaaatgcagtgttaatgcattttccccaagatttggagactgctttggctcttgctatcttacaggaggaattgggagaggctggtggatctttggtgtccaaggatgggaagaaattgggtgatcacgctgctcgaattaaaggcgcttaccctttacctttaccaccacccaaatttgtgcatgctggcaagggagatgataaaagagcagctgaagttcctaaagtggccagttcttctgacaaattggttgctctcaaggcctatcgacgagctcaaggtctttgttatgtttgtgctgaaaagtggtctcctactcacaagtgttcaggaccagtacagttacatgctgttcaagaacttttcagtgttttggcagctgatgtttctgatggtgaacaggatgctgattctacctctagtctgatggctatttctttacaggccattcaaggcacggtttctgcacatactttgcgattacaagggtccattcaaggctttgatgtgttaattttggtggattcaggcagctcttgcagttttcttagttcagtggttttacctcatctcactggtgtgaaatctttacttactccaattcaagtaaaggtagccaatggtactgttctttattgtacctctgagttgccggctgcaaaatgggaggttcaagggcatcagttctctactaatttcaaactgcttcctttggacaattatgatatgatcttgggtatggactggctagagaaatatagtccaatggatatcaattggcaggccaaaacaattcagttttgtcttcatgataagtcagtggaacttaaaggagtggtacctgaattggataaatgtgatctggtctctattcaccagttacagttgttgcacaatcaaggagctgtggagtcattggttcagctcactgccagtgacggctctagttcttctcaaaatgttccaagttcaattcagtccattttggatgaatttgctgacatttttactgaaccagaagggttgccagcttgtcgatcttatgatcacactatccctttgattgctggagcacaactagtcaacattcgcccatatcgttatacacctgatcagaagaatgaaattgaaaaacaagttcaggaaatgttgaaaaaaggtatcattcgtcctagttccagtcctttttcttctcctgtgttgttggtcaagaaaaaagatggcacatggcgtttttgtgtggattaccgacatctcaatgccataaccatcaagaataaataccctttacctgttattgatgaattattggacgaattggcgggtgcttgttggttttctaagttagatttgcgctcgggatatcatcaaatccgcatggctcctcaggatgaacataagactgcatttaagacccacaatggccatttcgagttcagagttcttccttttggtcttaccagtgctccagccacttttcagggtgttatgaattctgttttggcagctcaattgcgtcagtctgtcttggtctttgttgatgatatcttagtttacagtcgttctttggaagagcataagaatcatctgagacaagtattaagcactttgacacatcaccaattgaaggttaaactctcaaaatgttcttttgctcaacaaagcttggcttatttgggtcacatcattagtgctcagggggtagctactgatgaggagaaaattattgctgtcaaggattggcccactcctctttctgtcaaagacttgcgtagttttttgggattaactggttactatcgcaagtttgtcagaaattatggtgttatttgtaaaccattaaccaatttgctacgaaaaggggtactgtttcaatggacttctgtcactcaggaggcttttgtagctctcaagactgctttgattgaagctccagtattggctttacctaattttcagcaaccctttgttgttgaaacggatgcatcggacaaagggattggagctgttcttatgcaaaatagtcatcccattgcctttctcagtaaagcacttggacctcgcactcaaggtttgtctacctatgaaaaggagagtcttgcaatcatgttagcaattgaccattggcgttcttatttgcaacatgacgagtttgtgattagaacggatcatcgcagtctgtcttttctaataaatcagagattgtcgaccccttggcaacaaaaagctttgactaaacttttaggtctgaggtataaaatctgttataagaagggattggagaatggggctgctgatgcattatctcgccgacaatctgatggtttggaggaattgtctgccatttctatatgtttgccggactggctacaggagctaattgctggttatcagtctgactcggaggctcagaaattacttcaagctttatctgtgtcaggtgcaggtccatctaactttgaagtgctgaatggcattttgtattttaaacatagaatctggattggtcataacaaacttttgcaacaaaagattttggccaatttacatactgcagcagtggggggtcattcaggaattttggttacttatcaaagagttaagcagttgttctcttggccaggcctgcgcaaagatgttcaggagtttgtccaacattgtgatatttttcaaagagctaaatctggacatgttaaatacccagggttattgcagccattggaggtaccttctcaatcatggcaagtaattactatggattttatcgaaggtttacccagatcggcttcatttgactgtatactggttattgtggataaattctctaagtttgctcatttttttacccctgaaacacccctttactgcctttggagtggctcagcttttcatggaacatattcatagtatacatggtttacctcaagctattgtatctgaccgtgatcgagtgttcactagttctctttggaaggaattgtttcgccgagctggtactcaactccgaatgagttcttcgtatcacccacaatcggatggacaaacagagcgtgtgaatcaatgtgtggaaatgtttttgcgctgctttgttcattcttgtccttctcggtggaagcattggctggcattggctcaatattggtacaatacgtcatttcattcagccttgggtatgactccttttgaagtattatttgggcacaaacctcgttactttggattatccacttcatctgttgatgctcctggagatcttgcaagttggttaagtgagcgaaatgacatgaatactttgattcatcatcatttgttgcgagctcagcaacggatgaagagccaagctgattcgaagcgatctgagcgttgttttgcggttggtgattgggtgttcatgaaattacaaccatatattcaacaatcagttatgactcgatctaacaggaagttatccttcaaatattatggtccatttcaagtcttacaacgaattggattggtggcttacagattacagttgcctgctcacagcttaatacaccctgtcgtccatgtgtctcagctcaagaaggctctcgcaccatctgaagcagttcagccttctttgcctgtgttgaatcctgatgctggtcatttagcgattccaatcaaaattctggatcatcgttcgattcgtcgaggttccaagatgatcaagcaagttctaattcgttggtccggtgtgtcttcttctgctgacacctgggagagtttagatgaaatgcaagctaagtttccagctgcaccagcctggggacaggctgaaactcaaggagggaggaatgttacggcatcaatacagagcactacccataactctagtatcattgggcctagaagatccaaacgagaagtccacaccaacccaaagtatatgggctgtgattggtctaatagttgaggaagtctataaatactagaaggatcttctagaggcgggtgtggtaattgaatctaacttctatctgaagaaatcattcctcctcctaactttgtttccttcttcctctgctctgaaatgctctgttctgttctgttcttcctcctcatccccaatttcatctgtgattcgatctagggttcgtaacagaagcttgcggggagtcgggacagcgttgaaggtagagcggaggagagcggcctgcggcccgcgtgggaagcggcacggcggacggtgatcagccttggcgagaggaggagggggacgtgggcttcgattggaggagcaggtggtggtatctcgctagcattggccgaatggaatggacatggacacgcctgctctctttttaaaggcggacatcctatact

SEQ ID NO: 81296 - DNA, 6822 bp, Oryza sativa
gggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacacacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcattgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctatttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatctctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtactcccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctatttattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcacccttgcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattccttactcgccatcgaaatctcgattcgtagccgaacggattacgactgacgggggtcggagaagaaaattccgaacccccaccaaccttcgcaaccacctgcgtggctgcgtggtttcccatgggccatgggccatgggcaccgaggaggtataatcctgctttggttaaagaccacaacagagagactccttagctggttcaagtgtctccaatttccatcggaggaggttacccatcggacgtctaataaaaaacgaaatatcggccgcctctcacagcccttagtagcagcgcacctagcactacatttaaagcgcaagagcatgcagctacatgtgctagcctgtgtatgcagcatgtacggctactagcactatattataatgtacacatatatttttattctttgaactcttttctcttaaaatatatatttgatatgtaatttgattgcatcattagatttgttataataaaatctttataacaagatctcatatggctatattttgatataaaaaactactgaaacatcatgaaatgcttattgcaacaacagctatatgtgacatttcaaaaacccattgcaacaaaaaaaaactttaaagtgcaacatagtccatatctaattgaaacatttgtttctcattgagtgaaacactgaattttaacagtagaaacatatatatttttttcgtcagaatataatcatgcaagatttaataacaacaaatataccacaataatcggatcatgaatcgcataattagtttggaagaaaaatagttttaaagatcatgtctcaatttgcatgttcctatatacttgcatgcaagttgtgcatgcatacggctgagtaaaagtaacttggaaagagaaaccaggaaaaacaccaggaaaggtaaatcaattttagactagtatagaggaggaagctggcgtccgatgtttgtcttcccgtcggacgcgcgacacgaagcattttccatttccatctggtgttcagttgcccatcgagatattaatgccatcgataaaagcaacttcctagtttctagaaatgccattgcacaagcctctttctcccaaaaataccatcaccgtcaattcaacaccattacaaccgttatttttttttaacaatgaccattttcccctcagtgcagaatatacccagtttttatggtaaaagaaaaagagagatgaaacagtgaaaatttctaaccctaaccctagaacgatcctgatccaggcggctctcctagcggcagctcggtgcagggctcggtgacagcgatgaggcgtcggtccacggtggcggcatggcggtccatagcggcgatggggcaggacgcggcgaggaggtcgcaggcggcggtgcggctatccatagcggcgatggtgcggggctcggcgacggtccacggcggcggcgcaacggtccacagcggccgcaagggagaggcgggtttctagcggcggaagcccccaccgatggctccgtccctgctcctcctcccagagaatagctactggacctcggagtggagatggcaccgccgccgtactcgcctcacgaaccaggagcaatgacattggcctcggggtttcttctttctctttgtgctcgcttcccgccgatgtccagtggtaggttaagtttcttttggatttctcttccgatgcagagatactgagttgctgcctctgcagtggtgtttgccagttgctcctcctcgtgtggaggtgcagcgcgtccggacgaggcgaatgtgtgaaattggtttgtgaatttgatttatgtgaatttaattctaaaataatttgattgatagcaaaattgatgtctgtatttagatgctaacagaaatatggatcaatgcaaaataatgttgtgtgagcaaacaatgcaaatgatgttgtgtgagcaaatggttgcctggggtaaaattgtcttttcatacaacttaacggagagatgttaataacagtttgactgtgatggtatttttgggagaaagatgcaatggcatttttaggaagatgcttttgtcgatggtatttctgggattatggtgcttgtcgatggtatttcatggattttctcttaaaaaataatctaggaagtcggtcgatcctactgttcatggtcatgccaaccatggcaccgaccattttggatggacctgaaaacatggtagcgatctatcttctttaggcttttaaccaggcaaaagctatgttgatgcacagatgcactccaaagagtactgctatacgtacgacccagttgtacaacgatagacatgcaaccatagatcaattaaaggagagcatcttcatatgcactgtggccgtttacaactattgatcaaatccaatcgtacgtgaatcggacaattgggtcgtatgcatagaaaaatttcactccaaattatccagattattaagagatgctttgccgcacacaatggaaaatctctttatccaaaagacaatcggatggattcatgtacaaaacatctctccttcagagtgaatcttaagatcacacatacatattcgactaaaattatgttccaagatgcaaaaaggtataatttagactacattgtatctgcagccagaattgcatacaacctaccaaacgcaaactacatagcgatgcaattatcaacatgcccgaccttacaagtagcaccatctagccgatgctaagtgctttcatattcggagtttccttctcttggacctcccttagaatcttgtcacattcatcttcctcttcctcgttctcttctggcccctcctcctcttcctgcatttcctcttcatctgatctgtaatcaatatagccatcgccgaatgatttgggtattttctgcgcttcttccatgaaagtcatgatttctccactagtttgggctgagaaagtagggaaatagtcattctttgtgaagtagatagattgtgcctcttctgtgagctccctcgggaaattcttcaagaaccatggatggttctttatttcctgcatggtgattctctatacaggaaaagaaaagagctcatcgaacttgagttctagagtaagaccacagctcgatatggctcattcactagtatggtttaccacatgccataattaatcaccacatgaaaataaagtcacttatggatatcaatatggaaaccgagataaatgttaacttgcgttcattaccttcgatggatcactgacaaagattcgtgatatgagttctctgcaatcagtagatatgtggacttgctgtggtatctcatattgaattgcttttattagctgcaaacgaagataagccgccggaattcatgagtgtaaacaagaccgcaaatatattcacagaaatgccaatgaaatatatccatgagattataggactgagctatcaccttgacggtcttcataatattcttgggatcatccttgtcttcaatgagtaggcccccacaagcatgacatagagagtaaccccacacgaccatacatctgcaagctacaatataaaaatacacttgtcactaattaattaactgtgctgtctaaaaaacaggatgtcacgcccagaaattcccgaatagaattccaagcaaaatgtgcattaaaacccccgtcgaggaccggccggggtacacaaacgacaaagtcgacatacagatccacgtcttacaaacattataaaagt

SEQ ID NO: 81297 - DNA, 78115 bp, Oryza sativa
tgctgcctctgctcaccatcctcacacgtacacgtacgccttgatcacttccacgacctgctcgttgtctccacactcaacgacctacacatatcaggcactcttcgaacgtgggctgcagcgcgaaacagccactgggtcctacatgcccccccccccccccccttcctctttctttcccatgtcaccgacatatggaccccactaagcaacctaagacaactttggaaactgcttggggtgcaaaatgaaccggtattggcaattaatagatttcgtatacccggtctgtggttgagggatatgaatcaaaattacccccaagttatatacacgcagaaaattgtcttttttatatttctccagtatacatagaattttgagttaatttttgtttttgttgtctatgagtatacatagaattttccagtccgcgccatcgtccctttctctatcctcttctctctctctctctctttttcgctgagggatgggtggatggtgtcagcgttgcagatgaccatacatagagacaaccacgtgataaggaggaactcctcgtaggagtcttgtgcgcgtggcaaggttgcggaactcacgggtgagattaaggctatgtacaaaggtagagtcaggtatgagctctacattatctagagactagcatcctacaacagttggagacaatatggtctctaatcactaatgtatcaaaatattttttcttactcttctttcctttctttcgccaccatgcaacaaaaattactctaataaatgttaagagtcgactctgagccattgtcatgcataacaaccatatttctctttcttccatgtcatcaaattttacttgcatagcaataaagaaagaccactaataaaaaccgttgtacatgccctaatggccagacggtttccaacctgtcctcgaacctgttcacttcatcaccactttcaactcagccaaaatttaatagggtaacaaactaagcattatcttaccaatatcattctaccaattttggtaattctggaatttttttctcttataaaaacgatatcaaattttagagatgcatcgaactaaatacatccaaacactattaaaatttagcaatgccaaaatttactaaaatcggcattaaaatgaacaagccctcgttaccatggccctcaatatagatgcccagatgggccacccagtccgacatggcccaggcacaactgggcctgagccaaggttagtcgggtcgacacggctcaacctacgcgccgggccaggttgggcctacccacgggctgcacccacggcccagtcatggcataataggactcggcccgcggcccgaaggcacaaccgcccatcgtgcttctttataaattaagtctatttttccatcctcatctctttgggttgtgccttatggttagaataagtctattttgtcccccttcaggcatggcacaataggactcggcccgcggcccaaaagcacaacagcccatcgtgcttcttcatagaataagtctatttttccgttctcatctctttgggctgtgtttcatatggttagaataagtctattttatccctcttctctttgggccatatcttatatgaatgaattaagtctaatttagatccctcgactatttttctttgaccatgccgtgtcggaccggctcaccgtgccaaggcatcgccctaggcacggcccaactgtcgggtcgggctggcacgggtccgacaccaatcgtgctgtgcttgtgcttcaaataaccgtgccgtggaccgggccgtcgggcctcggagcttatggccatcgtcttcttgttcgattcaaactcttcgtgctctgcccgcacggttccataccctactcgttgtgttgttcttcttctacgtacgtcttcgatgcaatgcatcggtgatcgtcgaagctcgaaggaccttgtgtgattccggacggcgacctctatggatttgttcctgtttcaagggccatggacaaggtcgatgtaccggctgtcggtgtttgaaaatgacacagttggacatggcccatggacaagtggactttgacacagatttgtgttgcaatattcggcaaacatagctagcttactgtaaatgtgtaataaatcatatcgatttacttatagtccgtatgatcgtcgccgaggtctgccgtgacgacgtcgacgaggaagtcgaagagatcggtgttctgcacggcggcggcgacgtcctccttgtgcacagtccggcgcttgccctcgagcgtggcggcccaggcgcggcgcgtcagctcggcgatgaacagctcgcacgccttggagaacaccaccggcgcctccccggagatcatcctcgccccgccgccgccgccgccgccgccgtcgacgacgctgctgtcccccgccgaccgcttcatgatcttcttgatgcgagccagcggcagcgcgtgcggcccagtccgcgccgacacgccgccggcgaacatcgccgagtagggcctcgcctgcctcatctcgcctccttaattactggttaaccaatggtgcaatccgctgccggagacggtaacgatggaatggatatttatacgcggccatgcatttgactttgcgaggagcgtgcgtcgccggcggaggccggcaaatggaggaggccggccgttttgacagtgatcggtactttgcagagattatgaaatttaacaaagtacgagatgtttaattaggaacataggattgtgtacgttgctttcacttgcactgtgcagtcaaatttttggcccttgttgcttgcatccttgtgttgcatcattgcttgctagcttctcctagcctccttgtgttagtgcacatgtcattcggatggtgagttattttctaatcaaagatctagaggctagctatgtggcgcgtttaccagtattcgaacaaatattttttagattatttaccaatagaacattggtatagtcgttgatacaaacaagctatttttgattgaaattattgttactgttacgctattaatagtggagacaatgcttgatcattagtctttattctattggaaaatatatatgtaagaatcctttgtttttgttgtgactttcgaggatgactttttttaacgaaattttcatggggcaaatttggatcgcgaccaaatcttaacaacatcttggtgggccgaattaggatcgtaattttagtgggccgatatattcctttccccttcatctcattgtaccgcacaatgggcgtaaggctacgtaactgcagctgcaaagcgtaaaatgcattgacgccttccccgtcctcgatgctcccctcctccgccgcctcctcgccgccggcgccgccgccgtcgccatgggacgacgtctcctgggcggaatccacctcctcgactgttctccaacactacaactctctcccaaagaagggcaagccgcaggggcgggagtccaccgtcctcgccgccttcctcctctccactccgcagcaggacccccggaatctcactgttctctcgctggccaccggaaccaagtgtctcggcgccgctcgcctcaaccaccacggagacctcgtccacgacgcgcatgccgaggtcgtcgcacgccgcgcgctcctccgcctcatctacaccgagatcggccggagcggcgcttccgattggttggttgcttccggtgagaagtggaagttgagggatgggtaccaccttcatctctacatcacccagattccatgtatattcggtttgctgttcgccggttcgcatttttttttaggcttagccgattgtttgatcaattgaaatggcaaagttctacacatttagagttcaatggattccttggtttggtgaattttgcaggtggagtcatgcctgttccaccatctccctcagagttgctcagggaacagctggatagtgttaatggatgcgatggtatgcctctttcttggcattgagcagaacagtaaattcatgtttatagctgctaattttcttttactattagccttacgtttgacaaattgtattaatcagttgatggcttgttagaaatgctttatttgtcctggtaacatttaatttctacttaagtttttcaatgagacgcctactcatgtatctggagtagcagttgattcatgtctttagctgtgacatcgtactgtaactcagtagatatgtcgaagtttcttatttggctgattttccagtacttgttgtttttcctttctgttggaaaaaatggtatcatgaaagtgtgggagtggaactagctcccaggtgctaaacaagttggcgttggtgaccaatgcacaccaattttctagacttggaactggagagttttaatggggattacactaaatctagactccatgggtatataatacagtctgggaaactgatggatctttcatctcggtttaattgtttttttcaagatgtgcctactttgcccgcatgttaaaagtctaattcatttcattgtcttagtgttatttttctgtgtccattttaattggtagactgccttgtgtgacagatgttgggtttgttcaaaggaagcctgggcgtggtgacactacattatcaatgagttgttttgacaaaataactcgctggagtgttgttggaattcaaggtttgttgtccacgatcattttcaattcaatgttataagtttgttgattgcatcctatgtggcagcattttcatgctattcatcatttgctgttcatggcaatatatgctgcagatctgctgaagtaatatatagtggacatgctagtatttctccacaattatattgcttctttatttttctagttacgatattcccgtttcacgggtcaatggatcaactctataaccccttacctctgttctttcacaggtgcattactgtctcacattcttgagcccttgtacctgtccaccattactattggacaatcacctactggtgcttctgatgggttttctgttgaaaataatatcaagaaagttctcgatgctcgactgtcctctctatccagcaaactgctgttgccttttaaattgaacaaggtcggagtggcaatgttgtgtactgatatacaaatcatctgctaacttctcatgacagtggatccgttttctttcctacagccactattttatgaggcacctatccctccaaaagagtttcaacagacttctggagatttgcaacctttgacatgcgggtagtatatggtttgttgtctttataaacttagaccctttttttttagtttacctcatgtagtatgtacatgtttttagtaagagcacctagctttgcaatttatattttactaggtactcgatatgctggaacaaatccggttttcatgaagttgtcttaggaacaactgggagaaaacagggtacatcttcaaaggcagcatgctcaccatccactgagtcattgctctgcaagtaagagggtgcatcctttcccattccaagcatcctgatgcaaaactgttatggtatatttatattctgttttttaactgtaggagaaggttgctagaagcctttgtgttgattgaacatccattagtcaaaaagttccatcgcgaggaaatgtcctaccgtcaaatcaaggtatttcatcttatattggaaaatacagtagcttagtagcgtatgatgaactaacccttttgtcaaacgattctagtgtctgatgaatatgagaagtcaatgactgactactggaaggtggctgatgttctttgcaggatatggctcatgaataccagcagacacttgagcttctcaggaaggctccattttttagccggtggagtgctaagcctgcatccctcgattcattcacggtttcacggtgagattaacccccaaatggctctttgagttcccccagaatgatgttttcagtgctagttttagtgttgaggtgtgttaactctgaatttgttcagaaaatgtatgctcttcagccgatgcagctctgaactactgtacaagctgtcactgtaacaaacctacaaaacttttggcgttattaggttaagatatggataactcatgctgtcttgctcaaatttgtaagggggtaaattaaagtctcatttagacttagacaaggtctcattttggtacggagacccactgaaaatctgaaatgctggatgttaggttgatactactaaattacagtttgcctatcaatggatgttaggttgatactactaaattacagtttgcctatcaacggcccaacctttccttttactgtatgtcatttttttaaaacatttctagccattattcagatgatgtttcacatttgtagttatgttaaaacactagaattccacatgaatttcgtcagatatatagttcagttcccgtcggaaacctacataatttcccactctagcccaatcaccttccagatcgtcgttgccgccggagtcagcgactcatcgctcgccgtcgtgaatctcgtgacgctgccatcgcaaaggccaacacgcatgattggaacggatgatctccccgtctcctttttctgcgtgttttctgaatggatccaatgattagagtcgctaagcagtcaggcattagctgcctgcacgtagtacacggcaggcagttgcacggagtactatctactggcctgaattcgtagctgctgcagtgcagagagcagagtggcctgggatattaagagctgaccagcgcagctgaactgctctgatctggagcatccaacgaacaaatctcttttcataaaagcgaagcttggaccaacctaaacaggagagaaaaaaaaagagagaagaaaacgcgtgttagggtagagaatcatcacggcgaaaaacagaggctgggattgatcaaccgagtgtattaaaattcacaagatcaagtgtaaatttctttctgtactgaaaaaaaaagatgatctctgcactgaagaaatggagagcaaaatgccgaaatgattggggaaaatgtgcagatgtagacatacatatatggcctggcaactttacatctgtgctagtgtatgatctaaggagcattcaatgggtaatggccctctctcgcttttgtctttagtccagtgagtcctcaccgtcctgcactcatctaagcctgcaccaacagctaacaaaaccaggacacaagtgagagcagtacagcagcaaggtcttttacttctgggtacaaagtccaaacatctactagtaatggcgttgtcagccagtaagttcatcagttcatctggcctgaatttcctagaactcgctctaatgatcaagttacaaagagaagaagaagatcttgagatttcttttttgtttgtttgtttgttatgttgaaaaccttcacttgtaagtaaagagagtatttggcaatggcagtggcattgtgggtgtagtggtatagtgcggtgagacagattgtagaggagtttgttgttgctggattcctcaaagacccacttgcttaggagctcctcaagtaatgtacttgcttaagcttcaattcacaccactatcttctgtatagtcgaaactaggataagttaaactaacatatattcagttcttgcttttctctgaggtgtgagagaaatgaaaagggtggccttactcgtgccggcccaattaaacttttaagtggatcgtctacttgacaagtgtcaattggaaattttgcaagtatatatgttatatagattgactttagcctttaggcgtttgctgaatggagtgcaaacatgtttccgaattttcgcttatgaatcaccaaatttcattttgtcatgtagaatataggtatgacttaatgactgactaaaactcttgaaacccggagctatgtctgaagaaatggttgtaattaactaacatattgacaatgacaaagaaccaaaccttcctttccttctctcctttgtttatcatctcactctttcctttctcattaactacaaactgctttacaaaagcatagcgtcaatgccaaccaagcaatgaggcatctgcttcctagatcaatgctaagtacacacttgctctctaaacaaatgttctagtgcaatctaatcatacctacaatacacaagaaatgctagcatcatgcatattttcatcgatcggtctcagcctctgaattcttttaactgccaccagcacaccaggatatgcaaaggcaaaggtgactgcagagaagagaggctggcgatggttgttgacatgggaccattgatttgttgcaaaagacctaagtttttcatggattctgcctagctccacgaatggatgggaggcagagacagatgcagaaattaaaagaatccagcatcagagaccgaaagatacggctaagagaccagacagaccctggaccccaagtgagcacatgcatgtttaaattattgaaagcaaccattaagaaacatatttgcatgtaagtgctcttaatgtaggcaaaaacatattgatggcgcctcttgttcatgaaggaaaagtggtgatgaccgaacttgcaagttttatctgcaatccttttgttgcttctgaaaaactgaatttctcaccctcttggtgctatctttcttgttacttttggattaatgggccttttgtagtgaatttctcaccaatcttgatatatttctgaaaactgaatttctcaccttcctttttcttgtcaattttggatttaatgggctattttgtttgagatataatcagatgaagggttggtggtcgagtgccgagtggcctaatactgcgtgccttgcgccatcagaagagctgtggacacaaacatgatatcttagttggtgtggcctcctcaaccatcaagcaatacagacaaggacccctccaactgcaagaaaaactgccattttacagctcaaatccaaaatctaatctcctcatcttgctaatcaaccattgcctttgccagaaggagaggcctacttttggcttccttgaattatggatttcaataagctggttggaagatgaggaacacttggtgctcactgcaatgatattgctacgtttgaattcatgagctgcttacacattgcaaagaaccattggccaccatcaatctgaaaaacgaagtactatatttttaacaaagtgtaatgctccccagaaacagtaatctagtgtcagggaggagacagccatctgggaggttttgccttttgctgctgctgtctggcctgatcacatcaaggctgcttgcttccaaattactcaataccaatacagtttagtttatacacacgatggcatgtcctgcagtcctggtcactgtgatctgaggccatctctgaatatccaagtaccaagtggcaagctctctggtgacctcagtttcagtttatacggaaacatttctttcgtgtacatagtttctcataactcttaattatataccaacccaaatagacacaagagatattagtacaatgcagtataataaattgactagagaatcatacagaccgaaagaaaaaaagaaagaaagaaagaagaattttgaagtacagtagtaggtcctagcaacaattggggcaggtctttcttccttgacgctgcaacaatactcctataatctacttgtccctccatatttaaatgcaccaaagaaagaactgttctatagttgatgaccttgaatcaatgcctccgttttctcatttcgctgctagctctctttcggtgcaagaagttgattgcctgcagtcaccattgctggtccacacaatcgactgtgtgcatactatgcagagacctggaagcgttataagaacaattgtatcatttggatgtaattgaccgagttcaatgaaaactttacccttcacctcctgtgccattctatactactatacactgcctgcctaaacatagtggttttgacagtgtcctttctctcatgctgtcacgttcgattgccatgcgatgcagccccgtctgtagacacatcttcataaaattgaggtgtctgtttgctctcctcgtaccatgcatgtcgtgtacgcttcttggccttgctgaatgcgatgtttttcttctctccttgatctgttgcctgttgctggactcccaagccaccaagtggcaaaaaggatttgcaatctcagctcctatttttacacgatcttggctggcagaaaggatgatatgataatatgatatgctcactctgaatattcagtgcatcttactactatctcatttctgcagttacagctttgctacgttatggcctctgaagagggttgcgtgtgcagtgtgctacaacaaactgaactgtctgaactacgatgttataatcaagagtgtgactgaggctgtgtttagttcagcgcaaagtttagattttggttgaaattgaagatgatgtgactgaaaagttgtgtgtatatgacaggttgatgtgatggaaaagaactgaagtttggatctaaattttagatctaaacacagcctgaatcttttctcttctttggaagctgtctgaatcttgaattgcacgtgaacattattagctgtaaggctcctttcgtttcacccatttctgatacgttgagattaacgttaagagtgggtcccttgatttgcaaaccatatatgcagaattggaattggattcgatcgatcctaccaaaaattgtggtgtctcatgagattaaccatggctgccatgcaagcagcaggaccatggtgtgatagtaggcaacaacctggacccaaatttgcaggtgactaccaaacaaaaaaaaaagccactgttacttaatttgtttccaattctctttcagcggctgatcgatgccattgtcaaccaataatttctgaactgagatttttcttttctgcaacacgaccatgcattcgaattagaagaagagacatgaagaacatggagtatataagtccaagtgcaagaggacaagagtcaagacaaactaattactgaaactgccgagctgtcttcactccctccaccgctattactgcagcagctacgtctcatccttatccttcctctgtttacaaaaaatctaaggctcggtattattacagcggattatatgttctattatagcgataaattattttttgtaaaaaaaattaaaataagttatctaagtttttttaagaaaatgaattttcaaagcgtagagtaaatactatgtttagtaatttagtgaataaactaaaaagagcatgacttaaacacacgtccaagatgtaccatgtagcagcagcattctagcaatataaaccatcttaagttcttaacagtatttcagctaacggtattgtttttgtgttacccaatattaaatctgttgtagcctagttatcacaccatatgctgtaaaaataacatgaccttttttattatatcttgctaagtcaccgcactgtaattaagagagaatccaagaacgcagagaaaatggagggaccacatgaaaaaacaaagggaggacacagcgttgaacggtcagaaacaccacacccatttctgaagaaccccaaaataagcttctcctaaagaagttaaaaaatatataggcaaagagagttaagagacactgcaaacagcacaagagcagatcaaaaaaatgctgctaatgacattctataaccagtggctagtcttaaaataaaaggaagatgctccctaacccctaaattttcttttgagatgcttaatctctaacactaatgctaatactcagtaagtggtgggggtaatttgttaattaattgagtggtacttaattgacaaattaatagtgcgcgtgataactaatcggccaccgcctccccccacccttgccattttaattgctcgcactaaattagcccaacattctcctcgcttcctcctctttctctctctacgccctcgtctccctctctctctctctctctctctctctctctgcatcttcttcttcttcttccagtgctcggctctctcttttactcaactgctcacactccccaaacaaccaacccacctccatctccatctccatgtggtgctgaggccggagcagcagcgaggaatcggagcggtagccatggcgccgtgaattcgcgcgaggacgtgcgatctctgagagaggggggagtgtagtgctcgagtgagtgattcggaggcggtgctgcagctgcggcggcgttcggagatgaggcattgttggggcggtgcttcctccgtcctccggctcctcctcgcgttgcagtgcggggtggtggtggtggtgttgcagtgctcggcgaatgcgttgggcagtgacggtgagtgttgtcgcttgcgcggttgcgccgtgtatgtgtgttcttccactgacttggtgtttttctttcctgttttttttggtcggattttagggagttttgtttgaattcgtggtgttttttctaattatgcactgcctgtgaattccatttctgggagacgttttacgggttttttttttacatttttttaccgagtttgaaatggctgttcagatttttggttctgatctatcttcttcgaaatttccacctgttactcggtggaggcgatgcaaatttcgagatttatccgcgaaatttcgtgcctaaaactcgaattccacctccatttctatggtgcatttctgatctgtgaccaacggttttgctgtgtctcgtacactctcgttctgttcctccatgagaaatgtggcgttctgctcacacgcgctttgctacgccttgtgctagtctcggcgctcatcgcgttcaagcgcgcaatcatcgaggacccccggtcggcgctcgcggactggagcgatgcggacgggaacgcctgcgactggcacggggtgatctgctcctcgccgcagggctccgtgatctccctgtaagaaaccccccccccccccttgcacctgcactcagctagatctcactaatgtttcacctactgctttactagttactactgtggtacttactagccggtaatatcaaatcctgttcaacattactgtgtacataaagtggggagggaaaagagtttgttatggtgatttattaatgtttacattagcaggtactacaattttgtaggtgaagacttgtttgatactataagcactgccactagcttatcgttggagctgtacaatgctgtatatgtttgacatagacgcatattgcatgtgcaaacagctggaaataatggagtatgatgtgccatttagatatgtagtcagtagattttgtttgcaatgaaacgccaactaaaacccgtacttgcgtgatcagtcaaaatccttctgggatggaatttcttctcatgtgtcatgactcgatgattccgcaccttgcaggaagctgtcaaactcgtcgctgaagggatttatcgcgcctgaacttggacagctgagcttcttgcaagagctgtatgttctgttttattgttttttcaactggttatgatgaattagcttcaaggtttctgaaggtctcctttttgggcaggtatttggatcgcaacatgctttttgggacaattccgaaacagctaggttcactgaggaaccttagggtcttggatttgggtgttaataggcttactggtcctatacctcctgagctggctggattgagcagcgtaagcgtaatgtaagatgccaattgatttgcttatatattcagggttttcctgtctctggtgcttctttgctattgaaactaaggctgctttcattcatctgctgtagaaactttcattccaatgggttgactgggaatataccttcagagctgggcaagctacagaatcttgttcagctgaggttggacagaaatagactgaaaggatcaattcctggaagcaatggttctggtttttctcctacggccaatagtgggttggtgacttctccttactccatttttatttgatgatcaagactgtagatgcattttctatatatattaaaccataaaaatgtcacttaattcccttcaggttcctgtgctcttgtattctatgtctatatttctggatatccatgccatagtcaaaccattttattcatgaactgaacaccgcagctatgatatcatggcgattgtatttgtgtgtccctcttaaaaaacattcgttcttacatactagttaatttggcagtaaattttggtgacagtaaaaaggataagactaggtatcaagtggtggttacttaaggccccatcgtttggctttttccctaataagccaaaacggaataaaattaaatttgtaggtaaaacttttatatgtgtgttcttggtgacttaaaagccaatgctgaaaaaaaaaactacgttgaaaataactcaaaatcaatctcaaaattaagtttgaaaatttaaaatttggctttttctttggcttattaggccatccgatgggagccttagtaactttgtgcatgcagcttctttattatattctctcttgatgacatctggcagtgagcctgcaaaaaacttatatttgaccatgttttattatctttttgttaattatctgaatcgattttattttactccaccagatccacggctcacaatgggctatgcccttctcctcgattaaatgttggagatttctcatacaactttcttgttggaaaaatcccaccgtgcttgaagtatcttccaaggtagtaccatacagtgtgtttgctactgctttaaggtccatccatttacatggcttgtctgcaggtcaagtttccaagggaactgcttacaggatgagtactctgtccggcagcgggctttccaaatttgtataagtatgtatttttccttctagcattaacaggattacgcccccctccccccacccaccaaaaaaaaaacattaacaggattacttcagcatgcattaaagtgatatccttctattggaatttcacgatgtacctgcaagtggtgttgtgattgatatcctacaggcctacacttgcaaaatttatccgtgtcatgataagcagaagtatccccttttatctgcattcagtatagccctctacctttacagtttcactgctttatttagcaatcaatagaaggccaagatagcccacttgatctttgcatggtcaacatgataagacaattgatgtgcttcatttttccgtctttatttttttaaaaaaaaagtgacaaaacttaaagcaaagaggccaatattgaatttaagctaaactttaagcaattcctgatgtggggacctgacgcaaaacaccacactgaaattttgcacaccaattaaattgattgcatttctttactatttgagtattgttgggtaactagtcgataacaccatgtactgatattggctgaatccactcattttgtcttaggtggttctccggctggccagcgaggtggcgtaaagggattcaagcatcccacctctgaccataaacatgaaagatcaccacaaccaacatggcttctcattttagaaatttcaactggtattcttctgcttgtatttgtgatcactggtgcaattactgcttccagaagttgcaagctaaagccatcgataagaatatcctcgtggaacagatcaaaaagttggagtgatgagataacagtgctgatcggttagtgctgttatcggttaattaattgatatgatttgaatagtgctgttaatatcttaatgctctcaccagattctgatatgctgaaaagcctgccaaagttaagtcgccaagagcttgaagtagcttgtgaggattttagcaacattattggttcatctcctgagacagtagtgtacaaaggaaccatgaaggatggacctgaggtttctgtcatatcattatgtgcctttgaaggtcattggactagccaacatgaactattttaccaaaacaaggtaaagcttagcaaaattctgctgtgagaacagtatgttgtcccacaatattaatgggtgtaaattttaggttattgacctggcaaggttgaatcatgagaacatagcaaaatttctgggctattgcagagaaagtgacccattctccaggatgctagtgtttgaatacgcatcaaacgggaccctgtttgagcacctacactgtaagccagcctctttattttctgacgattatgtgatgcttagttattgcatattgcatgtgttatgtgcagcaggtttgcttatttgatttttatggggttccttcagatggagaaggagctcagttatcttggctcagacgaatgaaaatagccattggcatcgcgcagggtctaagatacctgcataccgagttgcagcctccatttgctatctctgagctgaattccaactctgtatatgttactgaagattttactccaaaggtaaggtgcacgttatttttggttcttcagagatagcctttccttgtctgttcatccctatccttagagtgcaatactctccaacctggtgaaacaaacacaattgttttccatttttgttttcagctggttgattttgagtgctggaaaatgatgttcaccaaacaaaaacatgagaaggctcctggccgcatcaataacaaatcctctttccctggccacttggattcttcagaggacaaacaagcagacatccaaggcaatacatttgcttttggagtgattttgctggagatcatcagtggacggcttccttattgcaaggacaaaggctatttgattgactgggtgaggcattctactctttctctatctcattgtgacaaagaagtaaatattttagaaattgactctgaagtctgctcaagaggaccagagcctagttccaccatgaacttaaaatgacttaaacaaaacatatagttcagaaaatacaggagcatgcagtttggaatattagttgcattgaacatttgcactgcttattctgaatatgcattctctacattgttcaggccatcaagtatctgcagcagacagaggagatcggtaagcttgtcgatcctgagctgaccaatgtcagaacagaggatctcatggtgatctgcagcgtagtgagccgctgcatcgaccctgatccatccaagagaccatcgatgcagatcatcacaggagttctggagaacgggatcgacttgtcggcagccgccatcctgaaggaatcctctctagcatgggctgagctcgccctggcgttgtagcataccattcttaccgctgtaaattcgtccgtcacatcacacactaatatttatctgatcatggccattgcatgctcggaatatagaggagctgagacgcacgagcaggcaggcactagttcagtttggtcgtgatactgtattgactgtttttgactcataatgctgtatgatttacagttgattgccggtattgcacagcaggtgtttcttcaatgcctcaccggtctaacgaaattcctttgttcgcctctgctggcatacatgtgtaagtttgtggtgcaacctattaggatgaaaaccggcatggaaattcccaattggctctgtacggttttcgatcgtttctgatcatcaccgcgtatgaatattgaaactgttttcctagttctcttatcatcgtattgcgattaccactcgaaaaattaaattggtaaatatggaatttctcgactgacacgtacaaatgatatcgcatccgacagttttcgttctaggctcctactccgtagtgtatgctgcgtgctgcacggagtttggaattgtcttggattgttggaatcggcatcatttttctatccgaatattatgtcaggtttctgtgctgcgtttcctccaacttggcatgctgcaatcctgataacatccacagagatggattgagaattccaggcaactacgcgaatcacaggttggggcaaggcgcagggacgcgcacgcgtccggttccaggggtcgtggaggggaagccaagggagaccccagcttcgccgagcgccgggcgatcgcggatttctcgtggttttgatcgcgtatttttcccgtggttttggaggctgcacgggtcgagctctatcgagattttcggccacctccttccctgtggccttgtgggcttgcgtgggctgtggctgggattcgctacagggatacgtaggagcgctcctccatcagttctcgattgtcgattgcgctgcggagacgccgagagatgggtgttttgtgggcgccggcacccactgacccaccaaacgtcacttccctactgtgggacaccacgttggtggggccctaccttcctccgtcgtttctcaaatccggaaagcaagggtgatcgttggatcgttgatcgattgatcgatcagtttgtgactttgaggaaacgtcgccgtcgccactggccggcacagtgggcgagtggcagcggcgccgcggcacgtcatccctgacgattttttgttgcaaaaaaccagaaacgactccgcgataaggtccattgacgtggaaatgcacgtcgttgtccccaacaactgaaccaccaaatcagcgagcgagaggtgcctgacctctgctgacgaacgcagcaaccggtggtatgtatccagtatccacctgcgttctagaatatgccacgaacccgcgccttctttttctcttttcttttcctctcgactcgatcgactggtaaaagttggacgaccactgtgctgtgctgtgggcacgcgctcacgggtggaaaaacgacgacgataatatgaccaacacgtacaatcagtttggccggtgagaagtaataacaacaattcaacacgtacgaaaggacgggaaaccgaaattttactactcgttagcacgggaaacccaaccctaaacgaagctactggttgtagccgaagtaaccagaaaaaatcaaatcaagacacgaacttgatagatacagtaggacgatggcatgcgatgggttggtcgggaggtagagacttttattacgccttggtgggcagcaccggcacgacgaagtgctgcgcgacgatgcggcgctggatcttgccggtggccgtcttgggaagctcgtcggcgatgtacaccttcttgggcaccttgaacgcggccaggttcctccggcagtaggccagcacctcctcttccccgagcgacacgccctcccgggggatcaccgcgcagttgatctcctccccgtacttggcgtcgggcaccccgaacgccacggcctgcgcgatggccgggtgcccgagcagcaccgagtccacctcgatcggcgatatcttctcgccgccgcggttgatcagctccttgatccgccccaccagccgcaggtacccctcctcgtccacgacgccgatgtcgccggtgtggaaccacccgaaccggaacgccgcctcgttcgcctccgggttccccttgtacccgctcgtcacgttggcgccgcgcacgcacacctcgccgctcttcccggcctccacccgccgcccttcctcgtccaggatcgccatctcctgacccaccgcgcgccccaccgacccggccttcctcgccccgtcctccggcagcgggttcgacgtcatcaggtgcgacgcctccgtcatcgcgtacgcctccaccaccggcgccccgaacgccgcctccagcttctccatgatcgccggcgccagcgacgcgctgcagctgcggatgaaccgcagcgccgggtactccgcctccggcttcgaggtgtgccggtcgatgatgatctggtggatcgtcggcaccgccgtgtaccacgtcgcgccggcgccgcgcatgtcggcccagaaggtggacgccgagaagcgccccgccgccgggagcgtcacggacgcgccggacgccagggaggcgaggaggccgcagaggaggccgtggacgtggaagagcgggagcacgatcaccgtcgcgtccgcctcggtgaggcggtacacggcgcggatgttctggacggacgccgccaggttgcgctgcgtgagcggcacgcccttgggccggctcgtggtgccggaggtgtgcaggaacagcgccacgtcggacgggtcgttggcgaagtccttggccgcggcggcggcggaggcggggaagccggcgaggtggacttggccggcggcgtccttgaggctggcggtggtgtgggcgaggcccagcttggaggcggccgcctgcgcggcgacgttgccctcggggttggtgatgaggagacgcgccccggagtcggagaggtagaactcgaactcctcctgcgtgtacgccgggttcagcggcgccgccaccgcgcgcgctcggatcaccgccaagaacatgatcaccagctgcaaaaacacacaagaaccagatcagcatcagcagctcgatgatcgtcaccgtgatatcaacagcttctgtgactggtgctttacctcgacggtgttggggaaggcgagcgcgacgacgtggccggggagcacgcccgcatcggcggcgaggcgcgcggccgcggcgtcgacgagcgcgtcgagcgccgcgtgcgacaggtcgaccttgcccgggacggcgagggcgcggcgcgaggggaacgtggccaccgccgccttgagcagcgtggtcagagtcggggtctccattgggtcgcccgctgcaggtgcttcacgtacaaatctctcgtgcgtcgcgttggtttgtgtgtgtggggagaacgtgtcgtgtgtttggcgcctctcaaaccgtttggccgtgtggggtttatataggcgcggaaaaccgaaaggccctcctctgcttcgcgtttgggcctctgcttcgtcagccacggattattgctgtgctctgatagtgaggtttactggagctcagctcacaaccaaaatcaaatttggatgtttggcctttgctttgcctccttgcattgcaccaggtgtgtgcgtgttgacgatgggaggcctttttctttctttatttctttttttttcgagggttcgtgtcgtagcgacgagtgtcttcctgctggaccccacaactgttgcacgtggacgcatagattaaacattttgatcctaatacgacacaaaatccttttgattaaacatttttctgtgatatgatattctccctgtccaccactgcgccgagtcttttttgttgtttcttcaacgaaactactgtctttttttaggcctcgctgggaggcagagaatcacttgctactgtttggcaccgaagagaacgcaaaaggctggaaaataattaagttggagtgtttcctttcttacgtgtccgggattcttgtcttgtgcggtttatgttatctctcacggtgttcaagggggaaaagccagcatttttatatgcccatccaactgggcattgcaagcgtcacgagtgcgcgcagctgatgcagttctaaattccttttcttttggatataaagctaagaaaacaggacgagtcgatcgtgctcagtatgcagcagcagccggtggtcagccaaacgtcgacccggccggttatttgtggctcaaagtgcgtgtggaaacgctcaaactgattgattaatccgcgtccgtttccaccgacggtaacccagagcgtaatactagaagcaaaagctatcgacaccgtgaccgtgtatgactagagagatctactagaatatactcgatcgaggatattcctctctctctctctctctctctctctctctcacttgtccgttagaactataataattataaactataaataaggagacaaattaacagaaattgtaaggtgccaaattgtaaggtgccaacaagctcgacgtccatatcaactcagctcagttagtacttatactacttctttaaatacaactatcattgaaacaattgattagtagcggctgtgatttaagcgcagttgtatagtagcgggggacgtaacggtgataagacgtgtcgagcccgggcagccggccagccaatgtttcgatcgaaatggaaagaccaaccaggcaagcaagcggcgccgcgtacgagcgagcgactgtgcgatcgaggcgaggcgaggcgaggcgagggcgcgcttggacaggcgggaaccggggaaacacgcatcatagagcggctgatgcgagtcgctctctatgtttggtttggattgaaatcaactagcgattgcgcggctatcacctaaacaaaatcatatattttttatataattttacttaaattttattaaatagctatcttattgtcttaagagtttgaaagaccaagtttgaaagaccaaaccttatcatctacgtgtttctaattatatagttttttaaaagtcacaccagttgctacccctatgtcatctccttctttatttgcttgcaagatttatcactatttctattcattctccttggaacctttaaagtttggatcttgtactttttagagtttattgtcacgttggattcatttttataatttctagacgtttcgtcaaacgttgctattatactcctctatggcccgtccactgtatcttctctttattgtcattgagattttaaaaatcgaacataattaccgtttggattcatttttactttctagaagtcccgccaaaccgtcagcggctttgccttgtatttctctacggcttgcccgctgcctcccttctttattatcattgatattttaaaatcgaacatgattataatttttttttactttttggaagttccgaacctttaaaaattgaaccttatagtttttagagtttactgtgttgttgggtttcattttttataatttctagaagtctcgttaaacgatgccactattctcctctacggctcatccgccgcctactctttattgtcattgtgattctaaaagtcgaacataactatcgttggaatccattttttattttctataagtcccgttaaccgtcagcggctttgcaactatactcctatacaccccgcccgctgcttctcctttttattgtcattgatattttaaaaatcgaatatgattatcaatggggtttatcttttttgctttctagaagtcccgacaatcgccttgctcgtttgctggcctgcctgtcgttcttccttttaatcatcattagtgttctatttggtgttttattaacagtttttatatgtcgtatcaaccgccaccactctactcttttataggcttgttacttaaattatctcgtcatgtgttttagatggttttttctttcgatagtctttatttttatcacatttttcagttatttataaattgtattcctaattgaaatattatttttcttctttttctaatttaagaatttatttttttttaaaaaataaataatatcgtatcgtgttcttttaatatttttattttttattttcaattttagttgtttcaaaattatattcctacttgaactctcttttattttttctaattttggatattattttattttttattctaaattttaattaatcttaacagtgtttatttttaattctgaatttcagctaattttaaattgtattcctacttgaactcttcttcttttttttttcttttgctaattttggattttatattccggcttggttcctgagcttccaagcttccaaaaatcagactggagtctggttggttccggtttggtttattgatgctgtttccgagtcttttgtttccataaaatatgtagactcatattaaatcacaaccattaatctagatctattttaatccaatggctaatatttttctctttttctctgattaatgtgggaatttctagcccccacagtgaacgtggagcctccttttaaagctgttttaataatataatagatagatttattagtaatgcccatattagatttcacattaatttagaacaatcttaaccagaattcgaatgttggcttatattggtaacaagtgacactaccaaaaaaaaattggcatcgtagcaatccaaataagccccaagtttgcggagcggcgggccgtggacgctgtcgcgcaagtagccgagagagtaggaggtgtacatagtgtgcatgtcgacacttccgcgctcaggcggtcacgcgtgcgtgcgtgcgttcaagctgctggtggagactggagtaaatattattcagccaaatgactcggtgaattgaacatctgaactcacgccacttgcgcgcgtaagacgatgtccgcgattacgatcgagccgacgcccgtgcggtcgtgatttgccggggcccggcctgcaatctggctcgctagtcgcccggtcatatatgcaggctgcccctccaccagatgcacctgcgacctgcgtgcagcctctcattccttcgcgcgctctatgcagcatatgcaatctcgattcgtagccactctaggttggttggtaggttgttgaattgaacccctttgatgggataggtgacgacatcgcatcgcaaaaaaccgtgcgtgtgtgcaccggatatatatcttcgtgctggcccccggctgcagctatgattctcttctgttaggatatggcgacgtgcgtggcgttgatttgtactgttgcgggggcgttgctatttgagttgagtaccatacatgcatgaatgctcgcttgctcgcaaaatagtagtatcccggctgtgcacgtacgcgtctcgatcggttgttaacttgctggttctcgcgcgttaccgtgaggccacggcgcttcaatcaaactgtatcaaattaaccaccggatgtgatagaggctgtgtttagattggcctaaagtttaaaatttagttaaaattgaagacaatgtgactgaagttgtgtgtgtataaaagatttgaggtgatggaaagttagaagtttgaaaaaaaaactttggaactaaacacgcccagaataatggaagatcttcttgtccccgagtgttattatcagggatggtgtcttgggcaataagcaacgtgatttttgacctagctagttagagaagttacagcaggtgcgtggaaactgcaaagtaaaagtgccatatttgcggccatggcgagcccagacatgatggagatagttaacctctctcgcatggttgaaattaattgcaccagttatatcgtgggcaccctgaaataccatcatatttgaagacaggatacgtaacagtactagtttctttatactaagcttaatgtgctgttgcttttgagcccttatttgttttctgtcaggccaaggccgggtcatcctgcctctgagaagagagaccacaagtggttgaatttggcccctaggagagggaaaaggcaaagatactgatacatacatgacccccggtcggcgaggcgactcctactattcagtccagccgcgcggcgcgtgacggcggtcatcggtcaaagacacgaaccggaaccagtgtggtgaggcggacgtacgtacgggaacgggacgaccaacccctggctgctacgcgatccgcaataataattctcggacatgccaacaccataggcccaccggcccgcatgtacttgtagcgattaccggcccggagaatccagcgcgaccatcggcccatcaatctgcgggcgcgttgcgcctccgcaaccgcaaccgcaccgagcgcgcggcctgcctggctagcgtttcggcccatcgatccgcgcgcaccgcaccgcaaaaccggcagcgcggcgcggccgtcgctgctggcggcagcagccggctgctcctcgcgaatcgtgatggatggacgcgtgagtcgtgacgttgcgagtggtgcgactttgacctcgtttggttttgcgtttccgtcggtgcctcggcccggccccggcgcgcgtcggcatgtgacgtcccacgtgcgcctcgcctccacctccaccgccgcgctcctctccgctcctaggattgttcttttttttaaaaaaatatacatttttggccccttctacagcttcttccctttgaattttttttcgaaaccgaactcttccatcaattccttcattgcttcttttactcgctttctgaaacaaacaagagtgtaggtgtatcagttgtgtgccattctcgtctcttctccgcgacgcgttcgctttctctcccacccaaaacccccagagagggaagagaaacgcctccctcccctctcctcccccgacccaccctgcacctccttcctcgtcgacgccatggcagcaccggagtgaagcagccagccagccgcccggatttcaccatttggtcccgggtttcgcccggatctgggtctctcttcaaccgtcttctccaatctggcggtgctatagctcgccgcgcccggttggggacaaggcccagtaggcgctagccaaacagtgttgagcgcctcctcccctcctcgcgcctcggcgcacggccggcgagaaggttttgaggggcggcgagcttcttcaatctgcctccatctcggtttgaatcggtatgcatatactagcatctccctgtagactgtagtaatacgaaattgtactagtagtttatgtatgcgtcgccgtcggtttgatctccagaaccatcgctgtcagcgagtagcattagcacttactgcgagcttatggtccctggggatctagtattagtttgtggatttctccatttgatgttgacatgctacagtatctccttcgcccatcatactactagaagcgtttctttttgcgcttttgtcgaatggaaaagatttgtagtttttttatgtgtaaatcaagtttgatttttattttttgttcacctgcatctgttatgaaaaattgttgtttttcccttgttgatgctacagatgttctatgactgcatcatcaggttcataagtcctgcttctaatcaatggtgctaacagatgtttctgttttgtacagagtggtgtagcaaataacatcattttcggaggcaatggcggcatataagttgggtgtggaggttgcaagtgctcatgacctgatgcccaaggatgggcaaggttcagcaagtgcctgtgtcgagcttacgtttgatggccagcggttccgcacggctatcaaggacaaggatctgaacccagtgtggaatgagcgcttctacttcaacgtttcggatccgtctaatcttcctgagcttgcgcttgaagcgtacgtctacaacatcaacagatccattgatggttcaaggtccttccttggcaaggtcagaattgctggaacctcattcgtgccattccctgatgcggttgtcatgcattatccactggagaagcgtgggatgttctcacgtgtgaaaggggaactgggtctgaaagtatacattaccaatgacccatccatcaaagcttcaaaccctctcccagcaatggatcctgtttcaaacaatcctcccccaacgccagcggagcaaatagcaactgatataaccggtacaaatctcagcacaactcatgagcacagggctgaggtgaaaacattgcacaccatagctaaggaggtgcagcatcagcaccatgggcatggccatctaccagcttcctttcccgaccaaccttccaagtatgctgttgaccagatgaaaccagaacctcaacaacccaagattgtaagaatgtattcagcagcctctcagcaacccatggactatgcactcaaagaaactagtccatttcttggtggcggacaggttgttggaggccgggttatacgtgccgagaagcatgccagtacatatgacctagtggagcgaatgcagtatctttttgtacgtgtggttaaggcacgggacttgcctgacatggatgtcactggaagcctagatccttatgttgaagtgagagttggcaactacaggggtataactaggcactttgagaagcagaagaatccagagtggaatgcggtctttgctttttccagagaccgtatgcaggcaactatccttgaagttgttgtcaaagacaaggatttgctaaaagatgactttgttggtctggtgcgatttgatctgaatgatgttccgatgcgtgtgccccctgacagtccattggccccagaatggtaccgcctcgttcataaaactggggataagtcaagaggcgagctgatgcttgcagtttggatcggcacccaagccgatgaggcatttcctgacgcatggcattcagatgctgcaacacttgaggatccatctgctgtaacacacatgaagtctaaagtttaccatgctccaagactctggtacctgcgagtcaatataattgaggcccaagatattgccataactgataagacacgctatccagatgtttttgtaagggcacaagtggggcatcagcacgggaggacaaaacctgttcaagctagaaatttcaacccattctggaatgaggatctaatgtttgtggctgctgaaccttttgaggatcaccttattctttcccttgaagatcgtgtagctcctaacaaagacgaggtgcttggccgtgtaattataccgttgacaatgattgatagaagagccgatgatcgtattgtccatgggaaatggttcaatcttgagaagccggtacttattgatgtggatcaattgaagaaggagaagttctctactcggcttcatcttcgtctctgccttgatggagggtaccatgttctagatgagtccactaactacagcagtgacctcagaccaacagccaagcaactctggaaaccgtccattggtttgcttgagcttggaatcctgggtgctcaagggattgttccaatgaaaacacgggatggaaaaggttcatcagacacttactgtgttgctaagtatggttcaaagtgggtacggacacgtaccatcgtgaacaacccgggccccaaattcaatgaacaatatacctgggaagtttatgatcctgcaacagtcctgactgtcggtgtttttgacaatggccagcttggagagaaaggtggtgagaagacgtccagttctaaagatgcgaaaatcggcaaggttcggattcgtctttccactcttgaaactggccgtgtctacactcactcatatcccctcctggttctacatccatcgggggtaaaaaagatgggtgaattgcacttagccatacgattttcctcaacttcattagtaaacatgatgtacctgtactctcgacctttgctaccaaagatgcactatgtacgcccaataccagtccttcaggttgacatgctgcgccatcaagctgtccagattgtgtctgcccgacttagccggatggaaccacctctgagaaaggaagttgttgagtacatgtcagatgttgattctcacttgtggagcatgagacgaagcaaagccaacttcttcaggctcatgtcagtcttctcaggcttgtttgcagttagcaagtggtttaatggtgtgtgttcatggaggaaccccattaccactgtgctggttcacatcctatttataatgttggtgtgctttccagagctcatactcccaacagtgttcttatacatgtttcttataggggtttggaactatcgttaccgaccttgctatcctccacacatgaacactaagatctctcatgcggaggctgtccacccagatgaacttgacgaagagttcgatacattcccaacaagcaggagtcctgatgttattaggatgaggtatgataggctgaggagtgttgctggaagaatacagactgtggtaggtgatatagcaactcaaggggagagggttcaagcactgcttagctggagggatcctcgggccacagcaatatttgtcctcttttgtctcatagcagcaatagtcctgtatgttacaccactccaagttcttgcagcattggcagggttctatgtcatgaggcacccgaggttcagatataggttgccttcaacgccagtgaatttcttcagacgactgccagcaaggaccgacagcatgctataaaatagctgccatctggtggccttatcattgtgataaattggatggagtactccatgccgattactgtagtctggcttcgttttgttgttattgtaactgtgtgttcttagtacttgagagcctgtatatcgtattagcttctgaatgcagggaataatgtgtttaaggcttcttgtgaactatcagattttggagttgtactggtcattttaaatatctagttgcccaatatatagtactttaaaatcttgcttgcttggtttctgttgtatgcctgcatatatgttgtcatgaaccattctctggaaagggtgactactgatcatcatacaagatattttttctgcctaatttttgttgattgatcggataggtagaaagggtgatgatattttgtggctaattagaaagctgtgctaagcgttcaatttgtacctgttgttgaacagctgaacattcagcattgattgatagctttacacactgtatgatatctccgactctccattatgattatattgtgatttccgctgtatactttgagaatgcccagaaactggtgataggaatggcttctgtgttgtagcgttgatggacacaatattttgtctacttgtatagtagcgttatatagagatacatgtgctttagaaatggcccattcaattatcatgttttacatattttgtggttggcattagcatctgtggaaaacatttggactggaaaaaaggggagaattctcaaacgaaatgtctgataaaatgcagaaataaatctcgtggtgctagttgccagttgtcacacttctttttgttccttcattgtctctttgcattcttctccaatccttcttccagtggcttgtccaggagagcacttcagtgttgctgaaagcaaatatgggagcagctgagtcatcttcaaagctcgctggctccatccatgaattcactgtgaaggtctgttgagcgcctgtccctccttccatttctctagaattatttattcttattttttatcaagcatgttgagaggttttatgggaaattttgaagaagccacgttgaagtgtctgtgaaccaatgcaatcgggctatttgaaaattgataatacaagaacaagagatggagtttttcaatgacagggtctctattcccattcatccaactttgatttcatttcgtcgtgtttaaataacggtctgtggaataattctgcaggatgcgagggggagtgatgtggaactcagcagatacaagggaaaagttgttcttattgtgaatgctgcatctcgatggtattggtctttacattttcattcgaaattgtctaatgagagtttgtactttcccacctgatctgatgatatctctgcagtggtctgacgaattacaactacactgaacttggtcagttatatgggaaatacaaggagacaggtactagttgtttacctatatgacagtacgtttgttgcaactcggctctgaagtcacgcgaatacctttatgaagtacttttggagaaatcgctgcaaatttcttgaatcttgaccagtgctcatttttcagtatcggtttttttaataacatttttagacttttatctgtgggcactgggcagctgtataataccgtactgctgttattgcttttactctgaagaaagtattcactctcttatcgtttcctctgccgtccagttaaattgcatcaaatctttcagtttccccttgacacctcaattgtaatttatgagagcataacgctgtccgttgacagtctacaatgacctcaattgctttgtatttcccctttttcttgtgcaattaggattggagatattggcgttcccatgcaatcaatttgcaggacaggagccaccgagccaggcagcaatgagcaggttgtggagtttgcttgtacccgcttcaaagcagagtatcctatccttggcaaggtccaaccaatggcaatcttttcttccagtgctagcttccaaaaccatatccaattatttgttgtttcggtctaaaatcaacgcgcccgagttgtcaaacaggttgatgtgaatggcggcaatgctgctccactgtacaagttcttgaagtcagagagaggtggcctcttcggagaacgcatcaaatggaacttcaccaaatttctggttgacaaagagggtcatgtggtgaaccgttatgcaccaaccagctccccattgagcattgaggtgatgaaacaaaacagtgttcgttttcattttattatatagcttcacaggcatgattactcatcagtcaatggttgtttctgcagaatgacatcaagaacctgctaggggcttagagctcactccatgaaagatgatgcatcgtcctgttgttgctgctactacaatctgtttgcaatttctgtgaagaggaacctacaatgatgatgctctgtatctgtgtagtgagaaagaatataaaggtagtgaaggaaatctgaatgtacaggttgggcagtagcacatgtcgctgaaagaaaagcaagattatcctgttgggattacacaactctgagcatgcatgcatgcatgaatgcaacgttgcctagtgaataataataatctataagaattaacggctcaaaaactgaacaggctattacagagaggagtacaattttgggggtaattctttgggaatcagaaaaacaaatttctggagcacatatggaagagtcgacaaattgagagatgaagctagcctctagatgagttgatatcaatgttggaacttctcgtgtcaaatatcccggagctaggccaccctcccgtcgttgttacagggggcggcggcgttagattttggttatggccggagctcggcgacgcgtcctgccctcctccggtcagcgagtccgagctgaaggccgccgccgccgcctgttgctgctgctgtttcccggccttcttcgacttgggcttcgaccctccctgcacgaaactcccaagtaccacctgcaagtgccaatgagtaccccaggttagaccaagatcaatgctagaattgaatcccatttctgatcaaaactcagaatccctttgattggaaaagaggaattttgtaggaatcatgtaatcatcccttccaaagaaggccttaatggagtgagtacatttgcaaccagacaatgctactataatcttgatgatgaagatgatctagccatctaggagaggagaaaaagaaaagatgaggttggttcagggttttaaatctcccgctatagctgtttgagaagggttatagctatttgctctcatatacaatttagctgctatagctgcttgagaagctaaccgctaaatgtcttagcccgctatttaaaacattgggttggttacctgaacggtgctggcagctaccaatgctccgccgagaacgcctccaatgatatgcctctcggggctgcacagcgtcacgctcagcccgtcgctctgcccctcgttcatcaggttgtaacaccccgacatgctcaagatctcgtacagcccctgccacaatgcacacacaaacatcaaatccactcctgtcacatgcaactctgaattaaacttaccaagattgcattgcaccaaccaattagttgttatacctcgtagatggcagggttcttgtagtgggaggaggcgtgaacccttgacatggcgccgtcggccgggtggcggaggaccacccgggagacggagccggtggccgagagcacgcacaccgccctggacgaatggttggcgaacgccacgatcttccctgcaacgtcctgacaatgatcaatgtcgcctgtcagctcagttcagttttacctcccctctcagtttgcatgcagctctgcattttctgctgatgaaaaaattgtagtaacggtgaatgagctatgagtatttttatttacctctgaaggagatgccgtgatgatgtgaggggtgaagctcgttccagctgagccactgaacgcattgccccctgcacaagcacaaacacgatcatcaaggtcatgacagttcctagtctgaaagttttttggtattatagagttgcaggacaattttgggtaggaggaatgcctatgcaattctctaagttaattaattaggaagtcacagaatactatactgtttttcttttctgaaaaagataacaacacatgatatatttttttatcttttctaagtaaagtacacatggatgacagaattcaatatttgagtaaacaaaacaaacaaaaaggaaatctaccactaaagattaaataaatatcaacgtggcagagcagtgcagagcaaagcagaggctttccctctctctacatatataaagactgtcacttgattcacttacctgaaagcttaaccggtgatgagagctgctgcttcttccctgtccccggcggccgcccgcgccgcttcttctgcgccgagtcgtccatccctgagccgccgccaaccatgtcggcgccggacacggaccccatcctcggcggcgcgctcagcatctgctgctggtgctgcgcggcggcggcggtggacaccttcatggtcccgtccgggccgtacttgcgcgggcggcctcgcttcctcttgaccggctccatgggcgtcgcggacggcggcacggtgggtgagccggcgccggcggaggcggagacggaggccatgctgttgtgcatcaatggcggcggcggcggcgcggcgtccatctggaactgcatgccggcgagcgggcccgggccgatggactggaggatcgcggtggggctcatccccatgttgggcatgggtcggatgaccgacgggccgccgtgcatcccggcgagcggcgacgcgctatgcccgccgccgcctcctccgcccccgagcatccggtgttgctgctgatgctgctgatgctgatgctgatgctgctggtgcgcatagtatgacagttcggacggtgagaggagttctttgccatccatgcatggatcaccgagctccccccaacagaaacagatcaatcaaactgcttcttcctttctttctcctgttcttgaacaatcagcacgacgagacgaggacgaacagcaaggtgttgaagatgaagagtgagttggttgggggagaaggaaaaggaggggaggaggagatgagatactagatcagatgaaatgatggggggagagagagagagagagagataagatgacgcggttggcctacatgctatcgcagcagccgcaacgcagacgatgcaactaggccaagcgcgcgcaggcgcaggcaaacccaagccaagaaggcacaagaggacggcgagcgtgagagagagatgggcagcggacggagggacggatggcgcccacacaaggaggcgataagatttggttccgtttccttggcccaacgacgtcgaaagggaaaaaaggcggagccgagcgcgagcggcgcggcgcgggggtggatttgcttgtgatttgccttcctttgcaatttgctggctgcggcttccgtttcgttcggcgcgcgccactccattttgcgtccacgcgcgcggatgggctgggtgggcggtggcctgtcgctacccgcccactcgatccccgcccccacgctacagtccgatcgggacctcccctcgggtcccacctgtcagctctccacaagatgttttcagatatttatggcgctcgccctgtcgcccacgaccttttcttggttttcaaggttgatgcttcccaaagcttcacctcacctcacctcacctgaccaccaacggcggatatctcatgaacctttgtgttgggcggttcatagttcacgtaagacttggttgaattgttatatcgagatagtatgtctaagcaggagcggagctagaacgaaatgaagagagctgccactcacttattttactctactttagactgatataagtgcctaaatttggattgagggaggtgcatatatggtgaaaatagatgaactatagcttaaaaaaatttcttaaccgggttcctgggcaccccctatcctacctagctccgctcctgtgtctaagtgaaaaatatgcatataggtttctcacacacaccaactagcaaatgtcataaaaaattagaaaaaaataaacagttatttctaatagtactacacatatatgcgaaaattcatattaagattcattacattttagccgtgacaaaaaaaatctgataattttaagagtaaccatctctaaagatttttttttacaattaaaatataatgaatttgaagatgcatgtttcaccacaagaaatctaaccaattgacatatcaggctttcacatactaccttcatatttcatattttaatgtatgacaccgttgattttttatccaacgtttaaccattcgtcttattccaaacatttatgtaattattatttattttattgtgacttgattcgtcatcaaatgttctttaagcatgacataaatattttaatatttgcacaaaaaatttgaataaaacgaatggtcaaacgttggtcaaaaagtcaacggcgtcatacattaaaatatagggggagtacaacggaggtcggagtcttcgaaagtttcacatatggtatttgcaaaataaaaagtgtgtccatgtaattatagcctacttattgtatgtaatatttgatattcacggatctacttcaaaataaaacacgatatgacattaattaaaattcaaaataaaaataaattaaatccctaaattagaaaaataaaaataagagttcaactaaaagtacaatttttatataactaaaaattcgaaataaaaataaatattattgagagaagaaaccatatagaatacatcacgagattaattaaaaatcaaaaataaaaaataaaaaatataagagtttaagtaggaatataatttgtaaataacaaaatatcggaatgaaaaatatggaattttcattaaaaaaaacaatccatttagaacacaaacgatgacaaattacaatagagaaaggagaagcaataaccaatagagaagggagaagcaataaccccgtaaagaaatggggtggtagcggtggactataaaaaaaacccaaatagaattccaatgatggttgagaggggagacgacgggcagaccattgaacagcacggtcatggctgttggtgggacatttagaaagtaaataaaatcacacaatgataatcatgtttgctttttaaactctcagtaacaacaaagaggggtagcaacgggcgagctgtagaggagtagtggcgaagtcgctgacggtttggcaaaacttctacaaagtaaaaaaataattaaactcaatgataattatgttcaattttttaaatcccaatgacaataaaagatgaagcagtggaccgattatagagtagtatagtaatggcgtttgacgggatttctaaaatcataggaacgaaacctaacgagataatgaactctaaaaactactagatttaattttaaaatttttcaaggaggatgtatagaagccgtggtagatcaagcaagcaaataaaagggtgagaaagaagtttggggtagcgactaatgcaacttagaagtttggggtagctactaatgcaactttttaaaaactgtaaaattagaaacacatgaagtgataaagttcggttttcaaagttatatgacaacgagatagtgatttaacaaattttaagtaaaattatatataaaaagagataattttgtacgtgtgttggtcccgcagctgcgcgggtcacccaaaaagttttgattaaatggtactccctccgtttcaggttaaggttataagacgttttgactttggtcaaagtcaaactgttttaagtttgactaagtttttagaaaaaaatgttaacattttcaacccaagacaaatttattataaaaatatattcaattattgatttgataaaactaatttagtattataaatattactatatttgcctataaacttagttgaaaaaaaacagttttactttgaccaaagtcaaaacgtgttttagcctgaaacgaagggagtagaagttattaatatgaatagtagtggtatttttttaattccaaaaaattatagtggtatggatctaattaaccatatattttacgacggatcgatggagtataagaggaccatgggatatctaacgaattgaccgatgggaagctagctgcttgggtcgtcgggcgatcgtagctagtgtcgatggctcacaggtcacaaacaagcgagaaatgttgctacctcccgccagcgataataatattccaaattgcaaagcaacgtctctttctaccgcggagagtagtagtaggagtggtactggcgtttgcagcgagtgtgcaaccaaccagcgatcgactcgagtgtgcgcgcagcggccacttgggggcaatcacgtcgacgcgggcggcggtcgatgtctagcgaggcgtccgtcgagagcacgacacgtccaagttgcgtccccgcttgcgccgggcccacccgtcggggggtgagccactctcactctgtatcatgctgctgcatcttatgcacatccatcgatcctttctgtgaataatggctgctgtccaatccaatgatcaacttgtcaaccgatccaccgatggaatggaatggatccagccgtaggtgaggagcagtgttagagcaggtacagtaagagcatgaagatagaagagcagcgggctacagatttatagccagctacagcacatatgagaccaaaaaataggtaactattatatgaattggctactaaattaactttaaatgatttagagccaatagttggctataatattaaacttgctctattagactataagggtgcgttcgttcctgggggattgggtgagaaagcccatcgtattccgcgcgcacgcttcccaaactactaaacggtgcatttttttaaaaaaatttctataggaaagttgctttaaaaaaccatattaatccatttttaaaatttaaaatagttaatactcaattaatcatgcgctaatggcttacctcgttttacgtatcttcccaatcttctcaatccccttctcctcaaactcaccctaagtcggctacaagcttatgtggagaagataagagaggaaagagaagataaacggactacagatttataactagctgcgatacaaactcccaaacatgttgtatgtataacatgtgggaccaattattaatgatatagtatatatttatagttaattattgtatgaattaactattagattgacaataaatgatttgaagctagcagtactctctacaattaaacttgctcttatagtctcatgggccacacatcagtcacagatatgtgccctgcatgccaaggaaagccaattgaagaatcgagcgatagtcacgccgccattactcctagatttcaggacgtctctggctccgttgcggtgaggtactgaagccaggcatgcagccttctcctgctactccctccgttttaaaatatttgacaccgttaaaattttagtacgtgtttaaccattcgtcttattcaaaaaatttaagtaattatttattcttttcatatcatttgattcactgctaaatatacttttacgtacacatatagttttacatattttataaatgttttaataagacgaacggtcaaacatgtgttaaaaagtcaacagtgtcaagggtggcagtatccgttactactacagttgtgttatctccatccatcgcgtcgcgtgtgtgtgttgactgttgcgcgcgggagtattgttgtggataagcgagcgagggagcgagcggcggattggatgcaggataagatcggccgtcccgggcgcgggcgcgggcgcgggcggcgataccaaccaactccaacagtgactgctcctcctcttcctcttgctgcgctgcgctttgccttgcgttggcttggcttggcttcgtccacgaccacgcgcaggcgcagcacatggccccgatgagcgtcaggattggattgggtcgtggatgggaagtgcgagttggttcacggaaccagcggcgccaccgaaagctacgtccccccagcgcggacttccattcgcattgcaccaacaacttcgctagtattaaccaaaccgaaagcaacgagatttccttcatgggccgccaaagtcgaggctttatgtaggcccatcaagccctgccgctaactaaggtcgaacagcccagatctctcatgggccttgtaattcgccatgccatcaggccctgcatacaaggcgtgcctgggcttcactgcctcatgggcttcaaaattccgccaggaaatactgcatcccaggggccagcggctgagaaatcttttgagattttcctctctgaaagaaaattttactagtaactttgacaggattacataaaagacatcagtattctgctacagtagatgcgtgtgtgcagaatcctcaattgcctctttgctactacattgaattaccagatcaacacataaatatatatatacaagttgttctgcactcggccttatggacgaaagaaaatggacactgatcagccagaatagatcagaaaccttagctagccaggtattcaggggctgtttggttgctgccctcgcctggagaccattgctcaggcaggtcgatccgaccgcaggcgaccgaaatcggacgcctgagatcgacgcatgagccgggcgcgaatctgagggcagcaagcaaacacgccctcagatttcagagtggttcagcgattcagccgtgcgaaccatattcctttgattgattccatcgtcataaactgaacttgtcgggactcgggactctatatgttttaccctgtctgtcaaaagaccttcttgcactgccaaatatgcactttcagcagacatcactgtgttcaataatgcatcatggcatatcatcaactatatattttatataggagtacgtttataagcattgacagagctagcttatttgggttccggaaatattgtgcaatgatcgtttgtgttccttttctcttgataagagaaaatatagtagtacattagtttagttgcatgcgatggagagataaaattaagatagctacggagtatgtatcagtttcttctaatatattgacgtgctatttttttacgcgttcgcaaaaaatatgtatcttgtctctttctcgatgacgatcgaatccaaattggtactcattcacgcgcaaaatgagttgcaatcgagatgcgtactactccaactctcaagcaacaagcggaacaattaatgcacacaaaaagcaagatcagaaaaagggaagatcattgcaaaattccaactagcttaggcaccgatcgatgtctaatgtcttgtaccgtgcaaagtttaatgtaaaacccaattctccacgtttcttctccactactatacttttgttaccatttatatatcaccaatcaatccacttgatgatcaggtcagatgcataacaaattaaattatgtctgaacagtcctgcaagcagtactggtgcatatgcatcatgttttctgtactctatcttagcatattcagagttagatcgatagggctttaaacatatacatactggaaaaaaacaacatatatagtcaaataaagacaagatgcaattgcatgttgttatcgactaattaatggcttcttatagtctaacagctagtagcttacatctacaattcaggactagtgaaaccagtagtaatttgcttacacaaattagatgccattaattcgttctcaaagtaaaagaaagtaacactagaatactcaatactactcctactgttgttcatttcttgtatacggggatgatcaatatactgatgtggagcatgcatacatatgcagtaattgtatacgatacacacctgtgtgctagcgttgggcttcgatttaactcctgaatctggagcagcttgcggattgatcaaggcggcgatggaagaagcaagccggcaggcaagcgcgtccagcaggcaaaggatcgatcgatcaaggaagatgaggaggcggaagcaagaggaaaattccaaagggattgcactgatcgatcacgcacgtcgtcgtcgatcgatgaggcgatcgatcgagatagctagccagatcaatgcgatccctttggagtcctccactagtttcctcaggccgatatatatgtcggccggttgaattggcaactacgcgtagctaagctatcaggttgcacgcatgcattgtggtagctaagctatctaattaactctcctatctctagaattcaaagtgcatgcagaatgtttgttgcagccagctgctagctagctaggtaaacactaagctaagtgtatagtggtattatagttaggtgctagcctggggtttataaggaggtagctgagcctgctcgagtgcaatggcatggagatcgagattgatatagagagagataggctagctggagagagagagagagagagaggaaatggaaacaagcaacgctagctggaagagggaggcgaaagctacagggcaatgagatggagaagcggagaagcttagcttagcttcacagtttgggcgtgtgaagtgaaggcgaaggcgatcgagagagagagagaggttgatgggccggggaacacaagggcccaccacggagatgctagtgtacccaatgtctggcgtactacttctgcccactccaatgctgacctctctctctctctctctcctgctgctgctgcccatctttttatttacgactctacccctggcaatgcccgttaagtttcactttagtttcgttttatccctagttattatacaacgagaagaaattactgactgatccatatccatgtaaaaacagtcgatcacgagtgtcatgcatccagtcttcgtccatagtgaaatggctattcattgatctatattgcacatgtgttctttgtgcacagctaactgtagtaaaaaatatatatgtgtgtgtgcatgagtgagaagtactctcactgtttacatttattaatttgtagaatatatagatgtatacaatagtaattagcacgaaggatgttcagcagtttaaccccgacagaagccaatgaattgttttcaaccgctagatcgagtagctaggatatgaagtatatatccaacgtcgtaaccgcctagtttgatatgatctgatcgagtatatagcttgcgttgttcttaaaaaaaaagaatatatagcttgcgtttatccctaaggttttgaattatatctgtttcttaatgctgcgttctttccagaagttggagagagtttttcagtgcacgcgaaatgggaaatatcattaagatattattaattaagtattaataattatataaacttgaaaatgatttttttattttttaaacaacctctatataatttttttataacaaatacatcatttaacagtttgaaaagcaagaaatttaaggtttggaattgaagaaaacaaataagcattagtactagtactacacattatacttgaatgaatatgtataggtagctagcagctttaaatatttgggcgttccatagcatagcaaacactccatgttgcagttggaagccaaatagctacagctaggtagataagttaacagtacacgcgcgcgtgcgggggttacagggacggccgtagttcagttaatccaatccacagccacccggcgcgattcgtgtataaagtggcggggaattaaaacatatgagatcaattactagtggtttatattggagtacgttatttctttatttttttatttatatctaaaaattaaggtttataggatgttttttaaaaaactgtgggatcagtcaaccccacgaaaaagacctaaatccgtaacttgatgcattgttgttgcaagcagcatttggccatttcacacactgacacacacgcacacatgctagatgcacgactgcaccgcatgcacgctcaaatgcttgatcgatcgatcgatcgatcaactcgattgctggctacctacctacctaccgacttggcaggctgccgtgtagggccatatgatatgtacgtcgatctgaattcctgaacctgagacgatcgagacccacacgggggaacatcaaattgagctacagatgcaacgtatgatctactcccttaaaaaaaaaaggaaaattggaaccataccattataatgtccagatttatagttagaactagtttttttttttgaaacggaaagaggagtatgtatttatgcacagggcatttgactgatagacagagaagaaagatctggcaacaacagcaaaagaaaaaaaaccatccaagaaaagaagaaagattaattcagatgcatggtttgggtcggcccctcttgattgcactgccacattaggcatgcatatgcatgatatggggtcgatcaatgggttgcacatgcatgcaacttgctaaatagattaattattaacggttgggcatacatactacctccgtttttaatagacgacgccgttaactttttctcacatgtttgatcattcgtcttattcaaaaaatttacgtaattataatttattttgttatgagttattttatcactcatagtactttaagtatgatttatatcatatacatttgcataaaatttttaaataagacgaatagtcaaacatataagaaaaagtcaacagcgtcatctatggaaaaacggagggagtatctagtaggaccatccatcgatcgatcgattcattcatgtatccatgcaacaacaacgatatgcacgcacgaacgcatgaccctgcaggacagacaagctctaaacccacaattaatcataccctgacccagatagctaagcaagcttctgcctgactaattgcaccatcaatccatcatcaacacatacattcgttcaaaagaaaaatcaatcatcaacacgatcgagctagcattagcaatacctgcatgccctctatcaatacagtttgataaaaatcaacttcagctagacagtagttctaagtacagaatatttactcccttccatccaaagtttaacaataaacacttttagaatgccgattccaatacatggaaagtcaagcattttcagtcaatcaagtacttcaatgggacataaaagcaattcaaaaatcgaaatttaacaatgagagaaatcttacatattatccttaatctttactaaggacctataattacttacatttagatcacggttcatttttgcttaaaattttttaaaagagccaatttgtcaaaaaaaaaaaatttaccgtggaaaatagtaattgttgcacttactctatgagttactccctccgtcccaaaatatagctatttctagcacagtgtcttgtcctaaaatgaagctatttcttcacctacctcctctcaaccaatcacaaccattcttcttcacctaatttctcttttcaaccaatcacacacttcctccaatcattctcacctactttcttaatacccgtgccaacctcaaaaatggtttcatttggggacggaggaagtagtaaaaaaaaagaagaaacgagcaaggacaaacgggggcatttcggtcattacagtagggtggtccaaatacgaaagcaagcaaggtccaaaagggaggagcacaagtatgcaaaggcgaagagagagtcgctggattccgccgggccgtgctacagaaaacaacgacgtgtgctcaaccgttttgttcacgacctccggcctcccttcctccgcttgccagtgcctgcctgtccgtgtctggagccaccaaaactggacccagcacacacagtcataccactgcgaccacagcaaatatcggcacttcgatctgttcatatatttatttttgaataatttctcactagtatatatttggattattcctgcaatatatacagaaaaatctaaaatatcattgtactagtctaatttcaagaaatgttattaacaagtacgagttccacgaaatatcatcgtacaatcaactttgtcctacaaaatgtcattgttagggttccatctatcccgctcacttaaccaaaaactgctaacggaaccctaacgacaataacatttctagagtaaagtcatttgtatgatgacattctatgaaactcgcacttatcaaggatctctcttaaaattgggtgtttttttttgtattttctctctatatatactcgactcgagagcatatttctatgtcagccactgtacattggacggacggacacagttgccgtatggaggtttcgatcgtgctggaggcagcatcatcctttggaacagtgagcagcgcattaattctggatagagagttatcagagaggcttttctttttatccgttatatatactaaaaaagaggtttttcttttgcaagcaaagcaaagcaactagttggtgctagccttgccaaacgccatttcgatcgttaaactactgctactacttgcaactagaccaacgattcgacgacttttcgagatagaatatatccaagttaaaatggccgttggtttttctgggtaaattattttgaattctcagtgaccgccaaagcagaaaagggtgagaaggcttctggagtacatgcatatgtggtccacgcgtgcaaccagccggccgtgtcggcttctgcagtgcaagttgccaaacctaccaaattcactcaggatccggacactttttttctcccccatttgcactccattattttctctagttaattaccatgtgtttcttcctataatcatcacactagtatacctgttcagctacccagtccacacggtttttcatttgttatttaagtatcttaggatttcctatggtcatcaactcatgatgcattccaaattataaaatgtttgagaaagagagaggaagatgccacgtacggctgacggaatcagatcgtaggcgtagctggaatgctggctaggataggtaggcacgtacgggtatacactgtacaccagtacactggcagatggtgtccctgcgtatttgtttccgtatgctgtgtgtgcccaagggggggcccacgtggcaaaccttcgcaaagacaagcgtcatgtgaagtgtctgagcagcggagaggtaggcccaccgcgcccggcccactttggcccacaaaacagaaccgggcccacgcgctgtgagcttacgtcctcctgccctcctattgtggctcacgtgggcctccacgtcggacccatatgttctttcaaacttcttccccgccatcattccttctcctctcctctacctttcccactatttttaccaatttttaccattcctatgcagtgtattaaaatgaaactgataaacaaaaccaacagacaaagcagtaatattgatctagctacccatccattcttgagatattattctaccaagaacaaaagcattcctgcatattagtaaaatttgtcctggaaaatcctatgtggtttgaacatgaagcaacataatgtagacagctcatgtgatttggacagatcacttacccgcagaagacaggatttagtccggtctaaaatttctagaatcccacaatgagaaattcccatcccgccttttcgttttctcaactttcaatccaagacggtatctcctttgaattcctgcgttgcctacaaaagatgaggcaagcttttagatatctgcccttttcctatgttctggactgagtaaaaagaaagaggcaaaacagtgacatgattccaccttttgaaatgacttactcacagatggaaatgctccacttctagcccaattacattatcagggaaaatgcaaagttcttgcaagtcactaccactttgtgcagccactttgagggcactagttgcgaagaagatctccaaggatgcacgcagtaacaccagttagtcaaggtagatagagttgtttcctgtacatgaaaaagcaactttcaacagttccttcaaagggatggcaaaggtgagaaagattgaaggaacagcggaggaagatatttattttacagcatcaggtaggttggtgttggtattcgaatttttagccagatcatgcaaacaaaactataacaagtagtaaccaaatttgcctgacaaaactttctctgtttgaatcttctacacttcactttgtgttcaaattcttttagcaggccatatgctccttatttcttgattggaaacaacaattatctgcttgaacactgtggacagacaccgattcagaaacagtgcgtgcgagagtaacatttctttttttgagagaacaacatttcactgtggggaaaagctggccggctatttgcaccctacaattacttcaaaacaagtgttggggaaatattttgagagttccgtgtgaggactttgttgacgcagggccactgttcgacagtgtcacgttgctttcccagcttcaggaatgtacgaagaaacacagacagccatgcgtggtgggatttggacatggaaaaggacgttgaggacgattgattgtcgggcatttgatgaaaggaaacagaccaaaccaggttactgtgttttagttatggaaccagcgacgccttcctctaggatggaaatttttgactagttggtgccaagctaagtgctaagtacagggctagccggtggctactggacatccacaaaagcaattatattatgaaactacacccaagtgactttatgaacacaaaaggcaaagatgcagaacaaaaagctgatatccacatggtttagtggcatatatcagcactagtcagcattctgtcatgtgcactgaaacataagctaagcagcagcgcatccaatgtggagcattattagtacccaaaccccagggtgtataaatctatggtagcagcactgagagttaccttttcaggagcattctccccgtagaaaccatcaaggctggcacataactgagtgttctgaattctggtgctgaagaacaacaagaaaaagggcgattccagtccagatcatcaagctcccccaatgctgggcaatttatactctggagaaagtttctgctcgccacttgaaagtgccgatgattagatttatcggagccgcggtgccgaagcagcacgagtgtggagctgggatgattaccagctaactgatgcccacagcacagtgctggcatagtggacggcatggagtccagcacaccaaccagaaagatatagtcatgtcaggaagaaagaaagagatcgattggtcctaaagcagtgagatgctcgaatccaaaccagcaggcgctgtagaagcacagttgcatgcttggagaagttgaaagagatggttaatcaagcctgtgagctgtgaccatggcggacagtggcgatgcaattataggatgtagttcaccgcagcaacgggcaggcagggttgacagggtgcatagtgcaaccggagacagggtaactgagcggcatcactgcaggccggcattccgtcgaacacttggcgcgcacgcgccaagcgtgccacgacaagcaacatcacggagacatcagacatcccatggcgcggtggccggtagaggcctgagacgcaacagaaacacaagcatgtttgccccgccagctcacggcgaaatccgcggcgcccacgcagcatcgaagaggaagaggaagagcaacgccgcggattcgcacttccgcagagcgcgaggcggaggaggagagatcgaagtgggctgggcatttcctttcagttgctgacttagcataaatgagcttgaatcgcgcagagcccgtctagtagtgggctttatattcttcgtgagataaacgtttaaggtgggctttctaacggacagttgactgagcccgtgggcctatattgacaagtgggccaatacgcgttatgagtcaatcaggtcaacggattgctgttgttgcggttgaaccccacataatgggggaaggtaagttaacacgtcatcattgactaattgagtggtattttatgtgattattatgtcaatcagggtcggcagggatgatacggaagtccggccccacgtttttgcttgatttcccctgtctagatagacatctatgctaatttagctgtcgttctgaacttctgataaggtgtaaacaatgccggttggcaacttcgtcaagctcgatctcctcttccgattttgagaagaaaaataataaaaagcatcaagcaagtgtccttactgctactgctataactttaaggtcccattatttggctttttccctaataagccaaaacggcttattagagaaaaaaagtaaatttataggtaaaacttttatatatgtattcttggtgacttaaaagctaatgctgaaaaagaaactacgtcgaaaatatctcaaaaccaatcttaaaattaagtttaaaagtttaaaatttggttttttctttggcttattaggccatccgatgggagccttatacagcagcagtagtagtagtactaggtatgagaataatgaaaaaacgttgaactctgatttggtttgggagcattcgtgcaaccgccagcctaggagtactatacctcctcagaaaaatagctgttccttttggagatattgaactatatgccacttttagatgtggcaattaactatttgttactgtacccccatgtcatagacacatgtggacccacatgttattgagataggagtggcaaatagttaattgccaaatctaaaagtggcaaatagttaaaagccccgttttttttggtatacatggctagcttcatatagcttaataaaatccaatatgatcgactgatccgctgcatagcgatatactccctccgtttcaaaatgtttgacaccgttgactttttagtacatgtctgaccgttcgtcttgtgaaatatgtaaaactagatgtgtacatgaaaatacatttaacaaggaatcaaatgatatgaaaagaataaataattacttaaaatttttgaataagacgaatggtcaaacacgtcctaaaaagtcaacggtgtcaaacatttttgaaacggagggagtagcatgatgatagcaagcacaacagtagctgcacgacgaatcagccgctaacttatggtcctgctcttttctccaacaagaaatgaatgaatattaagattttcgtggtacgcttttcaaactgctaaacggtatgtttcgtacgaaaactttttatatgaagtttgctctaaaatatcatattaatatattttttaagtttataataattaaatctcaatcaatcaacgtaaaaaacttaattttcatcttcatttctgcaagaaaagaacaccacctgaaaatattactcctgtagtgatgcagcgcatcgcgggagcggacacgcaggttacagatcaaatcgacctgttcgcttttggctcagtggggcccgattaacagccgcttggcttgcccgccagttcagctctgcagcaccgaacggaattaacggcctggccgactccgatcggcttgcaacgaattatttgtttgtttgataaggtaaatcaaatattatttttttaaaaaataataaaataaattttggttcaaacaatgcaatagaatttagaatttcgttgagaaaacacatttttaaagatgtggagcacatgatcaaccgtctaaacactcgtcagcgacaaatactactacttacgttacgtgtaaacagcgaacttgattgggcttccctccgtttggttggtctggttttgccgaacaatcagtctcatgacctcaccaaagttgctgcgccattcacccccaaaaagaaaattaaaaataaaaaaaggtaagttgccgcgccattttctcttgtcgtaggttggcttttgacggatcgatcgatccatgccaatctcaacattcttttcgtttcttttatccacaggcgggatagctactgctctgctctcttccttgcagcatcgctttcgctttttggcagcttgatttatttgttttatggacattaattccggtttgtcatcgtcgagttaattaatactggtaagcagcaattttattgcaaagatgcacggccatgtacaggacgacttgatgctgcctgtctgaacgtacttacgtacatgtcgtagcgtgtacacatacagtacaagctaatatcggtcggttcacacaacgattttgacttttgtgatcgattgccaagtcagaagcatactgtattcgctactagtaacagtgatgtttatctagtttactatcatttgaactgtggtcaaaccaaacctgcagaaaacgcaagttggatagaataaaattacctgctggtttgttgtagtagcgcacaggcacacagatgccgcatatggagtatattttttatacgaagatttggtccccgcatatcgctcactcgcacgtactgaggctggcagaaagagaaagcgtccgagtctcttttcatcatttcgtctgccaacgcaaacgtgcgtgtgcacgagtcgagaacaaattaactagacttttctcatcatcatcatcatcagatgcaacctgctcctcctacctatagcttccaagttccattccagctcgtatatcagctagctgggagtatgatttatcaggagaaaaaccagtacaagcaaaacaaaaaatataaacatttagtacggcttttatactttttttttgatagatgcggtggccgtgtgtgtgtccagcccggcgacggcacgcagcggccggcgtgcggttactggagcagcacacgaactaccacgaatagtcgcgcttcccggtgttggaaacgcacccaatttggccaacttgcccgtggcgttttactgccaaacagcagagtaggtaattaccgcgcgcgggattaaattcagagctcgtaatcacgacgcaaccaaccccgttgtcccagttacccagtacagcgcaggcatgtcggtataaataaataaataaataaacaaatgatagtaatagttaaataactaattgattaattaataatactccagctgcagcaacggcaacgataatattcccggcgaaataaaccccattcattagcaacggggttgtagcggtattagcgaataatagttgctgcagcggcggccacccagccagccagcctcaaccccaagccctccaaccccaagagaggccgcgccgcgagagagagagagagatccaatccaatccggcccccgtctccccccctcctccacgccgcggcgccgctccggttgcttgctcaggttggagtggtcgcgccgccgccgccgccgccgcgccgcgcctctcgattcggccgcgcgagcagatccgagcacccaacggcggccgctgcgcgcgggggggttcgaattctgcgccgctgccgttgcttcgcgtctcctttctcagggtgtgctgctctgttcgcttcctgcaggggggcgggctgctgatcgaaatgggcgggcgcgtgtccaaggcggtggcctgctgctgctgccgctcgcagcaccatggagtcgtcgtcgagagctcggagaagacgggtgcgtgatatgcttctctgcgccttccagaatgctctatctatccatccatctatctatctttccccctttttctgctgctatttttggagctcgctttcccttttccagaagctgtgggcgctcgcgatcttactttttatttgtcccccgagtttgctctattttcgcctagatatggccattaattcgttaaattgggtcgacatctccgcatttggaacgttgttaaactgactccggtagccattaatctgttccacctatccatttggtggtgatatctgcgttattatggtcaaactatttctgatttatgtgcgcctgtttacatattatatagcgtttctgctagtgatttgggggtgctgattagttttgttagttctgcatcttcgagtgatttttggctgcaagcttgtggtaatggagtaatttgagcggaatacatgtttatctgtagcggaggaggaccatggggagtcgtatgagctgccggcctttcaggaattctccttcgagcagctgaggctggccacctcaggctttgcggtggagaacatcgtgtctgagcatggtgagaaggcgcccaatgtggtgtacaaggggaagctcgacgcgcagcgtcgcatcgctgtgaagaggttcaaccgttctgcatggcctgacccgcggcagttcttggtatcctattgtcttcaccttaatccttttgcattgctaacgatgtgcgtttgcttggtgccaatggtagttgggtacgtggtggttattgtgggaatggtagattctgttctatttataagtgcatgaattggtttctaggtttgggttgtctcttatcatggaggttgttgatgtgtacctgttcctgagatgatatgcatgcttgttctttacttatttggcttttgggtggaatatgatggcttgcagttcaaattgtggcatctgccaactgtttgcacaacatatcttttttggtatgattattagattccaatactaaacaagtatcagacagcaatcattacagctagtagcaccatcattttgtggattacatgtttgattgctacatcactccattaattgctatgtgtgagttagtgtctcagtaattataaacttactattacctgttgttaacattatgtatttttgactgcattagttctagctcttcccgtggacaatgctttatatgccttgttattttgctaactgtcacatgttaattcaccaccatgccatttgtttctgattgctattgtacatactattaaaatggcaagtatagaggttttcttccacaactttaagcagcccattttccatattgatggcattttgttgtgtgagtggatggtggaatctacttcctatttgttgacgcaactttttgtttgattacccatatatttttgtggtaaattctctaagatcatctaataatccttttggtggaaacaactatgcttcaggaagaagctaaatcagttggacaacttcggagcaaaaggttagcaaatttgcttggctgttgctgcgaaggtgacgagagattgcttgttgcagaatacatgcccaatgacacactagcgaagcatcttttccattgtgagttgccatgcatttcttgtcgcatgccttagaacttttatgttgctgtcatcacatcaattagtaactgggttctgttcatggttacatttccgcatcatatataaataggatatctagagtagcaactgagagtaaattggacatgctgctttaatttcttttcataacactgttcaccatgacaattagtacttgccacgtgagagaagactatatgttcacttcaaagactcgtgtactctgtattggagctttctttttggcctctaagttcaccaatgcatctgaacttttggggagattccttgacatactttttccaacaatcgaaactgcatttcctgccatacatcttttataatgtcttgcattattaatgatgcaataccagcaatcttgaaattgatgtaatatttcaaacttattattgtatgatttcccaggggaggcgcaagcaatgaaatggcccatgagattaagagttgttctctatctggctgaggctttagaatattgcaccagcaaggggcgtgctctgtaccatgatcttaatgcctacagagttctctttgatgatgtgagtatcatatagattgtttttgtaacgtgatcatctgtgtgttttgtaacatttctatgttgtttacatggcacaggactgtaaccctaggctttcatgttttggcctcatgaagaacagtcgagatggtaaaagctacagtaccaatctggcgtttactcctccagagtacatgagaactggttggtaccttcttacttttcaaacatcgtaaagcttaattagtctttctttgtgagtgttataatctgcacatgatctttctggtcgtctaataacgttgttgcataccctggtttgaatcttattatcctttaacctttaaagttagtagggtcaacttttctctggagcattccaatactacgtggtttgaaattatgttaaatttttgcagcattttcataacttcctacattggattcttacagtttgaaccgtaatgattttcgtagtgcttctatccctttaaatgacgtttggtttgattttagcagaattgtacatctagaacccccccccccccctcattgtgcttggtggtgaattcatatttggtcaattgtgtctaagttcaagtgttcaactgctgtaaaatatgaagtcttgttacttttacattacaatttgtctcactcactcttttggtttacctgcaggacgtatcacacctgagagtgtcatttacagctttggtaccttgcttttggatgttcttagtgggaagcatattcctcctagccatgtatgcctttgagctttatttcatctagcaccattttacacttcctgcttttgcatcctgtcatgactgaatattttttttttctatatgcatccttgaaagaagtttagcaatttaaaaatataaatatgtacatacaataataaaagcataaatatgaatcctaaatatttcatatatacattatgtcattcacaatgtgtcaatactacttatttgtttagacttttgaaggatgaaaaataatattctcaaggaatctaagtaaaagataaccttttctttggaccactataaggacctttatcgcactatcaaggtcattaaggctgctacttagaacaatggatacagcaataaataagacttggcttcgcatatcttcatcttcaacagactaactaatatgagtgcaaatatgacaggcccttgacctgattcgagatcggaattttaacatgctgacagactcctgtttagagggtcaattttcaaatgaggaagggacagaactagtgcgattagcttcaagatgcctgcactatgaacctcgtgaacgacctaatgtaagatctctggtgcaagcattggctcctcttcagaaggatcttgaggtgaatatctttccacttccctttctcactatggcactgttgagttcaggtctcctaaaattatgttgagaaaattacgccatgaatttcaatttgttctatttcaacctatatatccaaattagttatttctatatctaaactcttcatatatttagtccctccctaagctttccacgactgacgccatttatgcttgtgtacattttttattctcagcttgaaagttaatctatcaaaatattataacagggtgattttggcatcctcattggacttgaagttctataatattgtaattgcagtaatgttgaaatattttgcagactccatcttatgaactgatggatataccccgtggtggtgcaacatctgttcagtcattgcttctttctcctcttgctgaagcttgttccagaaaggatctgacagcaatacatgaaatcctagaaaagacgggctacaaggatgatgagggaacagcaaatgaggttttagttttttttcccctcttctttactttctttagggtttgacatcattgccagtatgatttgtgtggtcttttcgtgagaatctttgtttgtatgtcaatcttgatggagcattctcagaatttacaagcaagcgaatcttttctataaaatcatttgtactgttagtcctcatgggctcattgcatcttttatgtcctacctcaagaaatattgttatcgatggcatgctgattgcattttgcttttttagatgtctgttggaatacattttagtgtaagaattctcttcatgttcatttcactttgatcctagagcaactatagttgacatgattttatgctgatctgcttgtcatctccttagttccagtgtgttaaagcaaaatagtcagttggaaagtcaccaaatattctgagtgtgacatttacatagttgcagcatgtgacgatgtgaaaccagttgtcagtcggatattgtgagtagttatatacgtagttgaaactttgtcatgctgaatgatttagcaaccatcctcgttatattgttatgctgttgcatgatccattgttttccttgtttgctgcagctctcatttcagatgtggaccaatcaaatgcaagatacattgaactcaaagaagaagggtgacaatgcttttcgacaaaaggacttctcttctgcaattgactgttattctcaggttgattttgcatctgtgtttatattctatatgggtttgtgagaagtgtcaggagagttgcatgatcaaatgtaattagtattcaacatagtatgaacagttccatttaatctttttttttttaaaaaaaaagtgtatgtgaaaacaacaatttctggaccgtgtgactatctgtaaacaccatcagtccattgaaaaggaaaaacttttaatcctcacagctatttttgactttgctcccatttgttgtatgcagttcattgaagttggtacgatggtttctccgaccatttatgcgcggcgttgcctgtcatatctgatgaatgacaaggcagaacaagctctcagtgatgcgatgcaagcgctagtaatatctccaacatggccaactgcattttatcttcaggctgctgctctgctttctttaggcatggagaatgaagctcaagaagcaatcaaggatggttgtgcccatgagacaagtagcagcagtggacattgaatatgactgaacaaatttgtagttcagaaaatgcacataacttcaggtatatgcttctaacaagtcctactactgaagtaactcagtagcccaagtaatcagtataagttcagtgtttggataaatgtgatgaatttgactttagctactaggttaatcataaggttgtaaacatctttgtgcaatgcagtttctgttgccatattgtggctcataacactaacaccaaatctgctaccatatttggtcacaaatggcatttactggtgtagccattaaatccatcagtgccatcactcggaaaaaacttatatgcaacctgaaatactgttatttgaacttacttagaacaggcttaagatgttctatgaacaattgatatttggaaggaaaacattaatataagtgaggtattgtttgccatctcttttaattcaccgtcattctgcttgtggcaggtgttttggtgtgaacaatcattggacatggaagcagctgttgttcatttgtcaatttggctaggggtttctttaaccttgttctgatttgcacgtgcggaaggtcgtccctcgtccatatgttcatgtaggatgtatatatggaagaaagcgacagcagaggccctgaaagagattgcaaagacattgaaggtgaataagtcctgcagacacgacattgatgggggaagggcaaaacttggtcttggttcctcctacccaagaaaatgggaaaacgaaaaaaaaaaagggattgttatcaaaaggcgttgttgatgtacatgtcaatcttgctggtaggcgtgtaaacttgtacagcaagcgttgtgttttctccaggtcatttttcttttctttttggttttgtttcatatgtgttagcccccattggtatattctagagaaaatcgtggaattcttgtcaggcggaaattggcagtgttgaagggcttggttcatttgcaaatcttggacgggctcatcacccccggtccagtttaatgctgtgctgctcaatttggtactagaatataacggtcaactaaaacctctgatgtgtgcgtccctttgacgagtaaaccggtaatgccgcttgagcttcggtaagaactggagttgctggtggtcactaaagctgggagacggcattgctggtggtggcagcgtgatcgatcgaacggcaaacacaacgaaggtgtagagggcgctgccgcatctaaaaccggactgcgttactgtgttagctcgccacggcgagattggtagccggatcctgcacagacgcgctgcgtaggcttgagtttagtcagtatgacgtgctcgaaattcccccagcatgagaggctcaggaaaccgagaaagctgggagtttttcctagctcggcgctggagccaagcaggacagggtactcctacatccaggcttacggcaatattgcggctgccgctgccagcgcagcgcacaatgcacgcacgaatgaaacaccattctgctgcacttgcaatcgatttcggtacgttactactgacccaaagcttttgtttattccgtgtgtcaacgaacgccactagcgactagtgcatctgttgctactatgcccggccgcttcgcgtagcagttgtcaaccactcttaactcggcaactccgctttatctcgcacactcactctgtccacgaaccacaccaccctacccgctgcacaaacctctgcacaaaacttacctataaatccatctcatctattcatgcagatgcaactcgtgcacagctctcatctcgcagccaaaaccactttactatctcgcagccaacctgtagcaaaagctaatcaaactagctatcaatcatgagctccggcgagcctgccgccgtcagcatccccatccacgaccaccatggcaaggccccggccacctcctccgccgtccctgctgctgctgctgctgcgcccgccgcggctcccgcggtggcgccacgcaaggtcggcatcccgttcttccggcgcggcgaccaccaccgcggcagccggtgcctcgcgttcctcgacttcatcctgcggatcgccgccttcggccccgcactggcggcggccatctccaccggcacgtccgacgagacgctctccgtcttcaccgagttctaccagttccgcgccagattcgatgacttcccggccttcctgtcagaatcacatatcatcacacatccaactcgatcacccaaattaaccatcgattatgccattcaaactgatgatgatgatgatcggatgcatatgctttgcaggttcttcttggtggcgaacgcgatcgtggcagggtacctggtgctgtccctccctttctccgccgtcctcgtgataaggcctcagaccatcggcctcaggcttctcctgctcgtctgcgacatggtatgtatcttaatctaagcaatgaaatggtttctttggatcgatagatttggctcctgatgagaattgatttgatgcgtgtactgcagatcatggcggcgatgctgacggcggcggcgtctgcggcggcggcgatcgtggacctggcgcacaacggcaacctgcgggcgaactgggtggccatatgcatgcagttccacggcttctgccagcgaaccagcggatccgtcgttgcctccttcctcaccgtcgtcatcctcatgttcctcgtcatcttggccgcctgctctatccgcaagcgctagcttaatcatcttgctagctaattaaaaaagattgtgcttaattatacatgcatataatatttacgtttgatttctatctgcatgcgcgagcgagtgcgtttttattttcgaattgtaatcctcttctgtactacatgcatttctttacttgtgagcattggcattggcgagtgatcgagcagtagtgcattgtaaaagttcacctgtgcatctatcgtttcactttctttctttcttgtaaaagatcaacgttgtgtgatcatcgtgctctgtaatctgaattgaacagcttgtttaaaacaaacattctgttatctctggtgtcaaacatgtctaataaatatcttattttgtcggcaggttcttttaataatgtcagatatggagtagtcattaatatatgaacacaatgcgcaactcaacaaatttatatagtcttacggatattttttttataaactagcataatattcatgctttgctatggataaaatactcatacttatttgaatatatgtgtactcacttgattaaaaataaaataaactactacataatattataaaatatcatgaaataatttgtacaacatgcaaaagcaattatgttgggctgatgtcaaaatcactgcaactgctattatcttttatatatagtagtattgattcagtcttacctattttgttttttttaaactaatataatatgcccctacattgtaacgggccatgtccgtataagtgtgaccgggataaaacatttagatccagttgttacttacttacttacttgtgctaagtgtgtgggcgcgtggtggaagaaggggatggaaagagaatgactccgtttttaaggtagggtaagagcatgcccaacagttttctaatatttaactcccgaaaattctaaattaggactatcaaaataaaaattaggctcaacaaccactcccttctccaagagaaacctaaaaattaaatcccaataatttgttggtttgccacataagtatggtgggaccacttgagagttgatcggcctctcccctctccatgtacgaacacccgatactcctcttcccctgcccgcaggcggagccgcctcatagttcgtcgcgatcggactgctgttcttatcttaatctgttgaaaaacgaaacattaagagcatactgtagctattcgtgttatcaaggaggtaatcccctagccaatatcattgatccgttgatccctagccaaacgacaagttgttgatcatgtacagctcttctgccgcaaaaaaactgataactgataaatgcatccagatttatttcaatagcaatcagtagcaatttagcagcacttcagcatcgtttcagcggcatttcagaacagttgcagcaatcaacattttagaacatctgcagcaatcagcagcaggcagcagcagcatttcagaacagcagcaacaatcagcattcagtacagcaccagtacatactccacagcacatacccacgaaaaacatcagcatatacttcctgctaatatttactcttatacagttatacttcctgtaaatattttcgtggtctctctctctctatatatatattaactggtgcaccatggagcccaggctccaacttaatccaccgtccatttgctttagaatgcgtgctttttaaaaccagaatattgaacgaattagtgggtttaatccatttaacccgttaggaaagatttgcatcaggtaccattccatttttaattcgcattcatgtatttccaaaggacgtacggattttgaatgtcattatgtttctatatcatagatcgtccaaaaaatcagccccgttaattacgttgaattgatttcttttccatttatatgaatttttctttttttttgcacgtatatatataaaccatccaacgatactcaaaattttacaatttaattagctgcatgcgctccgccggccgggagtacttctaccctcgttgctgcgagcttgcaccatgccgggacgccgccggtcgtccgcgaggttcatcgctgccggttcgtcggcgaggtttcgttgccgtcgccagtcgctagcttcgtcgccacgccgtaatgcgccatcggttgtctgtgagattcgtcgccggcaccccggtcgtccgtgaggttcgtcgtcgtcactgccggtttccccgtgaggaggttcgtcgctgccgtcaccggcgatgacgtggtttcatgtgtaatttattttaatctattcttatattttggcgggttccggctcaactgttttgcaggttgagtactgacaattttctttgtttgtcaagaccttaagacggtgatggatcctactaataattaagttgttggttcatcctcctatagtgatccaatgactgtacacgtatgctgccgcaggatgatcaggagaagatggtcgtaggaagaagaagcactagttggatgcacgcactaggagctagtaggctgttattcaaattaacttgaaaactaatttgaatatacaataattctagagtatacaaaaaaaaacttgtgtcggatacctttgatcgcatctatatgaccacagatttttctagaataagaaaaaacagctagttttaaacatttgtgttaatcacttatcactgatcactgaaagaataataattttaaatgtgaagcactaatattaagacgaatagactcagtcagacaggtttcaccacactcaactcgcaaaatatccaatcatactttcgaaatttaacggaagtttcaaagttccatggttcaattgcgtcggcattaggtatattttgtcgcatacttaattagccacagttatataacgaaaggatttttcaaactactttctccgtttcaaaatgtaagtcattattctagcatttttcatatttatatcaatggtaatatgaatctaaatagatatatatgtctatattcactaacataaatataaatgtgggaaatgttaaaatgacctacattgtgaaacggatggagtatgctatactgatgggaagtgctagttttgcatgtgtgggagatgctatatatacagatacacgtcaatacatacattaactatactaggcatagaatacccaatctgtagtacttaaacataagtttccacattgactaaatttacccaaactatgttattttttttcacgcgcatttagacaggtgcgtacccaactagaaatgggtatttttccaaaatatgcatttcagtgggtatatgaacgtacttcaaatcttgatttcctggaaccatgaggtcccaattcatcatccttgcccaatttattagtttgtactctagaatatattatacctagtttaataatatttcataattgtgtgtttaaaatactcttaatatccatgttcattaaaaaaaattattccacggtcattcaaattaatacgaagtattttggtactatgtatatactccctccgtcccaaaaaaaactcaacctcgtactacgatgtgacacctcctagtacaataaatctaaacatactctatgtctagatttgttgctttttttttgggatggtgtatctactatcccactattccataaatatcagaacctaaaattcatctacatgggcaggatatacgtaccacacaaggcttatatacctacatctacatctggtcagctacctagctagagtagaaaaatacttaactaaaaggcccagcaaatttcaaattcagttcaagaaaaaaaaaagcttcatgcaaaattgtgtgtgtttcagatgcatttagataggtatatacctaattaactagaaaacacagcacacagggcttatacctacatctacatgtaactagttacatctggtcagctacctaactaaaaagcctagctagtttcaatttcagttctaagaaaaaaaaataagcttcttgaaaaatcaaattatttttcacacgcatttagataggtatataccaactagaaatatgtatttttttccaaaatatgcatttttaagggtatatacctagtacgtgtgtttaaaccggtatatactcaaatagaatcatgatacgtcacatacctacctacatctacatctggttagctacctagctagagtataaaaaatacttaactaaaaggcctagcatatttcaaattcagttcaaaggaaaaaataagcttcatggaaaatcaattttgtttcaggtgcatttagataggtatatacctaattaactataaaacacaacaaacaaggcatatacctacatctacaagtaactaatttgtcagctacctagctagagtagaaaaaaaaacttaactaaaaggtctagctagtttcaaattcagttaaaaaaaagctttttgaaaaatcaatttttttacgcgcatttagataggtatataccaactagaaatatgtattttaacaaaatatgcagttttaagggtatatacctagtatgtgtgtttaaaccggtatatacccaaagagaatcattgatacgtcgtcacacatacccaatataccggtatacgtgtttaaatactaaaaaatatgcgtgctctaaatggtatattatacccaattaaatggtacatctaaactgcatgcatgtacgtacctagccgcttggtagtaagggtgaaaacaggacgggtatttcctgcttgaccgcccgaccgtattaattcggaacaaatttggctcagaaattcgggtacccaaaattttatacggatatagggttcgaatacgggttatttttggtggatatgggatcgggttcgggagcgcagtattcgacggatacggaaatacggatactacccgaatatatatacggatagtacccgtattacgtagtctgtacaaccaaccaaccagatttgaggcaagctagccaaaaagccaacaactcaggcccaaaactcaccggcccaatagtattgttaacccgaggaaataggagagagatgaggagaccgagtggagtgattgttcgtctgttcctattcctgggcggcggcggcggctcctggctcctgccgtcacgggctctcggcgacggcgtctcctcctggctcctgccgcggccgcgcccttgcgacggctgccagcagcgccacccacgccggcggcgccgctccgtcaccgcgccggctcccacggtgctcgtcaccaccgttgctgcacggcctgcgtcggttgccatctccgtcgtgccgtcctgccgtgtgcaggcctgccgtgacagccgtgtgcgccagtcgtcgtctcctactgatgatttgagtgtcttgtccttaaatatggtttacgtgaaatggtttgtgttttctggttggctcaagactcttgtgaaatggtgatgtttcctggttggcatttggcaagacatgtttctgagtattatggtattatgtactggagtactatgtggctgtgagcctgtgactgtgactgtaatgactataagtctccgttatgaagaattggtgatattttggcatgtggctgtctgacgtactgtactacttttagcttgtggctgtgagcctgtcacgtactgtactactgtgtcttgtttcctaagcccctaatgacctaatataatcgcattatggatatatagatttgttgaatggttattatctatatggtatttatgattgtttcttcgacttgatatccgaataagtatttgtaaccgagagtgtacgtatccgtttgggtatgtattcggcccatatttttgcccgatattatccgaacctatatccgtattcgacactatccgtgtccgacccgattccgattataaaatataggttaggatatgagaagggtgagatccgacccaatccgacccgatttcacccctacttggtagtacatttgaaatgcatgcacgttgcatacccaaaaatttttggagcatcttcttcaggttcatcgacacaaattaagaaggtccaccttacttttgtaagaaaaattatactaccgaaaaaagtccatactaaatggaattgatttgccataagtactatatcaccaatattaagaaacattttttaaatatggcatatccgatcatatgcattaattaaatatcattatcatcccataattaggctattgtatctgacagcttttgattcgttgtcaccattccatataagaaatcgttactgggtagacccgttaactttcatactcacatcaatcgatctgatcagagccaaatccaacggtatgtagcattggtgcccatacactatatatatatatatatatatatatatatattgtgaggggatctagtgcctggttctcccaaaccagggaggctggctggtcccctctgtcctctgtcgcctgaatgttggaggacggcggttgagcgggatggggaggcaccaacccacagagaccatacctgggtgggcgcgacgggacaccggcaccccgaatcgaggcggcgccggcgacgctacctgcggaagcggtgacggttgtcctccgcctggatccgttgaagaagtgaagatgcagccgtcactgccatagcatgcgccgcacctgcgaagagcgccgactccatggaagctagggagatcgatgcaggcattccagctctctgtggagaagagaacgccggcgacggtacagatcaaaccagcggcagatgagggcgcaaagagaaagagctgcgtggaaacgtttctctgcgcgcgcgcgaggaggctggtttcctgtgatttcgctgattgggggatgaacggacgcccctacgagaaaccatgatttgggaatcataactattgggcccgaggatagggagactgttggattagatttttcaataaaaatcccctaatattaagattgggattcatttagcaaatctgttaggcatgctctaaggagatataaaatcagaattacaggatgggccgaattgtagacgaaatccggcccacccgggccagtccagttgcggaagtaggacgcgcgccaaataacacgacccgagcgccagatagcatcccaaagtcgagaacgagacgagacgagccttatctccaatccggattacacatcgcgtcgcgtccgcatccaattcccgggccattcgaaatccccaacaccagtagccggccgcggcatgcagttcctctcgctctccgccgccgccgcctcctcgccggcggccgccgtcctcccaccgaagccattcaaacccctctcctccgcggcccccttccgtcgcccctccccgcctccgccgcctccgtccccggtgccctcacccgcgccaccgccaccgccgcatcgcccttctccttctcctcccccgaaccccctctcctccaagctatggctgtccagcaagctctccccgccgccccccgagacactagagcagccagagccttctactactactactactactaccccgccgccgccggaaccggaggcggaggcggaggcgcggcggcaggaggaattccggcacaaggggaaggtcttcgtcgggaaccttccactgtgggccaggaaggcggagatcgccgagttcttccgccagtttgggcccctggagaaggtcgagctcgtgcgcggccacgacgatcccgagcgcaacgtgggcttctgcttcctatactacggaggcgacgacgcggacgccgcggcggagcgtgcggtggaggttgacggggttgacttccgtgggaggtcgctcaccgtgaggcttgacgacggcaggaaagggagggccagggctgagcagcgggcgcgctgggtgaacgacggccggaggcgcgagccacggtcgccgtggcacgagggcagggacgaggcgtgccgtgagttccgcagggtggtggaatcacggcccgacaactggcaggccgtcgtctctgcattcgagaggatacccaaggtgtggcttctcatctcaaaatctattttctgctatttccggtgaataataggacatcaattgcatattatgtattttttttgaaaccaaaccaattgcattgttataggtgtacacgtgtgtgttttcaagaatgcaaagcaggtgaagtttttctataagtaattttgcaggaagcagtaccgttcgcataggagtcctacaaatgtcatctgtatttcggaatagggattaatgtgccactgaataggcacatctttattatacaatgcatgtttgaatttacatgttagcaaacttgtcatgaaaattgtcatttcaatgccatcttcagctgtctggtgtagttagcgcatacttccctctttgtaagcaaagttttggatgtcctggatcttacttacccatttctttttaaaaaactgctccatgaggtaatattcattacacaaataccagatgcttcatcttttcctattagatttgatgctaattcatgtagtcaatatatcatatagttcactagttcagtatatttgttattttcttttagataatggatcctttattgaactcattaaatcacatcgaggtgatacaattgtcctcccgacctttgcattataagttataacttttcttgagaataggtatacaattacttcattgagatttctggttagtgagtgagcaactatattttttcgaataaaattataaaatgtgccaattcttaatgttcaaaaatctctacattcatggttatgtgttcacatcttcccaagaaagttcaagtgccacaggagaaaaaaacaggtctagctgatgcttattgaatttattgcattgaagatagaggcatctcataactcatattaccattagtacattgttgtatgcaatgcattgacacttctatcttgatgtttcagccatcaaggagagaattcggtctgatgattgtttattatgccaagcgaggtgataagcatcatgctcgtgcaacatttgagaacatgagagcaagaggaatagagcccaatgcatttgtttttacaaggtaggtttattctttctgctatttgcaaacgttttgttgctgttcttttccaatcatggacaaactggtgtaggataaaatgtgtagccagaggatttgtgtaaaaaaaaaacaaccctgaaacagacaggctacagaatttttactacgtaaagataagaacttacatgagataaacatcacgagggaactgaaagaacagttggtaaggaaccttacacagaatcagactaattggttccttggatcctggtttgccagcttgagataagaaaatgttcactgataaaattgttgacatagaaagccatgtaactttcatggtgtaagcatatatggtgcaactgtttatgcctggtatgttagctttagcaaaatctttatgattgctctaattgctgcttgttgatttgcctcctgcattaaatttacttcatttcatgcagccttgttcacgcttatgcagttgctagagatatgcgtggagctctgtcttgcgttgaggaaatgaaatctgagggtcttgagctgacaattgttacctacagtatccttatttcaggattcgccaaaattaatgattcccagtgagtattttctgctcattgactagagcctgttctacgtactactctcacatgctttgttcagaatgaatgatagatctgttatagctcttttatgcgtagcatattctcattcagttttaaacatttctctgtgcatttggccacttaaacattctctcgtctttcttggcccaaggaccctgactttttgctaatatttttttatcttgtttgaaagatctgcagataacttgttcaaagaggctaagaccaagcttagcagtctcaatggaatcatatatagtaacatcatacatgctcactggttagtatttgtcagatttataaacctcttggaacttaacactgatatgagattgatttaacactaaagtacctgtacttgcagtcaatctggcaatatggaacgggctgaagaactggtgcgtgaaatggaagaggatgggatagatgctcctatagatgtatatcacagtatgatgcatggatataccatcattcagaacgaaaataaatgtctagttgtctttgaacggcttaaggtatagtggaaactgtcttctcatgggtaaccgatctggctttcttatatttctattaagtccagtttggtcctcaatccttcttgtggtctaattttcatttcatggccagcttcaagaccatttagtttacacaactaaaatgccaaaactggtacaaataaccccttgtattcaaatcatcgtgttattatcccattttactgtgacaaagacacattgacaacttgaattaccattgaggttggtgagtcagcacttttttttttttgagcaagggcgactgcccccatttctattacccgaaatggaacatagtagtttacagagtgcaaggaagaaagacatgaagaaacagcataagggctagaaaagacaacaaaaggaagattacaggtttctcattcaacaggaattccacaccaccgtgcatatgaccctccatcaaccgaagccgaaagcacaaaaacaacccctcaaccatagcaaaagctcttctgacatcagtatgctgggccaaaccaaaagaacatcaactttcttttgtgttcctgaagccatgtaccttcatccttccagtcttctcgtcctagtgtaccatccatacttcgagctgaaaacatcatttgctacctgccttattagcctggctcccagaagcaacttttcttgatttgcctccaacatctgcagcacagcccaagtttcaatccaatgacaagtcaagtaaactacatcaatgggatcttaaaacggatgggacctgcctgctgtcctgttctgtttttgctccttatctctccctccagatctggtaatcttatatctccaggatccaagtttctttcagattccgtcagttagctattgtaaccagtcccttggccagacctcacctctggttttatttggagcaaacgaaagtaccaactcaactcaaagatattttggaattcatggctggtaatcaaagaccgattcaagttaagaaattcatttctggattttccagatagtgagcaaaagaaacaatggggcacgacaattgcaggcccatggtaggaagcatagcagaagctgtagtagggccaggagcagtgaagtgagaagcttatctgccctgattctggcagcagcaacaaagtgccagaagtccaggagtgggtgagaaaggagaggtgggaagtgggaatttctggccatggtggtgctgctcagccagaaaccttagtggtgctgaccagcgatgaaagtatggaactaatgtgctttgtgatcatattatccatggaagctacaagaatgaaaccacaccctttcctctcattaatttctgtatgttccttttaaatatgcatatgcattgatgtttaggtgtatgagtatttttttgggaaaatgacctatctgcatatcactgcattgcatatctgtacagtatcggagtatctgggaaacacagatgatgaagttacttgatctgtggatacaactttgtatcatcgaggatggtgtcaaggaaatgaggaagagaaaaaataagcatatcgctgttatcgggccacaccaccctgtggactaaaatggaggcggttttagctcagggatgtaatttgcacctgttttgatatttggaagacctgtgataaatggttctaaagtttaagggtgaaatactgaaacgtaaaattagactacaagaggagttgagggaccagagatagatgtattcataatttttattttttctatctccccttctgatctgatttttcctgttttttgcaggagtgtggctttaaaccatcaataatctcttatgggtgccttcttaatttgtatgtcaaggtaaaagtaattctgttgcgtgctttcttgtcagttttcctgtaattttgtgtgttcccttagtagaaggaaacaaaaaattgtgcatcccagacaagtgtttttttccctcgtaaattatgatgtttaaacactcctttctgcaccattgatttctattcgttatatgactagtattctgaatatctaagagtccttggattcacctttttctgaaagcctaaggcaagggaagctttatgtcgagtttcttatacattgaacatgacaatcttcaactttgaaactcaaacctgcccctttattattaattgtaagataggttacttgagacaactcttaacagtgatcactgatgttgctctggtttcttttcttttctcttttcagataggtaaggttgccaaagcattatctattagcaaagaaatggagtcttgtggcatcaaacataataataaaacatactctatgcttatcaatggatttatccatttgcacgactttgcaaatgctttcgccatatttgaggaaatgctaagatcaggtctacaacctgatcgtgccatatacaatttgcttatagaggcattttgtaagatgggaaacatggatcgtgctatttgcattttggaaaaaatgcagaaggaacgaatgcaaccatcaaatagagcattcaggcctatcatagagggatatgcagttgctggtgatatgaaaagtgctttggatactcttgatctgatgcggcgaagtggttgtgttcccactgtaatgacttacaatgctctcattcacgggctagttagaaagcacaaggtatttttcaagtacatgctagtttcttcaaatctaatcctgtcatgtggcatttactttaaatttgtgtttataggttcaaagagctgtctctgtgcttgataagatgtccatcgctggcattacaccaaatgagcatacatacacaatcattatgagaggttatgctgccagtggagatattgggaaggcttttgaatacttcaccaaaataaaagagagtggtctaaaactcgatgtgtacatttatgaaacattgctcagagcctgttgcaaatcagggaggatgcagagtgccttagcagtcactcgtgagatgagcttccaaaagataccaaggaatacatttatatataatattttgattgatgggtaggtgttctagataagctctttagccaatgtttttactgactagtaacgatctttttaccgactcagtactcagggacgcttgtgaccatttatttatgtgttgactgcatcgaactacttagtcaactgctgtactgactcagggatacaagaaagtattatggaaaaaaataatatagggggtagagaacaacccctcaatatttttagtagaaggttgtggttgaacctgtggagggctagcacagcgaactgtgctgttagccagtaggtcctaatagtctcctcacatgaaactattatgatatttcattggattagtcatacattagttttgaaaatttgtattatatactgagttcatgttttatttgagtcttgctgtaatttatgaagttttataaaagcggtatattttcctttttgcctgtttcgtcacaaatccttttgtgtagatgggctcggagaggtgatgtttgggaagcagaggacttgatgaagcagatgaaagaagatggtgtccctcctaacatccatacttatacctcctatataaatgcatgctgcaaggcaggagacatgcaggtacgagaattttgcattggaatacttagtttcttacttattgtgagttgtaaccgtgtagtggagatagcctgattttgataggatatgtgcacatgttttaaggtagctgaccaaaatattttacaatgccatgactatatgcccgaattatttcagcactacagatttacctaggtggctacatattcaaatttggcacttgtgaatggagaagtattctcttggggccttcttgtaatctatccaattatttttttttataaaatgatttgtttgtagagagcagaaaaggtgattgaagaaatggtagatgttggactaaaacctaatgtcaagacatatactaccttgattaaaggttgggcaagagtgtcacttccagacagggcattgaaatgctttgaggagatgaaacttgctgggttgaaacctgatgaggcttcttatcattgcttggtgacttcacttctgtcaagggcaactgtaatggagggaagtacctacacaggaatcattagtgtctgtagagaaatgtctgagaatgatttgactgttgatcttcgcactgctgttcactggtctagatggcttcacaagattgagaggactggaggggcactaacagaagcgcttcagagaatatttcctcctgattggaattcattagaatttttaggagagccatccagttctataagcatgggggagtctgatgattacagtgattcagattttagcggtgatgaagatgaggatcataatattgatgatagctgaaaaactctagattccagagcctgtttttcttgttctgtgccctcactttttgtcctttggttctgccagagtggatgaccgaacaaggtattatgtgttgaactgttaatatgtgtttaatatgccatttccttttggtgatgtttctaaaaagcacacataataattcttgaaaaggagtctgccaacaatcatttgtcattactcattgccactttttggagttcctggaaattgcattgaactaacactctttgtttccatggcagcaatgtctttgatcaaactgtgccctcacattcagacaccagtggcttgtggactatccaagagcgtttggaatcttatagtgcaataagcgtgagctggctggcctctgctgcgtttcttcaagagcaacagtcagtaacagttctactgggactgaagacacaggctgtcaatgcaacagacgaagcttactcagttatgcgtgtagctgtacatatcaatggctggcacaggtaaatattcttgagatattgacagattcaattgttgtttctctccatcctttcagtatagtccaacttgatataaaatccaattccatatatatgtgtataaatgcaagtaaagctataccacgttaccagttaccacccacaccccttcttggcttgccttttgtagtgtgccatgtgaaatgtaccgaccatgatagagcctgcgtgcccatttttcaacatccaaatgttaggagtggtaggagcgcttataggcatatgcttgaacaccactttgattggcagaattttgtaggggcagcacagtgtgcctacaaggtttggttttgtaaccacatccctggacaagccgttcgatgcttatttgaatactagtacgacaaaccaatctgtgtcgtggtgctcgtaaaagctgagatcatttaaacttgtaagtagaaagttggacgagcttttttctcttcgagagaatgcacaggccctcatgttctttgttttgatgatcttaaaaaaaccatagtcaaggtaaataggagcaaagattggtatcttgcacattattgcgggttgggcttattcaatgggggaattccctattgaaactgaagtacaagtccaatcaagtgctagatgatgactgttttctcatttaaggtttggcatcttccagtacagcagcttcaatcaaatgggccttaacgtagctcagcccgattcaatattacttggaattgcacgcctctgtccaagctgaaagcttttactagtaggacacttgaatgcctgcacaagacggcattaatgctgtgcttatgagcccgatttcttgagactggtgttgagtttgtgcgtatgtgtgtgctatgagctgcgaatcttagctggccggtatctttcattgaatcgaaagtggcctccccattcaagtcttgcccacaagataaaacagtgcttcatttatgcctgttatttaattttgcttagctgcatctcgcttctccattcatacaccataaattctttcaaagaaatcttgattgtattagtgttgtattaggcctttgttcggagagaaaatttcatagtaccaattaccccctccatcccaaaatataataacttctatcactaagagtttgttccaaaataaaataacttatccaccaacattctcttcctaactaatcataaccctgcaccatttaatttttccatctacctccacttctcaaccaatcacaatatcatcat
